United States Patent 8,781,750 (CELL-TYPE-SPECIFIC PATTERNS OF GENE EXPRESSION) - sequence listing, part 61

SEQ ID NO: 38700 - DNA, 116220 bp, Homo sapiens
gggcgacgagtgcgggcctcggagcgactgcagcggcggcggcggacgcggcctgaggcgagcggcggggcgtggggcggtgcctcggcccgggctcgccctcgccggcgggagcgtccatggcccccgggcgccggcggggcgcggccgcggcctgaggggccatgtccggggtggtgcggaccctcagccgctgcctgctgccggccgaggccggcggggcccgcgagcgcagggcgggcagcggcgcgcgcgacgcggagcgcgaggcccggaggcgtagccgcgacatcgacgcgctgctggcccgcgagcggcgcgcggtccggcgcctggtgaagatcctgctgctgggcgcgggcgagagcggcaagtccacgttcctcaagcagatgcgcatcatccacggccgcgagttcgaccagaaggcgctgctggagttccgcgacaccatcttcgacaacatcctcaaggtgacgcgcgccccccgcccagcacctgcacccaggtgggccggggcgctaacccccgccccgggcccctccgtggtccgccgccgcgggcggggacccctggggcgaggatgctggatccagccccgcctgcaccccactcccccccgacccattccccgaggcctgctggcgtcgtctctgccccaccccgtctcgccctttttgagatggggtctcgctgtgtttcccaggcttgagtgcagtggcgccctcacagctcactgcagcctcgacctcccaggctcaagccctactccctccttagcctcccgaagtagtgggattacaggcgcgcaccaccagcccagctaatttttaagtttttttttgtagagatggggtcttgctgtgttgcccaggctggtctcagtctcctggcctcaagtgatcctcctgccttggtctccctcaagtgctgggattataggcatgagtcatggcgcccggtctgcctctgccctctctagggtgcctggggaccgtgggagtgggaactcgggccagcttctggggatggggagtgggggcttggcacttagccccctcctggatgtgccctagcagaatggtatctgtccatttcccactggaagatttgtgggataggagcccaaccggccgtgccctccggctgagcttagaagaagagcagtggagactggacgggaaccagccatgagtctctttttacttttctgtttttttagaaaggctctcactctcttgcccaggctggtctcaagccatcctcccacctgggcctcccaaagtgctgagattacaggtgtgagccacactttctaatacgaaaacttcaaatgtatacaaaagtagagaaaatagtagattgactgtaaagtacctacagcccaactaaagcagtcatcaattctgtgccaatcctattcacctgtgccctccccatggtctccaagcaaatccaactttgtgtagttggattaggaaacgttttaggatgtatatgagtggctaaaagatgaggcctccatgtaaaaacacaaccgcagtaccattagcaaacctaaacattagtaatagctcattatcaccagatatccagtgttcagaattcctccattgtggcataattgttttgtgtgactcgacatgcattgcaatgaatctccagattctcctgtctcttgcttccttttttctcttcgccatatttgtgaaagaagctgtagaagtcggccaggtgtgatggctcgtgcctgtaatccctgcactttgggaagctgaggcaggaggatcacttgaggccagaagtttgagaccaacctgggcaacacagcaagacctcagtgccacaaaaatgaacacattagttgggcatggtggaatgcacctgtagtcccagttgcttgagcggctgaggtaggagaattggttgagcctgggaggttgaggctgcagtgagccatgtttgggccactgcactccagcctgagtggcagtgaaaaaaaataaaagaaccatagagttgataaagtcggggttccagtctctcagtaccgtgagcctgtgttaaagggcctcaaggaagatctggaggaaactgatgatgagggaacagtgcagccttgcttacacctagatagcgtcctttgtcctccctccctttttccttccttcctttccttcttttctttccttcctttcttttcttcctcccttcccttccttcctttccttcctttccttcccgccttccttttcttcctttctttctaccttccttccttttttcttttcttccttcctcccttcctttctccctccctccctacctctctaccctttccttgtcccctcaccactttttccccagcccattttggggaaaccaagttagaggcgaggacaatcatctcaaagcagagtcggagagaagtttgccatgccagaaaacctgcctggagactaggttttatggtgcctgggagattttaaatttagcaaagccccgtagaaacctatcgggtacatttgtatcacttacccataaggactcctgcctcagccctagagatgaagtgactccttcctggggtctctgtgctggaatcctggcctccagacttccaggccagtattcgcacttgacatacttctcatggaaatgtttcattttaatagagctcctttaggattgtgaagggaagaaaataatttgataaaacaccctttttcattttacctctttccaagcctctcggtgcgtcagagctctggtcagatacttcgtgaactttgaagactaggtgcccagcttagctcactgggagcgtctgtgttcaagtgcatttggctgtctcagggcctgccctgtaacttctctgttaaagatcctgattttattgttgctgcttgcccagacctcagaaccaggcaggcataaaagtatagcagtttgactgtctctagtttcttccaactcagtagatggagaaagtatttggaaacatagaatctgaaatctaaatccctgtatgaagtgcgtgttagaaaactcaacctcctggcaggagaatggggtgaacccgggaggcggagcttgcagtgagccgagatcgcaccactgcactttagcctgggcaactcagcgagactccgtctcaaaaaaaagaaaaagaaaaaaagaaaactcaacctcctgatgcatagaaacactaacttccactgactttcttatcagcagaaacaaaatgtgttaactggtatcctagttcttctttccagctttgttttttactaattatagttccatattaaactcacttcatgtgtcgtgaccatttcaataacaagttagaaattcatctttcaatttaaaaccaaaaatcgtttcctcctcttcagcccccacccccgcatttttattcgaacagatcactttgagaagagactattttatttttttatttttattttttgagacagagtctcattctgtcacccaggctggagtgcagtggcaggattatggctcactgtggccttgcgtcgcctcgtgggctcaagcaatcctcccacctcagcctcccaagtagctgggactgtaggtgtgtaccaccacacccagctcatttttgtagagatggggtctcactatgttgcccaggctggtcttgagctcttgaactcaagcgaaccacctgcctcagcctcccaaagtgctgggattacatgtgtgaaatactaaacttggccagggaagggactttaaataaattgctctgcagtgcctttagtactggacatttgaatgataccatttagaataatacttgtggctatatagagggttagtgttgacaggctccttctagagcacggactgtgtgctgtacacatcgtgcctgatcctttcaaatatggtgttgaattttcataatgcttcagatggtattacctcatttagtgaatgaggaaattgaggatagagacattaaaatctgttcaaagtcagctacctaattagcagatggcagagctaggaactaaacatgccttttttaaaaattaaacttttgattttgagataattctggagtcctatgcagttgtaagaaatagtagagatcccacataccctctgccagctttccctcagtgattatgttctgtagaactagatagcacaatcttacaaccaggatattgacgtcgatacagtcacgatacagagcctttccatcagagaaggacccttcatgttgctcttttgtagccactctctccccttcctgtcccagaccctggcagtgaataatctattctgttgttgttttgagacagtcttgctctgtcgcccaggctggagtgcagtggcacaatctcagctcactgcaacctccgccccggggttcaagcgattctcctgtcccagcctcccaggtagctgggattacaggcgcccaccaccacgtccagctaatttttgtgtatttagtagagacggggtttcaccatgttggccaggctgatccccaactcctgacctcgtgatccacccgcctcggcctcccaaagtgccagatgtgagacgccgtgccccgcctctgttctttaattcgataattttgtcatttcatacatgtcatggccaggtgcaatggctcatgcctgtaatcccagcactttgggaggccaagacaggcagattgcttgaacccaggagttcaagaccaacctgggcaatatggtgaaaccccatctctacaaaaaatacaaaaattggctgggtgcagtagcaggtgcctgtaatcccagctactcagtaggctgaggcaggagaatcacttgaacctaggaggcataggttgcagtgcacagagagcacgccactgtactccagcctgggcgacagagcaagactccatttcaaaaacaaacaaattagccgggtgtggtggtgcacacttgaacctgggaggcgggtgggaggatcacttgaacctgggaggcaaaggttgcagtgagccaacatcgtgccactgcactttatcctgggcgacagagtaagatcctgcctcaaaaaaaaagaaaagattttcctgttgtctctcttttgttgatttctggttcgactccactatggacagagagtatactgtgtatggtttcacttcttttaaatgtattggtttgttttctggcctaggatacggtctatttggcagatgttctgtggtcttttgttggtgaacatcccgtaagtacatgataaacgcgtatgctcgtttggcggaatgttctacatgtgtcagatcttgattgatagtggtgttgagttctatatgcttgctgattgttcagtagttctgtcagttaagagtcctcaactataattgtggatttgtctatttcttctttagctctatcagtttttgtttcctgtattttgaggttctgttgtgtggtgcataaatgtttaggattattatatcttgatagattaaccttttttattatgtaatgtccttcttttttctccagtaattttctttgaagtctccattatcagatattttaatatagccacttatgtttttattaatgctttcataatatatatttctccattcttttaatacccttgttttgaagtgagtttcatatagacagcatattgttgcatcatattttttaatccactctttacatttagggtaaagtcattattatgactgttactatcttagagacaaggtcttttgctattgcctaggctgaagcgcagtggcacgatcatggctcactgtagtcttgacctcctggacccaaaccatcctcccacctcagcctccctagtagccgggactacagatgtgcaccaccacacccagctaatttttaatctatatttattttttgtagatagggttccactatgttacttagggtgctcttgaattgctagcctcaaagccatcctcctgcctcagccaaagtgccgagattataggcatgagcgatcctccctggctgatttttttttttttttaagtataatgctttgtattattttcttggtagttcccctaggtttacagtatacatatgtaacttatcccagtctcctggccaaagtgccgagattacaggcatgaactgtcctccctggctgattgatttttttttttaagtataatgctttgtattattttcttggtagttgccttaggtttgcagtatacatgtgtaactgatcccagtctcctggccctgatgttttacagctttaagtgtagaaactttacttctgcttgggcccatttacccaccccacttcactataaatgtcttagcacttaacagactttgaatgccacatcaggtggtttacttcagtcatcaactgtgattttaaaaactcattaggagtaggagattatattatcttttccccccttttgactgaataaaattgtcccttttttttttattacctattctgatggtcttctttctgaggctctaagccttcttctgttgtcatttcctttctgtttagagaacttcctttagccattctttaacgatcagtttgcttgcaacagattctcttagctttcctttgtccaagaatgcctgtatttcctcttcattcctgaaggataccttcacattgtttcagaagagaaatctactgtcgtttgagttggtctcctctccgagttcatgcattgctcctctctggctgctttgaagagttttatgtttagttttcagaagtttcattatgatttgtcttggcacaggcttcatcccatttattatatttggggtttgcttggcttcttgaatctgtacatttatgtctcttgccaaatgtgggaagttttcagccattatttcttgaatgactatttcagtccctctctctcatctccttctgggactctgacatacggctgttagcacttttgttaatgacctccgggtctctgagaccctgtggccttgttgagtggggttggaacatcagctcccctctgggcgttgctgattctagggaatgggagggggtagcaaagcgacagctaatccagccttcccccctcccaccctcccatcccctctttctgcctcgtggtgggggtgcacttccccactgggccctgctgacaccaccctggtgagggaattggagcacctcctgcttcttccaggcagagaatgggaggtgagatccctgcttggccctgccagcactatttgacatgccacttggagcatgtcacctggttccttgagggtagaagatcaatttccccctcaattccactgaaacctcagtgggtggtatatgtggtttctctgctgatgttttctcttgtatttgttttttgttgttgttgagatggagtttcgctcttgttgcccgggctggagtgcagtggcgcaatcctggctcactgcaacctccgccacccaggttcaagcgattctcctgcctcagcctcccaagtagctgggactacaggcacgcaccaccatgcccagctaatttttgtatttttagtagaaatgggacttcaccatgttggccaggctggtctcgaactcctgacctcaggtgatccacccgcctcggcctcccaaagtgctgggattacaggtgtgggccaccgcacctggccttctcttgttatttggaataggacgggcattgccaaaaaggtctgctgttgtaagagcatccttttctgggtcctttggccaagaacaggctcttcttggagttctttttctctgtaccttttggctgttccagcttggaggcttctgcagcgcccatcctgggtaagtaggaggcagtaaggacacccagagaactcactgccttgtcatccctcaagtcctgaggtcgctgggtagcctgccgccttctttccacctgctttctgcacttgctggttgtgttacattcagaactttctttttagctgtaagggggcagacctgggaggagtagagctgttactttgtggaagtctccatcatcctggtctttttactcagtgtctggggcttttccatcttgatcacagttgtgcctgaatttgcacataggatttctgttagatagtgcgaggacttcattacctcactctatcctctgcagttcattatttgaatctactagttgctttgatttttttgtaaagattgccagtaagactttctagtttattctttttttcttaaacaataatcaagtttattaaacaaatttttttaagtattataaaatgtttaactttcatcagcttcaaggtttatgctgctcccaaattttgcatacaactgaactttcaaatctgctcacacccactgaattgcttcgactttggattctaaggcgtcagttgcttcttgcaaatttttatttgctgcttctaacatttcctgtgtttcttcttgagaatggctaatgaagacatcaccgatttgataaggcatcattaagcagtcagcatctgcaagcatggtaccgtcacgagcatcttctacgttttggagttgtttctgttttacttctatttcttccttcagctctgtgattctacttgtattccatgcaaatttgtttatcttttgttgctcttcgaaagtaacattgacatcttctgcagccgtcttcttcatggtggccaccatctcgggactggagaacagcatgagacaatgggactttgcccccaagcgcgctcttgctccctgtcggcccagaattccctggcaaatacaaccctgtctccacattccctccccttggacccatggccaatgatccctaaaagctgggacacagggaggaaatgtcacctggaaggacttggtacatgccagttaaagggaccggcaacccccgtgggccaacatcaatgggggtgtggggaacagcctagtttattctttttatttttctaattctacagatgatatctcgtcacttcctgactgggctgtccttaaagtttgtgtatttggtgttcccgaagttgtgtaataatgcctctggtggtggggtgtgcctcaggctgttggaagacatcaggccagcttagatttatctcacagtgcttccattccctgacttatgtgtgatgcgttaaatcccaagagcgttttcattactaaatttcacatccagttagaagtggataaaatgttagctgtctgaaggttccttgttatatagactagaagtcctaaccatccacatgattgcattagtgtagcctttagccaccccaaggtagacttgtcttatatgcagatgtatagtcacgcatcgcaatgtatagtcatgcatcgcgatgcatagtcacgcattgcttaacgactgggatcccgtccaggaaatgcatcgttaggtgaggttcttacgcaaacatcctagagtggacctacacaaacctagataatatagctgaccgtatacctaggcctattgctcccagactgcaaacctgtaccgcatgttactatactgaatactgtgggccattgtagcacaatggcaagcatttatgtatctaaacatagaaaacgtgctgtaaaaatctggtgttataaccttatgggaccaccatcgtatatgtggttcatcttttaccaaaacatcattatgcagtgcgtgactgtttggctgattttagaaactttttgaagaattagatgattagagtgggtggtctcttgttgccactgaaacaaaaagatcaagttcaacaaaatctccacggcattgtgctaggtgctgatgcagaagggatattcagtgcatattgcagagcccctactctccactcgcactctcaagctggggagacagttgcacaagtaactttaacatacagcgtgaatggataccatggtaaatgccactggagaggtgttgcaggaggccagtgggaagattaattctggctgaggtatctaaaaaagccttattgaattgtgatttgagctggcctttgaaggttttgtaggatttcagcaagtggagaagaatacacaaatgagaaccatcttaatgcctctacatttatcagctaagacagaaaattcgaatacatagagatactaaagaatcagaactttctagtccaaaggagtggttgtaatgtggtggctttctttggactgcagtcgcagcactctagctgaaagctgtgggtcttctccctagaaaattcatgtatctgtgtagggtttcaggggagtgtttggacatccggaatcccaagagtgggcctactagtggcccatgcactgcaggttaacagcttttgttgtggaatatcaaagattatgtaaaaattttggaaattaaattttttttttgaagaattgtttgctgtatcacatgtactttttgccaggacgtacggaactttgaagcagcctcctctgctgttctggcctttaagagtctctgtcttgggagttcagaagtgcctctttaggcttgatgctgcggcgggtttgcgtggcggcagaagcatacatctgcttctggggtctggaagcacagtttggtttttatggccttgttggcaaattgcatttaacaggtttaccttatgctttgacatacggggttggtcctttcgtaataccaaaaaaccaaacaaaacaaatgcaaaaacatctttttccgtcagctaactaagtccagagagactcctctggccatttttggggattcagaacacatgagtgattggtcttgtcccctggctttcgagtttacatgttgattatcttaacgaaataattagggggagcagggtttgaccttcagtcatctgtcatgtgagatttggaagccagctgtgcttgatgtgagatagtgttccgttgacagctcgtaattattttctgttcttactcagttgagagtgggttcatggatcgtaccggttttaaatggaactgaagatttaaacttcggccttatctagagatgtaattatagggtgatgttcaaaccaaagaagctgatgttgtgtaatggacctagggcttaacttgcatcacctgaagggcagtgccatcccatgatgacaggccggctcatttcatgccgtaactattatggtttgtttgtacttaaaagaaatggaggcttcaagtgggctggacagagcagctgctcaggaccaccggattgccttttaatcctaaaagccgaatgtgaatatttgttgctgaccgtgtgatgggttagtctttctctctgtgaggataaatgctcaggtgtgtccaggttttgcagaatggaaaacatgacttgtatcctgtgttagccgttagagaagctcatgcttctggttgattctgttgaccaaatgcatttggaacgtctgctttggaagtgcggcatccagaggacagagaagcagagggtgggagctcttgcaagcagctagaaaggtgctggagggcagcacatccagccgctctggacggcaaggggaagaaaacatccctgacccccactttcttaagtagagaccaagtagacggcacctctctgtgaacgtcagcatctattttactgtctagtctgaagtccacagcaccaactttgtcacatggccctgttaaatcagaccacagcagcagagaaccagctgtagtgggtatttgctggtggaagtgtgccaggcatgggtaatcaatagctacttaagccaagccgaacagaaactaagcccgaggaacactgagacccgaagaatctgtgctaattctctcgtcaccgtggtggaacgttccagtgatggtgcatggcgtggactcctcgcagccctcgagtgcctgtttggggcagtcagtggaggttgcctggtctcaactgggaaaggccaggctagatgcggggtccacgggaggacctgctctgtcgttcagagctaggctttgtgctctgctgtgtgtatggtagtgagtggaggagacacagtcctggcctcgtggagctgattcctagttcacttctctggggacaggaaacacaacgggaggacagggcatgagccggaacatcactgggaaagtcacttggaggagaggggaggccttgcctagtggaagaggcctttcgactgtccataagatggatgaacacatccacctggactagtctaacgatgtcctggggccaaaatcagggatttgggctgcggagaaatttgtgacaaaacagtttgatgctcagtcaaggtgagatactggcagtcactgacaactccacgggatgcaaattacattcattttaaggtaaaattttgcacatctttgtagacaagatacacagtattccaggcaaaacccttgtgataagggagtcattacttaaagtctcacctgccttccggtttccattacaggtaagagggaatagctggttcagatgtttacttgtataatactaagaacacttttaatgtgtgttttccactcatgctcagttttatatctacaatttttggcgcacatgaggtgactaataactatttatatttttgtgaccacttgtgttttttttaagaaaatgaagttccaggcggggcgcggtggttcatgcctgtaatcccagcactttgggaggctgaggcgggcggatcacgaggtcaggagatcgagaccatcctggctaacacggtgaaaccccgtctctactaaaaatacaaaaaaataaccgggcgtggtggcaggcgcctgtagtcccagctactcgggaggctgaggcaggagaatggcgtgaacccgggaggtgtagtttgcagtgagcagagatcgcgccactgcactccagcctgggcgacagagtgagactccatctcaaaaaaaaaaaaaaaaagaaagtgaagttccataattttagttttagggtggggagaggaactgtttttccctaaggttctgatgacttgattagatagatatggatcgaaaactctgttaaaagtatggagtgatgtggaccaggaggcaaaactccctgggagatgagctggtcagaattgagaaatagaaaaccggtcatttactttcttatcagtacttatctggtatgaccgtagcacaatgagactgtttttaaacataccaggactgctggaacgcactagttaaagcagatgcctcatgaaaagtaatcatcttgggacagcaagtcaacaaatgcctattaagtgtgtgtttatgtgctaggtactgcagaagctgaggagatgagaagatggcctggaaggaatgataccttgataccttctctgtgcattgggagcttttgttttttgtttttttttcattaatttttttgagacagggtcttgctctgtcacctaggctgatgtgcagtggtgcaatcacagctcactgcagcttcgacctcctgggctcaagtgatcttccgacctcagcctcctgggtagctaggacacaggtgcacaccgccatagcccacttggcagggagcttgtgtgtttgaagcaccttatctgttatgtctttgatcctccgagtaaacctgtaaggtcaggttgggctttactctgatgggtgggattctcactttcctagcctcatgtttccttgcagagagatctcagctactgtgattctcttgcctctcctgccatcccttatccccctttgctcggggaaggagtgacttgcttgactggtggattttggggaaggcagtaagcaggtggggctcaggccctgtagattccctccaggttctctctttgggagccgccctccccacaggggacatgccttcctcctgccagagttgtagggccacctcccctgcgtttgtcccactatggcagtggtcaggagcctacttggctacaaacccaaaaccagactctttagtcagaaggccagtattttcatctccatccacctgactcctgttttgatttccaaatggattctagactgggagcagaggaagaaatattgagactcgtatgagcatgaacacagcacccaaggcaaaaagaagattctagggtgtgtagtgcatttcctgaccccagccccagtcccttaaggtagtattgaggcaagaaagagccattgcaaccctaaacattctgacaccttcccatctagaaagaaacagacccagagtcgggaatagaagccggggaaaagttcggggagaacactcaaaaggaaagggtccttggtggagccaggaagtgtggaggcacccagagctctgtgctgaccacagctcgaggcaggagtccactggaggttgggacacttactagctagcaggagaaaatccactagccccagacaagttcccagctctcatcatctccctttcctcagacagggattgaaagcagcgtctgtctgtcaaactctagctctggtccaagaagacaaaccaggtagaaacagaatcaggaaaaactggcctcgagcacgtctgagaacaggctggtggagggctaccacagggatgctggaaagggacaacatggcagctccgaaacaccgtccctaaagaaaagagggcgagaggaaaactagcacacaaaagtcagatgaaaaacagggtaagaagagaaactatgaaagagaagtagcctgtccaagagtgctctatattgtataagaataataagtatatagatgatataaaacaagagctccagggtatgagaaagcattaacatgagatgcacagggaaatggcagaagtaatagattgaaaactcagcatcgtcatagatctcataggtgcatcggagacaggaaggaactgaatagtaatgaacaacgatgcaaggggatgtctctgaatcctacccactgtcagcgtccccatggctgtagagttgggagtcagagagacactggactccttcaggcatttgcacaaaaaacatgaacctaaacctcagtgtttaaagaagccttagtttttcttatctctccgacagagggaaatatgggtggaggatttcccaattctaggctttctcctcctgtgtgcctgattttaaactgcctggggcagggacctgtttgtgagggccaagagcagcaaagggccttttgtacgaatagctggtctctgctctcatggaggtgagccctttgtacttcatacaatgagcagaccattttcttttttcttttctttttttttttttcctgagacagggtctggctctgtcgccgaggctggagtgcagtgatgtgatcttggctcgctgcagcctccacctcctgggcccaagccatcctctcacctcagcctcccaagtagctgggactgcaggcagacaccaccacacctggctcacttttaaaaaatttttgtagagaaaaattaagatttttgtagattttgccatgttgcccaggctggtctcaaactcctgagctcaagcaacccacccaccttggcctcccaaaatgctgggattacaggcgtgagccaccgtgcctggccaagcaggccattttcatatgggtatatccactaaagaagactccattggagtagagggaaatttatttctttgaccacctgctaaactgaagtcactagagcaggaatagttttgttttccctttcctggtgttttaacgtagcgtcctaaggtaacaggagctagaggacttgggggcagccacctgcagccagcttggtagacaacactttgatctttccccagctgcgtccctggtaccatataacaataccggctggatgtggaggctcatgcctgtaatcccagcagtttgggaggccgaggcaggaggatcgcttgagcacagcagttcaagattacagtaagctaggatcgtgccacttcactccagcccgggctgttgacagagtgagaccctgtctctgaaaaaataaaaataactattgtctacagcaaacattagtttagaaactgcattggtgatagttattttatagtacaaatccttaggaatataatttagctgtccagtagtgattatttaaagccttttctccctgtattcctctgcagttttcaggaagttttcattttgaattgtaggtgttttaatttctggtttgaatcttgctttacaatttttgtaatcttgaatatttttagaatgtgtaaatatctgccaaggagaccacaacatcttcggcattttcttttttaattggaaacttgtcttgtttcttaattcttggtaacttcaggaaaagagccaccaacttgcctgagttctttcctgttatctggagcaaattagaactcttctggtaaagtaagacgccctttttctagtctttcattaattaaaaaaaattttaaataaagtatcgggggtagggagaatgtttcaaatgtaggtgtttttgaagtaggttaaaagacttcaatcttgaattgagtcttctaaaaaaatttgcgcgatgtttttgtagttaattagcaatacctcatgatagatatacatgaatattttctttggtatgtttttataattaggtgattctttccttcattataactcctttctctgagtggttctgacattggtcctgccatctgccctattctaagtcatgtcctggtgtcactgcagtcaggagtcctgttctgtcctctgcactgctcacggaccagcccagccccactgtcctcagcgtggttatgcagaagccactgtggttcccttccagtcagtttggtggttattccctcagtttaggtgccttcagtccgggccacagtgcttgaattctcacgcgacatcacagacttcacctgaccagctgaagtttcgttaatacaacctttctgttttcactctgttttttaaaataatcgaggtaaaattcacataccatacaattaatcatctggaagtgtacattcagtagcatttagtacattcactgtgttgttcacccaccacctctatcaaattccaaaacgttccaatcactccaaaaggagatctggacacgttagtagtgactccccattccctccttctcccggcccctggcaaccactaatctgttttctgtctccatgaatttacctattctgaatatttcatataaatggaatcatataatatgtgaccttttgtgtctggcttccttcacttttttaaaattaatatactttatcacttaattttaggtttacagaaaaactgagcagaaaatacagatttcccacatactgcctgcctcccccacaccagttttcccctgtgagtaacatcttgcattagtgtgctagggttgggaaagttgtgagtgaatatgaatatattattaactgaagtccatagtttgcattagggttcactcgttgtgttgcatagttctgtgggttttgacaaatgtctccaccgttatggcatcattcaaaatagtttcactgccctaaaaatcctccttgttctacctgttcatccctccttccctgtctcccctcaacccctggcagcctctgagcgtttactgtctccatcgtttttccttttccagaatgtcctgtagttggaatcaggaatatgtagccttttcacatgggcttctttcacttagcaatacatatttaaggtttctgtgtctttccgtggcatgttagtttatttcttttcattatggagttgtatacctttgtatggatataccacactttgtttatccatttacctgctgaaggacattttggtgactcctaagttttggcacttatgaataaagctgtggtaaacacctgtgtgcaggcttttgtgtagacataagtgttcaactcatttcaagtgcagttaattgctggattatatggtacaagtatttgcttttgttggtttttttttttttttttttgagatggagtctcactctgtcacccaggctggagtacagtggcgtgatctcggctcactgcaacctctgcttccaggttcaagtgattttcctgtcttagcctcccaagtagctgggattacaggcatccaccaccaagcctggctaattttttgtatttttagtagagacaaagtttcaccatgttggcctggctggtttcaaactcctgacctcgtgatctgcccgcctgcgcctcccaaagtgctaggattacaggtgtgagccaccgcccccggcccgagtatgtttagttttgtaagaaactgcccaactgtcttccggagtttgcattcccagagcagggaatgagagttcctgttgctccacttcctggctaccatgtggcattgtctgttttggattttagccgccctaagaggtgaggaatggcatctcagtattttaattagcagtgccctaatgatatatggtgtggagcgtctttctatgtgctggttgtcccctgggtggtgggaatgctgggatgaacgctggaatgagcgtactctaaagacttgttctcttcagctgccgcagctgctttgtgtctgcggccccaccacagccgtttccctggcttctctgtcctgcatcctccttctttcagtgtcctggacgcaaacgccagcacacgttttctcaggcatttttcataaggctgctttcctgtttacaaaactatagcggccctcagcctcccatcagctcgataccttctcagccagaaatgaccacagtagctgtatgatggcacaaacgcacttctcctcctctctgagatagctcccttctctccagcacctccttccctagtttacatcttcttcatggcgtcttcatattatgtgaaatgaaaacacacccctttagggaaaagaggaaagcgtcttcatacactgctgggggcgcacatgctgggaagcttctgtccgccccttcccgccctctctcctgcttctgtcagctctctgctcttggggtgacctgtatagattgtagcagcgagtgttgtgctttctggcttctggttggccagtgggaagtcctggcaagagctcggagggagggaggggagagagtgaggttcagtatttcttctcccctcccacgccccaggattccttctgtcttgtttctcgggcttcccccacacctttgtgattagttcctaatttgagtgtcctgcttgtttcctgttgggtgcctggatttaggatgtaaattgttgtaacctgtcttttggtggcagtctgatgtttagagatggtcatggagtcttgggtactacccagagcgagatctaggaggaggcaagccaggtgtctgtccacccgcaggtgcagacctcaccctcacggggcctgagggagaggggcctcctcccttgtctttagtcggaaagtggttcttggacttcctgtgcctgtggtcacctggccatgctgttcaaatgcagattctattcagtaggcctgggaggtctgtgagctcctaggtgatggctgtgctgccaccggccctcagctacgctttgagcagcagggatttttttattgcggtttgatttgcattgttaaaatcctggaatgacctaatcgccacctgttggggctgactgattgaactgtggtgtgtgatgggcactacacagcttttaataagtcggtgaatcagctgatatttatcgagcaccttctgtatatcaagtgcccgggatacatcattggaaacaaatgcttgccatgtagagcttacattctagtgtgggaaacagacgatccacagggtaaacaggcacgtcttatgaaatgttagaaagcaacaagtgctgggggcaggagaaagcagggcgagagcgtgtccatgtcaggggtggcagggagccgcctgcagaggtgatggggagagcaccccaagtgcagaggcctccgcagacccagaggagccagtgtgatggctgtgtagtgagggaggagacccctggatgggcagaggcgggtgcaggccactgggaagacgcgggccttaactctgtgtgtgaggggctctttgtccctgaggatttctgcagaggagtggcaggatctgacttggacattcacggggttgccctggccaccctcactgagggagaccaggtggacgtgggggcagtgagaggctgtcatcctgatctgtgggaccagcgtgttaggagtggagatgctgggaagcggtcagatcctagaaatgttgtgaaagtgttgatgttgaaaataccatttttgagacaggcagacatgggtgtgatctgttcaactggaaaaggagtcaactatcttttaggaaccatgttttgaatgtgagcaaaaagaatggtggtggcatatggtaatgacactaacatgtaatgagcgtttctctctaattaaaggggatttatttttattgcccttatctctgttttctagaatgcgcattattttcatgggaaaaagagtcttagaaaagacattgcttctttctctaagtaattttactgcatgatctttattctatgaagtttactcatttgcattgggttttatagatattagtaggtagtttgtgctttattatgtctgcaacatgcttttttaatttttaattttttttttagcttgcctagccaactagaatgaaagatcctttgacattgagtattgcatttttatttttcctgtattccagcttgtaacagacacttcctaagtgcttattgaacgaattgttctaattcttttaagcaacgactggcctcttcccgaacagttttatttttctaaatctgcagagggttattattagcatgcttgaaagaccaaagaatgattgtctaattcttgaaggttctcatttgttcttccttatgccctctgttcctgttaccttccccaagcactcctcctgcatatgccgtcaaagtcctgaattggggctgcggttgaagttggagtgtcagaacacgcttttgcccttactgctatcagccttcagtcagataagtagcctttttatataaatagttccctcttgtctctgtagagctggggaaggcggggtcccttgggtttgtgtgtatgctggatgaagcagacagaagggttcttcagggtatggggccgtctctggactacaccaggaagcctggaaaaggccctccaacaaagcctgccatagatgatgcctcggaccccacgtttttagttacaaataatatacaaatagttactgagaattaaagttactttcttcaaggccatcagagtggttggtaactgtaatgtccctgaaagactcagtgtctttaatctcctaaaccatgttgaattccagtaatgggaggccagggaatgggcagaggactgatagtgaatctagggagcacctttttatcacatctaggagggggctgagcagactctcttagggactgagggggttgagtgtttatctccttcaactcctttccaagtcattgtctttaaatctttcttttcttttggaaacggagtcttactctgtcgcccaggctggagtgcagtggggcgatcatagctcgctgcagcctttactttctggactcaagtgatcctctcagttcagcctcctgtgtagctgggaccacaggcacgcaccaccacgcctggctaatttttctgtagaaacaaggactcactatgttgcccagcctggtctcaaactcctgggctcaagcagtcctcctgccctgggcttgcagtcctttttctttttgttgattgaggctgatctcacgctcttgggctcaagcagccctcccaccttggcctcccaaagtgctgggattacaggcgagagccaccacgcttggcccttcaatctttatcagggtttgagaaggggacttccataagatatgtcttagattggggaggttaagagtgtgccaggtctcaggcccacctaactcagaactaccactcttagttactggactgtctacagatgctagttccagtaggtagatctctgaattctgaagaaattgcccagtgaagcctgacatgcaaaacaaccactccagtcgctgccgctgtatggttgaaaacgtacgaagaacaacatctcggaggaggcatagcttcccacagaagcttcagaatttgtaggtttagataaaaagttaaaagagaatgggaaggctaagcacattctaacgttttttagctaggtttgttaagaaatgttggtggtaatctgaatcacccttgttgatgtgtatatcacattttacatagttctagtcatcacatcctggaatgtcagcctgggcgggcatgcgagggcctggtctgattcccctgtgtccctagggcctggcaccatggcagcacatagtaggcatttgagtatttgttggatgcataaataaattcttgtaataaatacaggaaaaaggtcttagggaacttgaaagccaaattttaatattgatgatcttgtaaacaaagtatttttcatgttttagtaacatgaaggtcaggattccactaagcaggaatatggtgtaacctcatgtttcctggcaactagccctttgctactagacttgccacaggaagggaaagagcttacctagcattgttcatcactgtcttgctaaggtggaggaaaacgaggagcagggagctgagaaaatagaataactgcaggagtttctcttgtccatagggcacaccgtttggggtgaattgttttgcttggggccacccagtgagttcgtttggagttgcaagcctcgcttccttatatagagtcattgatacaattggggagtttcctgagtggatgattaaagcagttctgtattcattcttctctgtaagtgccaacacctggccgtgatttctctgcggtcagctggagactgacatccattttctcacagtatttacgagggaagggaaccctggttggtgaattcattctcatggtctttttgcccgagtcagcagcaagacagtcaccttgccacgggaggcagcgtgtccctgtgttgaacaggcggagagtctcccctcaggatacagcaggagtgattggaatgattctgtttctcagcctgtcttgcagaacatctgtaatctaagcgtcatcacaaaaattcttaagccaagaataagcagaacattaaccagagaataattgattggcatctttcacctagacaacatttttgtgaaatgggagtgattcctgtggagttttgtccatgttgatgaaaacatggatgtaggccgggcgcggtggctcacgcctgtaatcctggcactttgggagtccaaggcaggaggtttcttgaagtcagcagttcaagaccagcctgagcaacatagtgagatcccatctctatcagaaatttttagaaattagctggccatggtggtgcatgcctgtaatcccagctacatgggagtctgaggcaagaggatggcttgagtccaggagcttgaaagctgcagagagctgtgattgcaccactgcattccagcctgggtgacagagtgagatcctgtctctaaagtaaaaagttttaaaagacacagttggagtttcctctttggaagattacagggcagaggccagggtggtcagtgagtcaggagctggtgactggccggtggggcaggtctggacaacaagcagctgccacactgtgtgtcacttccgtgctctgtgctttacagcgcttgggactttctttttcaattttttagcttttttaattttattttttatttttttgtagcgataggttttgcatgtctcctgggctagtttcaagcgatcctctcacctcagcctcccaaagtgctgggattacaggcatgagccaccatgcctggcctcagcttaaaaaaaaaaaaaaaaaagctttattgagctataactcacatatcataccatgccctcatttaaagcctacaattcagtggacttcagtctatttacagagctgtgcagccatcaccacagtcaatttttaaaacattttcatcaccccagaaagaaaccctgcagccactgcacattttcctcctgccccagccccagccccgggcggccaccagcccactttcgacaccgtggatttctctcgacgctgttgatttgccttttctgaacattttatgtaaatggaatcatacagtatgttgtcttctgcgacggacttcttagcatcgtttcttcaaagttcatccatgctgtagcgtggcatcgtcatccctctaagcggccgaatagcattcccttttgctacgccccgttttgtttatccgtgcctcagtcagtggcatctaggttctttccatcttttgtgtgttatgaatgatgttgctataaacatccatgtgcgggttttggtgtgaacatgttttctcttgggtgtattcctaggagtggaattgctgagtcaaatggttgctttatgtttaacattttgacgagctacccgagtgtttctgaattggccgcaacatttctgttcccaccaatataacgtctttggggtctaaccgtgcttgtgtttatctgtcctttgaattccagccatcccgttttcggtttgcctttcctcgatggtgaatgaggtatagcatcttttcatgtgcttatgggccatttgcgtatcttctttggagatatggctatacagatcctttgcccatttttttaatttggattatttgtcttttatgcagactagggaatttcttaaggggactgcttttggttattgtgtttctcacttataaactcacctttcagtaatgagtcacatacacctccacagctgttttggttttctgttgccactgtaacaaattaccacaggcttcgggacttaaaacatttatttgttagctcctagttgcttgggtcagaggtctgggcacagtgtggctcagttggttgccctgagtgtcatgagactaacaggaaggttccagccggactgtgttcctttttggaggctctgggaatgcatcggcatccaagttcattcaggttgtggcaagggttcaggtccttgcagctgtaggactgaggtccggtttcttttctgacctccctcggctcctggaggcctccctccagtcttgcttgcagcccctgcaactcagaaccagcagcgagcggctcacaaggaacctgccagacttttccaccttccacatctgcttgtaaggactggtgactccatcaggctcgcagggtaatccagaataatcgccctattttaagctcagctgattggtagccttaattacctctgcaaagacctttcacctaggttcccaattgatgaatacccccggccatctttagaattctgcccgtgccacgggcttgtggcctgccttacagccttctagttacaggggaccatgaaagggttgtgaggctggtcagagagagtaagtgaaaacggcaagcgaaacctgtgggagaggccactttgagtcgcctccctcccttgttcgtttgtcctttgcttttttttttttttttcaagttagggtctctgtcacccacgctggagtgtagtggcgcgatctcggctcactgcaacctccacctcctgggctcaggcaattctcatgcctcagccacttgaggagctgggactacagggctacgccaccatgcccaaatattgtttgtatttttattagagtcggggtttcaccatgttgcccaggctggtctcgaactcctgacctcaggcaatctgtgtgccttggcctcccaaagtgctgggattacaggcatgagccaccgcaccaggcttcctgttctttattataagttgtattttctttattacaagctgtagtttgtctagcctctaatcagtggttctccgttggagagactatgctccccagggggacatttggcagcgtctgcaggcgtgtttggttgtgacactgatgggtgccgccggcatctgatggttggagatgctgctgactgtcctgcagtgtgtgaggcgctccaaaacagaattccccagcccccagatgtcagtactgatgtggtaaacaaactttgttctatgtcagatggccagttttttaatggcagaattacactattatgtaaataattgatgttcttaatgatgactccccccagaacctacaaaaccctgacatgcctgttagctgtgtagggagtcattccgtgttcattgaattaattttaatacgttatagtgaactacagtcccacttgaaacattaagagcaatcttacagtgtgctagtactttttcttctttttttgtttagtttcctaactatgaaagcaggtgttctaatacatttggaactaataattcatgtgtagtgtacttatggagacttaaaaataaaactaaagggagggaaggaggaatggaaggaggagatgataattaacaaagaattccttattcacaattaatagatgacaacatttgtcataactttagatgtttcttctatgttccgttctcctccccagtcctaatactggaaccaaactgcttagaccagaatcctgagtgaccttggatcagctgcattcattcatttgttccacaaacatctgagtgccaggggctgttttcagcattgggaataacagcagtggccaaaagtcagagtccatgttgtctgcgtaatgggcaggttagggacaaataatgagtaagtgaagaaatatataatgtctccacagagagagctgaggggctggtgtgggcagagcagagtgagtgagggcgagagagcaggtggacatggggtggctggggtaagggaggatatacagtcttgcaggctgtgtaaggattctcatttaaagtggagtatgggccgggtgtggtggctcatgcctgtaatcccagcactttgggaggccgaggcaggggtgggaggaatcacctgaagtcaggagttcgagaccagcctggccaatgtggtgaaaccccgtttctactaaaaatacaaaaaatgagctgggcatggtggcgcgtgcctgtaatttcagctatcaggaggctgagacaggagaatcgcttgaaccctggaggtggaggttgcggtgagccgaggtcgcgccattgcgctacagcctgggcaatagagcgagactctgtctcaaaaataaataaataaaaataaagtggagtatgatgggaagccattggaaagtttaagtagagagttgaactgacccaactgtgtttttaaaagggtcattgtttgttaagtggggagtgtagacctcctccaggggtaggaggtggaagtgggcaagaatgagagcaggggcatcagtgaagagcagcagagacccagactgacttgatgggagcagaggaggcggtaagaagtcaccggagtgcattgcacattcctgatcatttctctagcctgagttttctcatctgtgaaatggggacagtaatcatggatgtctcctggccgctcttaagaattgaatgagttaatgtgtgctagacctgtgcctggacagagtaggtgttcagtgaatgttagcttcaatatcattctcactgtcactgctgctactgcccttcccaccgaggaaaccctggcatgagctggataattattcaatttgtgttctgtacatgttttgagtccataatcaatatgtatattacttgtttttaagaatttatggaaatggcattattttgaatatatcatttaaaaaatggatttgctaggctgggagcagtggctcacgcctgtaatcccagcactttgggaggccaagacaggtggatcacctgaggtcaggagtttgagaccagcctggtcaacatggtgaaacccatctctactaaaaaatacaaaaattagctgggcatagtggcaggcacctgtaatcccagctacttgggaggctgaggcagaagaatcgcttgaactagggaggtggtggtcgcagtgagccaagaccgtgccattgcactccagcctgggcggcgagatcaagactatctcaaaaaaaaaggatttggtgagcagcacatgtgcgtgctgtccatgggggtgcgtgaagatctggtttacttctttccaccgtcacattacttaccataattgctgatccgttccctgtgaatgcgtattcaggttgtttaccgttttccctgcgaccaacagtgctgcactgtgtgtccgtgtccacgcctccgtgcgcggcggccagggtctctccgggatgtgtacttagacgcagagttgctgggtcagttccacgcaggcccagctttgccaggggctgtcaaccattgcttctcatggaaagtctcagcaaggctattaaatgaactcaaaaactatctcccttattttcagatgaatgaaaaattcagtgtttgtgtagatggagaggagcagaggagtgatgggaaatgtctctgggattggacgtcatcaggtgtgctaagacacagacgggactgttgtgaggaaggagcttgtgctcacagatttgtagaaacaggaggcacagcacacggggccacacggggagcaccaggctccagggagcaccacgctgggtcaggaggcggaggggtacttgtgggcaagagcctcgattgtggtttctgaaaagaaatgggcaaggcagcatccgcggtttaggattggctggtttgagtaatttccccagcctctgtgctatcagggtggtccctggttgtccagtgcttggccctggggtggttggcagaggcatatggctgcctgcagtgtggagcctgggccgccaatatagccctgcactccaacctgcgctgagtcatctctcctacacgctccagcctccctcatgttttctttagtgtttcaaaaatgcgaagctcagggtcttcgtgcgtgagattccttccaccaggaaagctcctcctgcccctgctgcgcagccggcccctccttaaggtcttgtaaatgcctcctcctgagccgccttccccaacagccctcatttaagcagcctccttgactgtaggtccgctgactggcttcctccttgagagcacactcacagtgccggaccgcaggcacctcgccgatgttcctgtccacttgctttttgtattgctccttctccagtgagcttggaagcctcatgcgggcaaggccttgtctgtctggttctctgttgtgtcctcggagcctgccacagtggcggcgcttggtggctttgacaggggactggattgggtggaaggggcgagattagacctggatacagtgacgtccttgtcagccatgccgagtgcagagcgcctactgtattgtaggcatttgaaatgaaacggagaatgtttcccaggccgtgcctagcaaggatgcctggcagtcgtgtgagtgagtgctgtggaggggagcagtgcacacccggtgctgtcgggagcacaggaagggtgcttgggagcagtgcggggcaggtcagggaaccctttctaggatgtgtgttggacaggctgataaacttctgtggaaggccgttatatgcaaggagttcacatctggacggtgactggtccagccttttagagctccttccagctctgagattctatgccacgaaaaaaaaaaaaaaaaggcaggaaaaggaaataaggaattttttggtgggagttgcggctttaaataggatggtccagtaaggccgcactgagaaggccttcccagtaaagacttcatgggtgcagaagaaatttcctcaaagtcttggtttgtgtctttgattttatttgtgagcttggagaagcttgagcagggctttattctgatgtctctaattgtctttaattcagattataggaattcttaaatgttgacttgcagggttcgggaagcacaccagatggaaaccgaaagtgctgccgttttgagcacctactcattgcacaccctgggtccagggtgagtctcactccgttcaactcctcggccacagatctccctgatctcagtcaggattctccaaagaagcacagccaacaggatacatagatgtataaaaggagatttatgatggagaatttcactcacgtgattctgggagctgagaagtcccatgttctgtgtggcaagctagagacccagggaagcccgaggcgtgattcaaactcagctcatgtccgaaggcctgagaacctgggcagccgatggtggacatccagtcccagggcaagagaggatgagatgtccaagctccggcggcgaggcaggaaatgaggggtgaactcctcctccctctgccgtctgatctattcagggtcttgagggattggaaggtgcccagccacttggggagggcagtccaccttcctgaacccactgtcctaatcctaatgtcatctcgagcaccctcacagacacgcccaggaacggtgttgcatcaggcaccctgtggcccagttcagtgaaattaacatcacaatctccgtggtccacaccttctggacaaggggtctttgcagatgggcagacttaggcgtggccccagattcccagatctcctaacgaatacgctgtttcctgctcctccagctgcactctgacagctcacatggggcgattgcctccatttccattttcatttccttcacagattggtttgctcaccatccagcatgtttgtttgtttttttttccccacctgagagctctcccggaatgtccccagcctctccctctggaggtatagcagatattgtggtggcttcctgcaaggagcgctgtgctggcatcactcagtgatgtccccttacgcaagctacactgactgggaacttctgttccctctggggaaggggaggtaggaggagactctcccctggatgccccttaataaccagtgaaattggtactatgggcatggagtcatctattttttaaaataatttaaatgaaaacatgactgtggagaaagccggtttcctcaaagctcataaatatttatagtttgaaactttgtttcatcttagagcttgaaaatataaactgtaacctcttgttatagaaggggaaacaattaccttttaaaggttgctggataccaggcaggaggatcacttgaggccaggagttcaagaccagcctgggcagcatagcaagactgtgtgtctacaaataaaattagctgggtatggtggtgaatgccggtaattcccagctactcaggagactgagcctgggagtttgaggctgcaatgagccatgattgcaccacagcacagcagcctgggcgacagagcgagactctgtctctaaacataaaattttttttaaagtttgaaaagtaaaggtcactggattcttttgattttatatatgtgtttatcctttatccttaaacctaacaaaaaaggggccaaataactgctttgtttaccaactttctcattagaggtggggtttcctaggcatctagacagatgctgagttttataaatgtaacgtctgtgccttcatgtggccctggtgaagcaccatcgtagaaggtggctgtgactgacaggagcacaaagcccctgatgtgatgtgatgtgatgtgatgtgatgtgatgtgatgtgatgtgatgtgatgtgatgttatttttgagatggagtttcactcttgttgcccaggctggaatgcagtggcacaatcttgtctcactgcaacctctgcctcctgggtttaagtgattctcccacctcagcctcctgagtagctaggactacaggcatgcgccaccacacccagctaattttgtatttttagtagagacggggtttaatcatgttggtcaggctggtctcaaactcctgacctcaagtggtccgcccgcctcagcctccaaaggtgctgggattacaggcgtgagccaccgcacccagcctacaaagcctctgattttagcaaagcaccaaggcctaaggactctgcccgtgtcttagcagctttagaaggaaaagcaagccaagaaaaacattgagttatttaccataattctgaagaaaagcaaatgtgagtccttaagggaggaattctgactttcttgaaacagattagtttttttcatggaattagtaacacagggacttacttgcccggttttaaggtttttggtgaggagttgcctgaaacgcaagttctcttgagagttttttcaggtttttggagaggagtcgcgtgaaacgcgggttctcttgagtacttacagccccttcccactgcccctgggaaagctgtggtgctgcctctctagggaaacaaataagcgctgctctgtgcgtgaaaaaaacagatttcctttcgttttataagatggacggggacatgggacttttcacttggctcttaagggaggggctttttgagaagtagacactggtgtcctgcgtggcctgccggactgtcttttcagctgtcagcagaacccctctgaagggagcaccagtttcagcagcgtccgtgccgcagggaagacatggcaacatcagagaccagcacagctgtgggtgaaactggacagcagcccttgggcagcattggcggctagggtttaaccagagcctgtcaggggaagcgcttctggttttgcaatcgttctttacaaccttacgaaatctgtgccgtgtgctttcaggtaaatggatttcactttgaggtcccttctcaaatgattttttaagaagtctatatagttggcaaaaatttgataaaagttacttcattggtcatgacataaagttatctgagtaagaagaagcagcacacttattctcctgtacctctggaacatgtgagcaccctggttgttctgggctttctctgccaaggctgggaaactagagttctggcagctttgttgctcctttgtcttctgtgtgagccgcggtgtcatcagccaggtcaccccgcttgcagcacagtcgctgtgctctgggcatcggtggagcggggagctctggttgtgcacagagggccaggtgtagatgttgtgcacagaagtcagccccacccaggttaggctgagccgtcttccctgaacctgaaatggttcgcctggagcccacgtgtgcacagcctgggggctctgggccagggttccttgtagtctgtatttcctttccaattctgatctcctttttgctgctgggagatgaaatcccctcacttgacgactcaggaagcatctgtttcttctgattcttgggacttgccatctccaaaggctgagctgcgggcctgggtgtccctgttgaatgagagcgctccagggcctccttccacatgttatctcattatctttttgtttttttctttctttctttctttcttttttaagacagagtttcactcttgtcacccaggctggaatgcaatggcgtaatcatggctcacggcaacctttgcctcctgggttcaagtgattctcttgcctcaacctcccacgtagctgggatcacaggcacctgccaccatgctcatacccacctaattttgtgtttttagcagagatagatagggctttaacatgttggccaggctggtctcgacctcaggtgatctgcccgcctcagcctcccaaagtgctgggattacagaagtgagccactgtgcccggacttttctcattatcttgccagtgaccgtgaggtccatcatttggaatccaactgtaaaaaaaaaattattgacaaaacccaaggagtaagttccttctaaaggctgtagcatggtttttgttagcagtattactaatactgttattattttactcatttgcagtgctatggtctgaatgtgtccatctcaaaattcctatgttgaaatcctaacccttaaggtgctggtgttagggggtggggcctttggggagtgatgagatcacaaggacagagccctcatgaatgtgattagtgtccttataaaagggaccttaatgagcttgtataccccttccaccatctgaggacacagtgagaaatcaccgtctaggagccagaaagtgggccctcaccagacaccagtctccatcttagagtcccagcctccagaactgtgagaaagaaatctctgctgttcaagccacccgcctgtgaggttttgttatagcagcccagactaacacatgcagcgaacctgaaatattcagctgcgtacttcttaagcgatcctctcccctcctggggttgacccctttctaatgtcaaaccatttccctctaagaaggtgattgtaatgatactagaagactgttccgaattcagaatgcctttaaaggagtatctgtattgtattaatcatagaaatttttactatgaatttattactaaatactatttacatagaatttattacaaagtaatatttattactaacaatacttacataattttactatgaatttattactaagtaatatttacatttacataaatatttacatatttacagatgtgtgaaaattgcttcttctattaaacgctatcagtcacttgcagttttaatttatccaccacagtaaagtaagctgttgtctttttggctgatcttttcctgtcaataggctttttcatttttattgtactgttccttggggagcagggctaccccaaaggcggtgtacccagagtagccggctttttaattttgtctttgacatacgaaaaggaggtagttttaggaggaattttcagatccattgtacaactaatttttttttcaaataaagtatggggcaatatttatgtattaatgtcaataatgagtcatcatagggtggaatttccaatgaaaaatacattgaaacgctaatgatgtttggtttgtgtattttttatcaactttggtacaagacagatctaatgactatctaatataaaacacctgttacttgagtgctcctcactgcaggtatgaggtaggactgctgcccttactttgcggatgaggacctggggtcccttagttcatcctgccaacaggtagagcctctgctctgtgccggccctggggacacgggtgtgaacagagcagagccctgtccttgtggggcttgtgctcggtggggagagaatcatacaggagatgctgagtggactctgaaggcgggtagccagccggaagtggtcaaggaagtaaagcgaggatggagcgtgggaaggatgggcctggggtgcagttttggataagatggccaagggcaggccaccctgagaagcttccctgccccagtcctcactgagcattgaggaagtgagccgtgcggctatccggggcaaagggtttcagttgtcaggaaccagaagtgcaaaggcctgaggcagaagtgaggatgtgcctctttgaggacctgagtttttgccatgaatgagatgggagccttgtagggttttgaacaaagcgggtgataagagctgacctaggcttagcaggctaacttgaccactggttttgacagtagactgaaggggacaagtgtggacacaaagcagccaattagaagacttgccataatccaggtgagagatggtggtggccggacccaagtgagagccatgggagcagcaggaagtagggaaattgtagctgtctctggaaggtagaaccacggcattggctgacaggctgggccagacctcaggatggtgcatctcccctagctgcaggccgctgctgctctgtggggagtgaggtcctcctgtgcggcccaggtccctctccatcccatccaaattcaggcccacaggatggtccagggtaacccacagcacctgggcactctcctactacagccagtggccagcctgcagggacagacagcctccaaggccacagtcagctcggcccacacccttgctgatctgcagaaggtgcagaagcagcttttcaggcagcatggtagcagggcctgggtaggccagctctggcttaacccaagtgcaggccgtaagcactgaaggcgctgctctaggtgggtgtcgggtagcactactcatgatggtcactgcttacaggagggagttgggtatgcgtgagaaggaaacatgttcacagattcccgaaagagatattgaaacttgcagaggccaactctgtaattgcaaatgaagcataaattaagattttccgtttagttgtctaaacagttacccatgcagtccatagaagagaagatggatgcctgcagagcaggacttcattaagcagcagcctgagtcctaagtggaggaagcgcccaaaatgatcacggagcttgtggtactttcacctaataattcatcgtagctcctccacggggcacagagcggtttctgcgcgaacaggtttttcatgagctcagcggctgctcttcggtcgtgtgtgtgcctaaggttggccccttaatttgaaacgctgcagcgtcttgtttagtgaggctgcctgatgctgatatttaattattgccatgtccaagtgcgtttttggtgctgttgaagttaccattgagtttattttctgcagtagtaatttactacttaaatttacttcttccagcttttttccatttggtcttatcgcaagtttgaactttcctccagatagtcttagaggcaacggatgagaacagtgagcaagctgctgtgttatcctggctaggtttttttttttttctctcttataccttattttaatgctcattaattcaaagagatttctgtttatggagacagtaattaatagtaaatctcccatcaaattcaaggctctcttgattttgaaacttctaagaactcaggctaaatgttttaaattgttctttataccttcatgaaacgttttattggaagtgttgactgagcctagttttcttactggaaacaagagactagaaattcaaacatgtttgtgaaatttaagcatttttattactaattggtactttattacttattattgtattataatgggacttagaggaaaataaagtataaaaatcagtataaaagcttatttgaagtagagaagccaaatgtctattccattttttctaattttcagttgtcagtatacatacactaaattttcctcattttcagttgctagttatcctgatttctctttgagctgtggtttgaggtcatgactgcttagatattattggaggacaattttcgtgaagcaaatagatcaactaaaaaacaatttgggggaaaataaaggaaaattaaaagttattaaacataaatgtgtaaattggcagaacctttctggaaaacagtttagtaatatttatcaaaacctcaaaaatgtgtgtatacttttttgacccagcagttttataattcaacatctaggaatttgtcacaagaaaatagccatatatgtgaaaatagggatgtatcaaggagttccttgcatcgttgtttattctttccatacactggaaagaattccgatgtccagccatagggattacctcaatcttagcatgtcccacatgtcggactactctgcagccattacagatcttgaaatcttgaatgacataggaaagtgtttacgatacatcgctagaaaaattttaaagtgttacaaaatgttctgtaaagaataagacagataacattcctagatgttaataagttatttctagatagtgatatttttaaggatttaattttcttctttatgtatttctatatttcctctattttttgcactaaaaatacacttttataatcagaaaaagacaagttctttcttcttttttctttttctttttttttttttttttttttgagacagagtctcgctctatcccccaggctggagtgctgcagtggtgcaatctcagctcactgcaacctctgcctcccgagtagctgggattacaggcacctgccaccatgtgcccacacccaactaatttttgtgtttttagtagagatagggtttcaccatgttggccaggctggtctcgaactcctgacctcaggtgatctgcctgccttggcttcccaaagtgctgggattacaggcgtgagccaccgcccccgaccaagacaaattcttttagatatgttatcctacagcaatgctgtccaatagcaaatcgaatgtgagccacaaatgtaaggcacgtgtgtacttcagattttctagtagccacattaaggagaaagaacgaaagaaaaatgattttaataatagattttattgaatccaacatatccaaaatattacaattgcaacatgtaatcagtataaacaaaagaagtttacgtgttctttttgtactctttgtgatccagtatgtatttataatacctctcagttcagctgggccgcacgtccactgctcggtggccctcgtggctgggacagagccaccattagatggtctcttgctgggctgccaagatagcgtagatgagtgagtgttttcagtgtctggagatattagactcaagtagtgtctgaatgcacaaaatgtcttctaatgtagccaggcttaacagtatatcccatacttccagattttaattactatttttaaaaaatgttctagagaatttcagaagtgttgggtcctcagaggtcagctcagctctggctctagtctccgtgcctgctgtaagctgcgtgagagcaggcggcagcccaggcatcttctgcctcctgcctgttcctctgctcccttatctctccagatactcacagcagtgtagaacagagctgaaaaatctctagcttgagcccgcgcggtcaaggctgcagtgagctttgattgcgccactgcactccagcctgggggacacagtgtgaccctgtctctacaaaaaaaaagaaaatctctagcttaaactaaatcggtcaggcttgataactgtgtgattttgagcttccgctttctcatttgtaaaatgggcataatgctattcctcgcagagttatttataaagactaaatgagctaatggacagtgagtacttaacacagtgtcgttcacatggcaggcgcttagtcccatgaacgcagattgttatggcctctctgaagcagccttttggttgatagactggcatgaattttatgcatgtctgcatctgcttatttatttggcaccttggtcggtgtttaaaggctttgtggaaaggctctgggcctttatttaccacagtgtgctgaggccccagcttgaccaggttggatcaggaggagggttctaaagaacactgcctgggggtgccaccaccaccatgcgctgcacacatcatgtttgataatcaaaagcagcctttctaaaatgaacattagctgcgtatcctcttcaatatctttttttttttaatttattttaatagagatagggtctcggtaagttgtccaggctggtctccaactcctgggctcaacagatcctcccgcctcggcttcccaaagcgctaggattacaggcttaagccatcacgcccagctctcttcaacgtctttagtggtagaaaatgttgagtggtagctctgtgattcccagacctcaccatgcaatccaagatggccccaacgaatgggccaagaatatgtttaatgaaaaccaacctagtgacactgcccccagaggacaaagatttcaccattttctcacacctcctcacacagtttctttgcactcttatcagtttttcacaaaacccaacttgttactgtttggacttttgacactcagcccagtcctattggctttgaagtggtgggaccaaggaaagccagccttgtagcaggctcatctacaagagtctggcccagtggcactcagaccatagtccagaggaacccggtgtatgtacacgcgtgtgtgtttatgggtttatgggtttacgcatacacacacacccgtctatatatagctgtctctgctaaaacaaattctttgaaacacttacctttattatttgcagtctattcagttagttaccagtatattcttttcctttttaaaatgcctactaaatgatttcacaatgcagatcctgacttgaatttcgaaaacactgaattagcacatgaagctgttacctgttgatagtgtgtgcaagcttttcccccttagaatgatattttgtgtgtttgtgttctcaagttttgctgatcttttctgtacttaagaggacgatttcgttcccccttgtactagtgtttgtcatgtagtgaaatttttagtgaagggagattccgagacttatcctgacccctggaagaacaggagaggaagaagttggtctgcccatggccatggctggcgggtgggggttggggagatgattccaggagtttccagcctgctggcttgtgagttttgaaatggagccctggattttcactttccagttcaggagatctggggaaatctggattggtttggagttgtttttttgtttgtttgttttgttttgttttgttttggacttttaggaaaaccttttcaaggcagctgaaaaaagctaatgatgataatttgcttctcctatgccattcctaaacccagagttttctctgcagttccatctcctcttgagaagcttagcttggatttcccactgtccaactgaactaaatttgttgaaaacctacctaaatgtcaccccttctaagccatcccctcctgtggacctgacttgggagaactggtgggtattgtgcttacacaacagggccctcactgctctccgtgctctgcaggtttggtgaattcctggttttggatctctccatcttttattgagagcacttggggtgagagcacttagggggctcctgatcactctcctgctttagctgctccttccctgcctcctgtcccacctgccacgggacctgcaggcagcctcagaccttgccattctccttttccaaagccctcgatcgtcccctttctcacacagacttcttagctctccacagcctgtctgtgagcgaggcctcaccagcggtggcgattctggctgtcctccgacggtcctgtccttccagttatggggctggcctctgtactctgcatctgagactgtcgcttatctgctcgtgctctgtcttgctgctacgcttgttttgaaagttctcccatagcaggagccaagtttaccgccttttgggttttccccattcgttacccaccacttttcattgcctgaggtgagccctcggtatagtcactggcagagccaagagggggctttcttagagaaataataggcctgatcccgtacggcagtgcatttgttgcggaaggcaaatccgcggagttatggtggggccagggctgcgctgtgaaatggcagaggctctgatggctggtttgacggcttactgcctcccttcgtcagtttctcgctgacctttacactaaaaggtatcttgcacttcagttttcgagaggaactaagaggcgctgtctttgtttgctggattcatcaatgtaaagaaatgcatcctgtttacacttctggcagcgtttcttttatttggatggtggccaaaggcaaacaactcagccgagtgggtttttaaaaaacagagctttccaagtccacatgctgttgcccgagtgaacatccagaatcttcagtttgtcttaatggaactgtttcatcttgtagaaaaaggctcatattatcttaaagcattttatgtctatcgtagctttggtatttattgtgggaagattttactaaggaatgactaatcttaaaagatttggtttgattaggggctaaactaacataatctattttgaaatgagataacaggatttgcagtttttggtcttcatccagcaaaattgaaccccaccccccacccccccaaaaaaaatctacatccccagcagagagggaatctatactttgactagaagtttaagttgctggatttataagttgtcttaaaaatatgctgtctgaacagtttgaagtgtgacattgtattgagatgaagtcatcaaactgcttgagactttaaccgtttatatttgggtaaccaaataaaatgtatggttattcaaacaattaatacttcagtaataccattactgaaaaaaggatttttctcttagctattaaagagacttgaatgagttgtcgttcttatttattttaagtgtatgtgagttttaggattttcttggcttttgtgttttagaaaattggtctttcattggaaaaggacaggagtaagaggtttattataatatgcctcctatactagtattttacttttaagactttagcaattctatataacaatggtaaaagtgtaactatcagttctgcaaaagtacggtaaatacattattgttacaggctttaaactccagagagagcttacgtctctctctaaaaaggaagaaaaggggactcagaatttagccaaatgtccccaagtagaaaacttcgctggaactcagatgtggattttcagaacaaagttggcagagagcagtttttgactagaataaatgtaaaagggcaaaagagagacatcttttttttttaatgccttttttccttcaaaggaagggaaaatggactgtaactacaaagcttacaaaactactacttaactgttcaaagctcatcagtagtttagccacctttcttgtgttttgaaaaagggaaaggaggagtcttttcttgtggttgggtgcagttcatttggaccagctccagcctgcttgggcggattgtgcggtgggaatagactgctgttgcatgggccagttttgcgtgtgtgtgtttttaagccaaacctatgttcaccctgatagttggggaaggcctggtgtgtgcagtcctgcagtcttcgtaagtgacctttggccttccaagtcctacctggccccctgacttcgtctttgacataaaaatgaaacttcctaggggttattgatttaacttctgagtgagattgtactccttgtgaagctaaacttttcatttgtaaaaatagcacctgaatagatacctggtgggtcggacccaatttctgtatttgagttggacgagcagggccttcccggatagcgggagggttggtgacttgattgggagggcatggaggctgaaaccccatccaagccactgttgccaggctgggccgcatctgcctggatgatggagagcgtttttctgatttgtacaaaggcaccgagaccctttgcccgagacctcgccagagaaatctgtgtgctaccttctccgtgccgagatagtttttgttgtgcatagtggggaaaagaggaattgcctttgtttccttgggttcttgaacctttttggttttgtccttttggaaaggcaagagtttggtgtggtgtagtcaaaggaagtggggagatgaggacccggaggaggaatcacagtgggggagccgggaggaaggaaagtggagagtttattcaagtcacattttccctctaggtagattccagtccaccactgccactcgctcagatgaacccacccttcggaaagctccgtctgaggcccacctccagttagggttttagcaagcctcccttccctactatctctttgccttcggcctctgctaaccctccctctccacatcacatcgttggaacttacattgccgtggtcgctagttaactttttaaaaactttttattttgaaataagtataggttcacaggaggttgcaaagatagtacagagaggcaggcagtttttcccagtggttatgacagacataatttcagtatgctgttgaagtcaggagacgggctttgggacactgtgtgtggttgtgcgccctttcctcacctgtgtaggtttctgtaaccaccaccacagtccagaccacaaagatctcctcgtgttgcccctttctagtcacttctccccctgtctttcccattactaacccctggcaaccatgaatctcttgtccatctctgtaatcttgtcacctcaagaatgttattaaacagaatcgcatagtgcgtgatcttttgagactgacttttcgtttaacataacatcctagagcttcatccaagttgttgcatttccgtagtgaactcccatttgttgctgggtaatggtccatggtatggtgcaccacagcttgcttccagtttggggctatgatgaacagagctgctgtgaacattacagggttttgtgtggacttagctttcaaatttctgagataaatacccaagtacagctgctaggctgtatgggagttgcatttttagtagttataaatccacccaactgttttctagtttgtgccatttgacattcccactagcagtgtatgagaggtccggggtctccgcctcctcacctccgcttggtgttgccgctggttgtcttggtttggtggttggttttttagctgctttaacaggtgtacagcagtatcttactgaggtctcgatctgctttttcctgatggctggtgatcttgaacatctttttcacttgtgtatttgctgcctatatatgttctccagtgaaatatctcatcatgtcttgcccattttctttaaaaaattttttttttctcttcatttcattctgtgacctgctgaattttgcccattttctaactggatttgtttgctttttaaactgttgagtatgtatgtatgtatctcaggatcttgctctgtcacccaggctggagtgcagtggcactgtcatagctcactgtaacctcaaactcttgggctcaagctatcttcatgcctcagcctcctgagtagctggaactatcagcgtgtgccaccatgcctgcctaatttgtttgatatttttgtagagacgaggtctcactatgttgcccaggctggtctcgaacttctggccccaagtgatcctctcccctcagcctcacaaagtgttgggattacaggcgtgagctactgtgcctggcctaactgttgagttttgaatgtccttgtatattctaaatgagtcctttgtcagatatggcagatgtgtggttggcaaatattttctcccagttcatagcttcttttcagcctcttaagagggtctttggcggagcaaaatattttcgttttcatcaagttcaatttattgataatttttctcgtgtgaatcatgtatttggagtcacatctaagaactttgagcacaccctacatcctgaagatattctcctatgttatatatagttctacattttgatttgattttgtataagctgtgaggtttaggtcaaggttcttccccaccccctcccccgctccccccaattttctttacctgtggaagtccacttcctccaacagcgtttgttgaaaagaccaggcttcctctttttaattgcttttgcacttttacaaaaattacctagctgtatcaggggctatccctgggttctctgttatgttccattgatctgtgggtctgtcacctcaccaataccacacagtcttgattatcatagctatataataagtcttaaaatcagatagactgattgttcccacttttctttttcaaagttgctttagctaatttaatgctttttcatataaattttcaaataatcatatttatatctacaaaagatcctgctgggattttatggaaattgtgctaaacctgtttattaatttaaggatattggtaccgtgttgaatcttctaattcgtgaccgtggtatatctattagattttgaaaatttctttcctcaacattttgcagttttcagcacataagtcctacacatattttgttagatttatacctgtttcgtttttttagtgatagttagtagtagtacatctttcatttcactttccacatgttcattgctagtatatagaaagacaattgaatttcgtgtgttgacattatatcctgcaactattctggattcatttgtttattctaggagtttttttggtagattactttgggattttcaacatagatcatctttttatctgcaaatgggtttagttgtgtgttttctttttttgtgtgtctaatctatttgttttcccccctgcttttcctgagctgtgtgatcttttatttcattttcctaccttgtcgcactggctagaacttccagaaccatgttgaatagcagtagcagaagtaggcatctttgtcttttcctagtgttggagggaaagcattcagtctttcacattaattatgaggttagctgtatgtttttttgtcagtgttctttatcaagttgaagcatttctctgttcctagtttgcaaaggttttttaaaatcatgagtgggtggtaagtattttttttatccatacatttgtctttctagccagactctgagtttctgggggtcagatactgcttcttaaagtttgtttcccccacaaacaaacacactgaacaaatgtttgtggattggtagaactaggcatggtctccaacggcagacagacaaggtcctgaggggaaaatcagggagcatctctaaccagaccgtcctggtcagctgggtctggaggagactttcaactactctttggtcatcattacgtctgactcagtggttcaaggcagaagtggaagttataggcaccaaattgatgctgcaggagagagatgaaggaggcagaatggattcatctgctctgccctgggtgtcagaaatgaagatttttaggataagtgccaactaaaaatcattaagttgtacacttcaaattgatgagttatatggtacatggattatagcacagtaaaactgttatttaaaaaggaaaaaaaaaaaaaggccggatgcagtggctcacacctgtaattcctagtgctttggaaggctaaggccagaggatcagttgagctcaggagtttgagactagcctgggcaatatagtgagaccctgactctacgaaaatcttaaaattagccgggcgtaacgaggcatgcctgtggtcccagctccttgagaggctacgggcaaggatcacttgagcccagaaggtcgagattgcagtgagccatgttcatgccactgcactccagcctgggtgacagagcaagacccagtctccaaaaaaggaacatagataagtgcctagtgagcaggtgaccctggttttctctgtcctggaggatgggatgctgctctcagctggcctgagtccctcagattgctctgagatgagaaggcttttccagatggacagatgtgtacttgatagccttctcagggcccttgaccactctgtatacccccagtgtagaccataccagagagtatgcagtgtgcccctcagaagaacacagaagttctcataaacactgccttgctgatttcgaaacattagtctaaggatggtggaacagacctcctaactgctcagggggtgctgtttttgctgagagaatattttccaaaggctggctgcattccctaatactatgttagttatttcttcatccctttgaccctgttgatgaggtaagaaggggcagaacaacattaactttatctttaacaatgaggaaacaagcaaaagaatgaaaagtagtttctcatcacaaacgatggtgacgttaaatctagaacatgatcccctggctcccgttttggtgggcgggctacttggcttgtcgtattttagtcttttcctgtctcatgactgctgactgcctggatttgtatgttttcccacccgttttaagctggaagaagcagttgtatcttttggaatagaggagctgccagatttcagtgatgatgacaatagtagcgctggtagtactcttggcagtacagtcatctcccgttatccacagccagccgccaacggaaaataggcgcggacggtgataccacatttgagagacagaaggagagaccatatttacttaactttcatgacagtatattgttataattgttgtattttattattagctattattaatctcttactgtgcctaattcataaattaaattaaactttaaaaacaatacaggtagggcttggtaccgttcagacatccactgagggtcttggaacttatgccacggataaggggtggaggctactatagttgttgttaaaacattgtttttttggcggggaggctgaggcgggcggatcagctgaggtcaggagttcgagaccaggctggacaacatggtggaacccccctctctactaaaaatacaaaaattagcagtccgtggtggtctgtaatctcagctaaaaataaaaaattagccgggcctggtggcaggtacctgtaatcctagctacttaggaggctgaggcaggagaattgcttgaacctgggaggcggaggttgcagtgagccgagatcactccattgcactccaggccagggcaaaaagagtgaaactccatctaagaaaaaaaaaaaaaaaaaagttgtttttttactgatacacttcattttccagtgaaattttctgaaattgttgccacctcctccccgcccagttgtcttttttccagtagctttgcaaatgaatgatagcagaaagcagacttctttctgtggtgcttatgtacatctgttttcttttttttcttttttcttttctttttttttttttgaaacagggtcttgctctgttgcccagcctagaatatagtgcagcaatcatagataaccgtagccttgacctcctgggctcaagcaatcctccccgctcagctgagactacaggtgtgccaccaccaagcccagctgtttttaatttgatttaattttttgtagaagcagggtcttgctctgttgcccaggccggtctcagactcctgtgttccagcagtcctccctctttggcctcccaaaggggaggctcacagtgtgagccactgctctcggccatgtgcgtctgtcttggtgaggttatactgctgagagttaagactttccacatcacaacaaacaaaccaagagacagactcaggctgcacagctcagagcttgtgagttttctgcgttatgacaatggatgcccattttgagcttctctagcgtggtttagtctttggaatgcaattaaatcctctcttctttcttttattttctagggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctggtgagtgagtaggccttcttgctgggcacctgatagtgtgttttttacatgactattttggaccgttagttgaatttccttaaaaactgtgtaacagtccaagcaagctctaaatcaccgtaagttgtaatgatcaacaaccaaaacacgggatggaggcagatgctatataaaaggctcaagaggggaaggagcaagagccactcaggtaagatcaatagctttcttctgggaatacggagggttcttagaatcatcagcattggcacaacccgagaaatttagttttttttagagatcttgttcatagtaggaaataacaccccccacaacagcttcccactttggacctgtgggtatgggcaactcacgaacgccttcagatcagcgcctcggaagcaaatccaactcctcccagttgttcccttcagatttgttcctttcgttttaaggtctaaaaacttcacaaagcccagttatttagattcatttggggtctgaatctataaccagaaaatctggggggttttgcctgtttgctttttgtttttttctacctttcaaaattaaccgtatataaagtaaaatgtacaatttttctgataaccagcataaatgtgcacagctgatattaatacacacccagggtatccagaaatgcctctcactctcacagccgtttgcccccttagcacccagagtcaagttgaagtcatgaatcctttgccgttcttatgattttgccataatacccatttattatttgtaaacacgacagtcttgagttttactgattcttaaccttcatataagtcatttcttagtgtatagtatatatgcttctgtgacttgcctttttcactccacatgttggaatttcatcaggcgaggcacatagcagcggttcttcccttttcactgctgtctgatgctccactgtggaaagatactaggatccattccttctttcattgaggtacttttgaactgtttttcatattttgctattggaaacgtctttttttttcctttttttttttttttttgagatggagtctcgcgctgttgcccagcctggagtgcagtggcgccatctcagctcactgcaacctccacctctggattcaagtgattctcccacctcagcctcccgagtagcagagactgtaggcacccaccaccacaccagctaatttttatattttttagtggagatggagttttaccatgttggccaggctggtctcgaactcctggcctcaggtgatccacccgcctcggcctcccaaagtgctgggatttcaggtgtgagccaccatgccccaccctattcatatcttttacccatccttttcctgcagagtaatttttatttttctcaatcatctgagaggtgctatatagtctgctaatagtcccctcagttcaatttccttatattcttctcccaagtccccctaatgttaacatcttaaccactatacaactattaaaactaagaagttgacatcggtatgaaagcatcaattaactgtagaccttgtctgaatgtgacccacctttcctcttgcgctcctgtccgctgcttcctctcgcgtcctgtccgctgcttcctctcgcgtcctgtccgctgcttcctctcgcgctcctgtctgctggatcctggcctggaatcccccattgtgtttagtcattgtgtccccttggtctcttgcagtccatgatagctccttgatctttccttgcctttcatgaccttgacatgtccagagcactggccaggtattgtgtagaatcttcctgtttgggtttgtctggtattttctcgtcatcaggatgaggggatgcatttttttggcacagaaaccgcaggcgtgccgttgagccctgctcagatcatctgatcaggaagtgcgtgatattgtccagtggctggtgatgcaagcctgggttgcttggttgaggcactgttggccacctttctccactgggaagtcagtattttctctgtgttgttaacacatatcttagggagatacattgagaccctgcaaatagcctgtttctcctcaggcttttgcctgtaaatgttaatgtcctccagggcatcttaaggatgacgtttttactagcccctttccatctgcacattccttctcaagttaactttaacagttaaggtaaaagaatcaaaagagagtggaagatgtggttgcggtagaaaggaaattttaatctcctaaagagcagggctggaagaaacaattgggaaatacatgtcagtatctcaatgtgaaattgaggtttacaccttttccccatacactcacagagtctgggaaagaagattctcattcatttagaacttggatggaaattgaggattttccaaagaaggaagcagaagtgtctggggctgatcgtactgagtgaggcttctgtctgggattcggcatggtgcagcagctttgacaggcttctgtctttgccctgttccgtcagtgcagggtgtcagtgctggaagggacctcccaatttaggaagtcaagcccttgtattgtcacgacatggaagtaagcccgtaccagttatgctgtgcctgaggccacatcatcttggtaatcactgtgagaaatttgggcctcaaagcccagtctgcttgtttctccccttcttcactcattcattcattcattctgcattcatggatcacctactgtgtgagacccggtgctacatgctggggatatagcagtgaagaagaccaaacatgagcctgtctccagcgagtgagcttttaatctagacgtgcacttggcgggtgattagggtaaggtggccacaggtgggtcagtagtcgtccctttggttcgatcttatgcttcagaccatgagactttgtgaagatacagaaaatatactgttgtagtcagtgatgcatttgtaaagtctgtaataatcagatgcagagatgatgatgtgaaattcttgtttattgggtggtgggtgcatgactgttattcctatactttatacatttgcccttctttttattcttcaaaaaaaatgatggagcattttattaaaatagctagatagtaggaccctaatagtcgttgttgtcaaaatacacaattacagcaaaactgaaagaccatacccatctgaagtcaccgttaccagggctccctcccccacccctgcagtagacccttgtttctcttccaatcttttcctgagtgtcaaagcttttctagggcaatgcttcatcaccttgttttttgcttgtctttcttccccagctgacagcatttgacagtccctgtgaagagctgcagctgctttgagaattgctgtcagccaggtactaggcgcctccctgttccctctgccgtcttgctttttcctgccattccagtcagagatagaaacaaaaagaggaggaaaaaaggctgtgtctggtgattaccttgtgacgaccctttctcctctgagaggagcagggtgggccggggtgggggatggaaatcttccctttccataggggaggcagcctggccgccttccccactggccccttgccatgcctggccattgctgtccactgctggtcacagacagcagacaccccatgagcatcacttctgtggctcagttaaaaggaagatgatctcgccatgttagaccttatcttccaaaacacagttaagtaagacagagcaggatgctcaacagaaagactttggtcatcggtataactaatataaatattatcttcttgtctgtcctcttttttaataaaataaaatttagcatttttaaatatagcttgctcattaactaatgtgcttataatatagtatgtggatgatattgcctacatactacaaatgtggatgaattatctacttttgagtataccatttatttctttaccttttttttttttttttaaagggacaatcttgctctgccttccaggccggagtacactagtgtggtcatagctcactgcagcctggatctcctgggctcaggcaaaccacccacctcagcctactgagtagttgggatcacaggcatgtgccaccacacctggctaatttttactttttctttttcatagcattgaggtcttactatgttgcccaggctagtctcaaactcctgggctctagcaatcctcctgccttgggcttccaaagtgctgggattacaggtgcataccaccaggcccagccttggtgtacctttgaattttaggatctagttaattagaatggtatgatatagatatatcagtgtctttggtgtgtggatcctgacctgaatgtgacctggatttgtatgtcatagtcctccttctgtgccacggaagggtattctttcagtgagtcctttctgtgtgccaggccctgtgctgaagtcaggtctcatttcctcacatagccggtaggacagacagacatgcaagcaaataattgttataaatgtggtaagaaatataattgaggttagacaaggtgttgcgcgcctgtagttccagctattcggtggctgaggtaggaggttcacttgagcccaggagttccaggctacagtgagctgagatcgcgccactgcactgattgcagcctgggcaacaaagcgagaccctgtctcaaaaaatatgtaattgaaaaataatcaggctatgttaagcataaaggaaaaaagcagacaattctatccggcaggaggaggtcagaggtgctttggaggagacttttctaaaggcaggtagaatgacccaggagacagtgcggagtgaggtggcagagggagcagacacaggcagggactgggaaagcagccggcagggcagaagcttgctcagccagaggctgccctgcagagttgagcaggctttaggcaagaagagtatgcatgcacgtggatgcaagcacagaaaccccagctcaaactggcttaaccagaggcgctttgtgagccaaaaactgacacaggcggtagctttatgtgcactgtgagctatttctctgccctttcctgggctttcctgggcttctctgtgctggttcctttttggcctggcttcctctgtggctgcaaaatgatggcagcagaatgaggcctcacacacacacatcaccaccaggagcaaggaggggacctggcacatggccagggagatgctgtgcgtggttggtttaggcatggatgaactctggatccctgtcctcaccactggagaagtaggggccgcctaactggagcagtgggtgggatgttgccacccggtctgtgtgctgtaaggtgggtgcaggcaggtctcagaggtcacagcgttctctgcggccacatgtaccaagcagtttgaactcacctatggggagtagtgaggcaccactgaggtgtcagagcagtaaatcacagatctgagttgctgtttttccagaaatcactgtgactcatgtaaaagatgcctgaaggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagatgcctgaaggggtccgggcacggtggctcacgcctgtacttcgggagcactttgggaggccaaggcaggtggatcacttgaggtcagttcaagaccaccctggccaacatggcaaaaccccgcctctactaaaaatacaaaaattagccatgcatggtggtggggcgcctgtaatcccagctactctggaggctgaggcaggagaatcgcttgagcccagggatggaggttgcagtgagcagagatcacgccactgcactccagcctgtgcaacgtgtgtgtgcaacaagaccctgtcagaaaaaaaaaggggaggtaagatggggcaaggccggctgagctctcctgggctccatagagaggcagtgtggtcatagcagggcagaggtagtcttgatccttaccctcatgtcctactgttcatcaccccatctgcttctttcctggctgcacagctctttgcttcctacctagttaatatcctcactatctaactttcctccaaacatggcctgtgagcaggccggtagcatctttaggtacagaattgcctgaataagtggaactacttattgtttttcatgacttacttttgaaattgtggccagtcaattacatgtagtaactaagttgtgaatataagttgtgtcttttcttgctcggtccagagtgtgcgctcctgtcctcagctgcatatgagccagaggagggtggggagggagagctcccctcttcttttagagtgacttcctagacgtgccgtccaacacatcctcagaagtctcctgaacgggaacacagttacctggccacagcgacaaggcaggctgtgcggcgtggactcacagccagcaaactgtcccggggaggagctgttgagcagcctgggggagcctggatggatccatggggtggccatgggagcagcttccacatattcttggctctctggttttgctggcatttgtttttttttttggagacagtctcgccctgttgcccaggctggagtgcagtggcacaatctcagctcactgcaacctctgcctcctgggttcaagcgattctccctcagcctcccacgagcagctgggattacaggcgcctgccaccatgcccggctaattttttgtatttttagtagagatagggtttcactacattggccatgctggtctccaactcttgacctcaggtgatcctcctgccttggcttccaaagctctgggattccaggcgtgagccatggtgcccggccctggcatttgttttctctctgccgtggtaacagagttgagaagatgaccacaaatctggactacattttctgccttcttgtggtttagcatagccgtgggactgagtgctgggccttgctgtaggggcgaaatgacacttacccccggcctctcccccttcccgatgcctggccagtgtcaagaatctgagcagtcagcgtggacccacaacggaagcggccttcagcctatcttgtttaagcctctgtgtcttggctttagctctcaccaacgtagcttcccagagtggcgtttcccggaaagctcagaagatggtgggtgcctgggggaagggagaagagtgttgtagctggaagaatggcaagcgcagaggcccctaggcgggagcaggcttcgtgctccagagtgcagcagggaggctgacgggaggtgggccagagcggtgggtgacaggcgacagctcgtggtgcctgtggaggggcgcctgagggctgccggaaggacttaggaattggtcagaggcgtgctgtggtttgactgacacttaaataggattgcgttggtagccatgttgataataaaagtgagggtcccatggaggctcttgaagtaatgtaggtgacggtgacggaggcggtgagctgccatcagtttccagacaccctagaaccgggagggattcacaggccacctcgcctattgctcacacagcttcaggattgctggtgtgtccgccctgaggaagagcgagccccagggttgttgtgttctgtctgtggatttggggtgcttactggggagcccaccgcttgtctttgtgagtacgcccaggctgcctctgtgtgtttggaccctgcccctggagggcagagcagacagagctgaaccccgtgttcatggtgtcactcacagtggcatctggtgtcttccttgccgggggcttggctctctgccaggagacatgtttcagacccagagtccccagtctccccatgaaggccatcacccatcgttccttcaggtctcgagatgggcatggtgggttggggatgcccagagtcgccatcttgaatggggcagggagaggttatagcagctcagagacacctgccccagggacagcatcagtcccggtctgtgctggtcacggactagctgacttctcaagcattcgattagtgtttaattagtgaaaactaaagtcagcaaatcgcaccagcccctaccaggtgcatgagaggattttccccatacctcagctatatggctttagacttctatatgcttagtcttccatagatagacagacagacagagatataatatgtttatacgtttagttttctgtaagttttgccagcttggtaagtcgaacttttcataatcattggttcttttcatatgtttattggccatttacatttattctcttcttagttggctattgacattctttgctgctttatttttctttgggaataagcatcttttgattcgtaccagtcttatcgccaggcgcccgttttttccaactcccttttctttttttcaatttttcattttgaactaattacagattcacaggaagttacacagatagtccttgtgtgtgtcacctggtctccccccaatgatgacatcttacaggattatagcacgggatgaaaaccaggagactggcattggtgagcgtgtgcatgtagtactgtgtcactgtattacatgtgtaacaccacagtcgaaatacagaaccatctcccaccatggcctccctcatgccgcccctttccagtgtaccttctttttaaacggaatctcgctgtgtcacccaggctggagtgcagtggtgcgatctcagctcactgcaaccttcacctcctgggttcaagcgattgtcctgcctcagcctcccgagtagctgggattacaggcgtccgccaccacacctgactaattttttatttatttttttatttttcgtatttttagtagagatatggtttcgccatgttggccaggctggtcttgaactcctgaactcaggtgatccacccacctcagtctcccaaagtgctgggattacaggcatgagccattgtacctttttatttctgagtagtattccctagtatggaggtaccacagcttgtttatctgaaaaatgtgtgtgtgtatgcacatacacaatacacttacacatgaagaaaaatgtgtgtgtatatgcacatgtacaatacacttacacatgaagaccgcatcacttttcagctcataggataagtcacaatgtcagaaataagtgaataatttctagagaaaatagagttatttcagatattaaaccatcagaatttactttcttagttttggtttggtactgtatatatgtgtgaccgtttttaacctttcacgctaaattaacttccatagtgtgattcagagctttcttaactgttacagtcagaaggacctgagaaattcccctaccaaatcctatttgatattgacaccgtttgaggtctgagacttgaagaaatttgcctgacgtgacaaagctaatgaatgacccagacaggcttgagaagaatttagagtagcctgggtagtctcatgcttacttgggtgctgatcccagctctggagcgggtgggacacttgcttttcctctggggtggctcttgcctgaggatacagaagcaggaagctgaggtatttgctattcttggatcctgcactggtgagaaacttaatgtgtttctgcctgtgatgttggcctttccccttcatttcattaatcacgaagagtattatatacttataaacctctaaaaatctactcctctaggggaaaaaaatgaagtgttaagtattttaacatagatccttaagccagtacatagtggcccagggtaaaaatgtgtgatgtaatagagttaataatgaaatactttatgtgacagcaagaccagaaaccctaaaggaaaataatgatggatttgaatacataaacgtttttaacatttgtatggcaaaagtcaacataaattaagagtcaaatgacaaatttggggaaaattgcaacctataacaaaggtgttttctgtatgctaaaggagtgagagggcgcttgcgaatcagtacacaagggatgcatccccaggagaaagcgaaggaaagaaggaagagggtcatcatccatgccactcattgtggaaacataaattaaagtcatggtgaaatagctttgtcagctaggttgggagtgattttaaagaataatgctttgggctgattgggtctcaggaagtaggtactatcatacataaaaggtaggagtatacagtgaggaagttccacagtttgtgtcaaaacataaagtgttattctattctttggcagtaattcatcgtcccaggaatttatcctaatatagtaattgtaagatttccagcttggctgggcatggtggctgatacttgtaatcccagccctttggtaggtgaggcaggcatattgcttgagtccagagttcaagaccagcctgggcaacggggcaaaaccccttctctcccaaaaatacaaaaagattatccaggtgtggtggcatgtgactatagttccaactactcgggaagccgaggtgggaggatcccatgagcctgggaggttgaggctgcagtgagccatgatcacaccattgcacctcagcctcagtgacaaagcaagaccctgtgtcaaaataaaataataaaataaatgttaaattttaaattaaataaaatgagataaaaatgatttccagcttctagttatagtggactagttatctaaagacctgctgaaaataatttaaaatgctagataaaatgttaaaaataaatttattaggccaggcatggtggcttacgcctgtaatcccagcactttgggaggctgaggaaggtggatcacttgaagtcaggagtttgagaccagcctggccaatgtggtgaaaccctgtctctactaaaaatacaaaaataagccagacatggtggtgggtgcctgtaatcccacctactcgggaggctgaggcaagagaatcgcttgaatccaggaggcgcaggttgcagtgagccgagattgccccactgcactccaacctgggggacagagcaatactacatctcaaaataaataaataaataaataaataaataaataaataaataaataaataaatgtgttacagcctctaagcactgacaggattgtaaagcaccaccaggcgaaaccttacaagagcctggtgggagaagcagagcctgagctgcagtttctgacagatcttttgggggtcccgaagtggaggtggaaatgaagttgggggatctgataggagactgccgtgtaatgaatggggacctcagagggtgaggatgaatggaaaggatacgcacaaagaggggacagcagagaagcagggcagggagagggaggagacaaactaaatcccacccatgggccagctccccgggagacctgtcacccacatacctagcaccatggcagtccaggcaacccctgtgcgatggatccagtttaaagtgacaccaaacagataacatacccaagtgcctggtagaagccaactttctctggaaagacactttaaccctaaaccatggagattccccacagatggtttcttaggggcaggggcatcacagagacagccagactcccaggtagacaacacagtgcctggaaccagaggctgcagcagacggtggggtcaggtcagacctacatgcttcagatattggactccgacaccggtctttaaacagctgccctaacttgtttaaagataaaagttagaaaactggacactatttaaagtgacatggcatatgtttaaaagaacaaactagaaattctagaattgaacatttaaaactaaaaaactcaatggctatgttaggcaacaaagtattagtaaactagaagaaataatggaagaaagtatcaagaatgtagagctgagagacaaaaagggagaatataaaaggtcaggaggaaggaggatggggtcagaaggtgtaatgcacgtttaacactgagtcacaggaagaaaagtcggggcagcaccatgtttgaagtgacggtggctggtaaatcatatcaaacagtcaagaaacccagtgaatcccaagcaagattaaaaaaaaaaaaccaaaacactatagacataataaaactgcagaaaaccaaacacaaagaggaaaatcttaaaagcagctacagaaaaaggtagacgtgaactttcaaggagtgacagtttgacagctttcttcccaaaagctacagcaggcgccagaaagagtggaatgatatctcgaggtggtgtctacaagagagcttaactctcaatctaattgagttttgtaaaatagaaggcagaacagagacatttccaaacacagagagttgatgggtagcaaatcctcccaacaggaatcataggaactacacttgaaacaggaagaatgtgatttctgatggaaggtttgaaatgtgtaagaaataatatgaagactaacatctcttttttcttttgttttcacttttggtgtcaaagctaagaatttgttgccaaatccaaggttattaagatttacacctacattttctttttatgtttaagttattttctatttaggtttttggtaaattttgagttaatttttgtatatggtttgaggtaggggtccaaatccattcttctacatgtggacactcagttgttctagcacaatttgttaaatgtctcctctttccccatttaatggcattcttgttgaaaatcaattggccatagatatgtgggtttatttctagactccaaattctattctctcaatctatacatctatgcttatgccaggaacacatcactttgattactgtagctttgtagtaagttttcaaagtgggaactgtgagtctttgagctttgttttcttttcctcattgtggttttgatttgcgttcccttgaggagtaatgatgtcaagttgtagttgttattgatgaagaataacatggacttgctctatcacagagattagcaaactttggcctgcaagctaaatttcatgtagcttatttttgtacgcccacccatgaaataagattgttctttacatttttcaaggcttgagaaaaaagaatatacagtaaagacagctacatgtctttagacccacaaagcctgaaatatttaccatttggctgtttactggaaaagtttgctagccctttctctaattatcagatattaagatttatctttttaagaacttcaatacagtggaggtgttggtgcagaattagataagtagagtagtcaaaccacataaagaacaatgaaattgtaccctacacacacacacacacacacacacacacacacacacagacacttactttgaaatggattagagaccaaatttgaaaggcaaaaccatgtatttaacgtgtgcgtgtgtgtgtgtgtgtatgtatatacacatatatatgagagaatcttcatgatcttgatgtaggagagaatttcttaaagaactaaaagtacaaatccaagaggaaaagattaataatttgactcccataaaattaagaactgctgtatattttcaaagatagcaccagctgtgacagtgaagtcatttgctatctgtaacctacaaaggtgtgagtatccagaaataggcaattcagtatgagttacggctttcaataggcacttctgagaagaggagatgatattatgatatactcacagatttgcaaaaattaaaacgtgacaatgccaagaattggcaaggatgtgggatgacaggaactctcatacactgcagtgctggtgggaacacaagttggtttctctagtttggaaaacagatgggtatgatttactaaagttaagatatgtgtttccagtggctcagtaatcccaatcctaggtatgaaaagccatgtatgtaaatgttcatagcattatatataattgaaaaaatccaaatgttcctcaacagtaaaatgggtgagtaaattgtttttttttaatttctgaatgctgcaggaaaaatgagcagaggacagctctcagcaatatgatcaatctcacaaacattatgatgttggcccaaagataccagacacaaaagagtacatatagtgtgtttacattcatacataagcacatatatagtgtgattacattgagaattcaaccacattgttgaagagtgcatacacaggagataaaactactggaaaggataccagcatcaagacagtggttgcttctagaagacagagcgagtgttttgataagggtgcttctgaggtgctggttgcagtccatttgttgacctttgtgattgctattttatcggttagtgcatgtatcttttatgcatttttcctatattgttataatttacaataataattttaaaaaggaaaatcagatcaatatgcaaagattatttgcaaggatgtttattgtattgcttataaaaacaaaaaggaaacaacctaattattcactggtaggggttggttgactaaactggaatactgaccatgtgatagaatattgtccagcggttagaaaagctgagagagaactctctatgttgacatggaaagaagtccctgacgcatcaagtgaaaaagtgaggtaagtagcaaaatatatatcctgtttctgtttagaagggaaaacaggcatatatatatatatatatatatatatatatatatatatatatgtacacagaaatgtgtaaaaaactagtacgtggtgtaagtacatccactgagctacctcagttgttctatttttcttatttttatatatgtttatgaaaacattcactttctaaattatttttatttttaactgtggccaaaacatgtattattcgccaagcctgctggctcactcctgtaatcccaccactttgggaggctgaggtgggcagatcacatgaggccaggagtttgagactagcctggccaacacagcagaaccccatctctactaaaaatacaaaaattatccaggcgtggtggtacatgtctgtaatccagccactcaggaggctgcagcatgagaatcacttgaaccccggaggctgaagttgtagtgagccaagatcacaccactgcactccaacctgggtgacagagcaagactctgtcttaaaaaagttaaaaagtttttaaaaatgaagtgtttttataatcagaaaaggccatgagaacaattttagagtgaattataaaaattactgtgacaggaattttttttttttgagagtctcactctgtctcccaggctggagtgtagtagcgtgatcatagctcactgtagcctcgaactcgcaggttcaagcaattctcccacttcagtctctcgagtaactagaactaccggtgtgcaccaccacacccaacttatttatttatttatgagacagggtctggctctgtcacccaagctggattatagtggcgcaatcttgtttcactgcaacctctgcctcctgggctcaagcattcctcacgtcagcctcctgagtagctgggggactacaggcatgccaccacatcaggctttttaattttttgtagagaaacagccatgttgcccaggctggggtcaaactcctgggctcaagtgattcacccgccttggcctcccagaatgctagtattacaggcaggagccaccacgcccagcctcagctaatttaattttattttttgtagagatagtctcactgtgaagcagtcttcttgcctcggcctcccataaagtttatgtattattcctgaaagaaggcttacagttgaaataattctggttaaatataacgtacccttaatctgaaagtttcaaagggtggtagtatcaaccccattccccatccacttttaccagatttcaacaaatttaatcagcttccacaagaactgagtaaagcccagggaatgagaagagccctggactctcaccattttcgctacatattattgaagcttcagtccttagctatcaaggaaggcggtattaataccctccttttagactgactctgagagatgtgaaaacatctagcaccatgcttagcaagtagtatttgtttacctacctggctctctgattttgaatttcttttgtgctcagcagtgggctatgagctataggaggaacgattttcttccattcatctccctgagagccaggggtctgaactcctgaagtaggggcctgtattacccaacttgtggagagatgatcacaatttagcctccagctctatgtaagtagggagctgttggtgtgagtgtcatggaagaaatcagactttaacttgggtggttttgaatgaaagatgaaattctcaaaagagataggagggaggtggcacagatgggctgatgcaatccataagtggtgatcggagactcagaagccagcctgctcttgtgaaaaagcaaggcctgccctattctggctgttcttaggagaggttttgtgagaattttgcgtttaagccaaatgaaatgcttgatttattaagttgttatgacttttttcttttctctttttgaaaaaattgtggcgaaatatgcttttttttaagtctcttctcactaaaccttctagcagaccagtattaacaactggacacatgtatcccagcgagtctttggaaaagactatgccgctaaggcggcatagtgtagctcgtgtttgagcatttcctcggagacattcctgtgatgtgagtgcagttgtgatttgctgtttggtaaataggagattgaaaggccctcctcttctgaagttggaagacatctttgctgggatcaccagggacacctcacaagttttagttgatctttttaaaatttccttgcttatgagttcaaggtttagaaacaaatctgagtttatttatgagcctttcacatctgagtgggcagattccccaggagtagtattttcatcatgttttctgtcttagctggagctgccataacagttccacacactgtgtggcttgaaaacagacatatatttttcacagttcagaggctgtgaacccaagatcaaggtgctggccggtggggttcctggtgagggctctcttcctgacttgcagacagccaccttcctgctgcttcctcacatggtggagagagagagaagctctgatgtctctccgtcttcttataagggcactaatcaggtcatgctcccacctatgacctcttctaaccctaatcacctcccaaagaccccacctccagataccatcccactgggaattagggataggaatttggggaggcacagccattccattcataacagtgttgtgatattgtgaagtatacatttggtcttcctttccatttccaaacatatagcttcgccctttcaggcatctggtataattgaactaagagacaatatcatctcttgttttgaagctgctttcgaggtattaatataccattggatttctatcatatggcccatttattcattccgttaccctctgctactagtcctccttttcttcatttatacccaagcgtccacgtttgaaaggagcattaggttcagtcactgtgctggtctggattgcaggcagcaataacctagccagtgtctcccctcagtccactcccattcagatagggtagggctacacaggtgcaggactagggggctgtatttaccaccaggaagtacagctgcagtcaccgtgaaccccagttctcccagatggggtaaaggcacaacccacccccatcaggtccttggaattccagtgtaaggtttattcttattttattattgagacagagtctctgtcacccaggctgaagcacagctgcacagtcacagctcactgcaggcttgaactttcaggttcaagtgatcctcccacctcagcctcccaaagtccctggattacaggcatgagccacctctcctggccccgacgtaaggtttaaaaacagtacagtttcttgcttaggaaccagctctgcttccagcactggggttgcaagacctggtcctaggatcactgcaccaagtgggagcagggtggccaagctgaggtgatgcaaggaaggaagaaaaatgtgtaatccttatgccagcctgctcctctctcggcaagaattgtgtggtcacaccagcctccttcccagcccctctttccctgatccacaaaacaggaacatcgaatggggacgtcctttagccgttgaatgtgggccagcccttcatgctttcatcgcccctgtcttagccagggttttaactccccgttccgctgctctgtcagactcactccgaggaggatgcgtctctgcccgttgttggacaccgtgggatgtacagtgtgtcccctggtctgaggaaatgacggtcggtgtccagatccgagcagtgtcttctgttctgttctttctatagcactctgagcactggcctcttccaccaggcaagcaaagcccagtccagagtcagtgttcactctggttaagacccatttgttggctgggcgcggtggctcacacctgtaatcccagcactttgggaggctgagatgggaagatcacttgagcctaggagttagagaccagcctgagcaaggattgctgaagcccaggaggttgaggctgcaatgagcggtctaacctggatgacagggtgaaacccagtctcataaaaaaaaatcaaaagacccattgttagcccccagggctatacttgccagctgtgtccagggccttcccaccaggggagctgccccatagccaccggcagtttctgtctctccagctggcaggcagaatggctgcattaagcctagctgtacggaccttttccacagtacgggtctgggccctgtgcccctgggtaacctgtccaggtagtgtgagggatgaagggaggggaggactctgccagctctgtgggaggctccttaggtgattctgagcctggcctgtattgagagccactgatgagcctctgaggtctcttccacttgtgacgtgattcggagcctggccctctgctttaattcataggcagagtttgatggcagatatcttctcctaagaaagcccgtcacgttagaacaggctgttgggtaggacacaggcgtttagtatccaagtttcgcagatgcccatagaccaggcagctctgttttgcttctgcgtttatgaaaagagctggcagagtgcttcggctccaggccttttcgagacactgggcacgacgttcctcctgagctgctgtggctgagatagaagggatcagcaatggaggctttatttgcagatgattttcctcctctcggtttgtcgttcccactcttcgtcttccagaacctttttagaccccatgacttcaatcctcatcacccaggacattcaggctggctctgtctccttcccatcaacttaatatgaccgtatctaaccctaaatgaggctgcaaaattaaaagcagcatactagcaccagagaaaggatatcttaagcctattcaaatcaaacctcaacaccctggaagctggcgcagcggctgcctacagaaaggagagctagggagctgagacactggtttctctagcgtcctcctcccctgttacgaatttggtactctgtgcatgtattgtctatccaaaaacttgaaagatgttagtcatcctcagtagaggggaagtaactcatcacatagtgaaaagtccaaattgtttaactctttaagccacgtctggtgccaccaaattgggaagggatgtcggtaaattaaattgtgcaattcatactcttttgagaatattattaatattgactctcatatcttgactgcctgctgtgccaaccactgtgcatgagtcaacccaaccccaggtaagaaggtggctcagtaacacagatagctgcgtaaatatgtgacagtgtttaaaaggggggaaaaacaagtaccctgggctttgtacttatgtttattcttagacgtgcctgattttatttacctttgaaagaagttatataaaaaggaagacaaacctgtaagtgcaaaaggaatgaagattcagtgacacgtgttgactgtaggttctcaaaccttgtactttttttgacccttatatcattaaagcattcgacacattagcaacctggaccccccctttgcctcggcaagcccatctcctgctcccctcctctctgtcactgctgcaggcgcactggccttcctgctgctccctgcacactcagggcctcccagcgccatcagggcccttgtgcttgctgttccttctgcctggaatgcacttcctcctttatctcatcaaggttttgactcagatgttatcttcatgaaatcttacctgacaatcttgattaaagtcaaaaccgcacccaccactacctattacctttccctatttcatttaaaaaatgtttttattggagaattacatatatatacacacatatatatgcatgcatgtgtgtatatatgcatatacatgtatagaaataaaagtgcatctatattaactcagttttcacaaactgagcagattgtgtgacctgccgccagctcaggaaacaatgacctgtgccccagaacccctttcatcttcacaccaccttctgctctccagaagtaaccagttctgaccgtgaacaccagctgttctgtagaatgggtatttctgcgttgctgcttcatctgtggcctcacacggtatttactcctgtgttactggctccttctcgtcgccatttcgttttgtgcggttcttccaattctgcggcacgttcttccttgttgctgcatggtaattccattttgtgaatgtcccgcaatttagttccctgccctcctggtgatgggcgtccgggtagacgccagctcagcgtcattacaaaaatgttactgtaggtattcaagaacctgtcttttggtgaagagatgtaggcatttccctcagggctgtccaggggtggacttgctggggcatccaggtgtgcctgggttcagtgttcatggatttttcacagtgtttgtatttgtgctctaccagcagaggccaagttcccattactccacctcatcaccagtgcttgtcctctttttcaaatagccattctggtggccgtgtagaggtatctcattctggttttgtttgtttgtttatttttgagactgagtctcactctgtcgccctggctggagtgcagtggtgtgattttggctcactgcagcctctgcctcccgggttcaagcaattctcctgcctcagcctcccgagtagctgggattacagatgcccaccaccacgcctggctaatttttgtattttagtagagaaggggttttgccatgttggccaggctggtctcaaactcccaacctcaggtgatcacccatgtcggcctcccaaagtgctgggattacaggcgtgagccaccgcccccagccttgtttatttgttttaattgaagtataatttctgtgtgcaaaatgcacaaatcttaggtgtatacaacacaatgagatttacgtatgtatctactcacacagccaccacccacgtgaaagaacatttcagcatccaagaaagtccctcccgctgcttccccattgataccactcctcctggtgaccacgctagtttcacttccatcactgtagattagtgttttgcctgtttttgaagtttgtttaaatggaatcgtttagctggcttctttgcttaatgactgagagattcatctgtgttgctacgtggattggtattttcttcttttttctttatagccttccattaaatgaatacaccataatttatttcttctcctgttcacagacatggtgtttgtttctcgtttttggctactgtgagtaaagctgctttgaacattcttggacaggtctcttaatggatatatgcactgatttctcttggaaatatacctaggagtgggattgctgggtttgccaactatttctccaaactggccgtactggtttatagtctctccagcagtgtgggacagttagtccacgttctaaccaacacttggcattgtcctcttgattttaagcctcctggtgggtatcaattgatgttttactttgcatttctaagtaagaactttcctgactaaataagtttggcacctttttctttttttttttttgagatggagtctcactctgttgcccaggctggagtgcagtggtgcgatcttggctcactgcaagctccgcctcctgggttcacgccattctcctgcctcagcctcccaagtagctgggactacaggtgcccaccaccacgcccggctaattttttgcatttttagtagagacgggtttcaccattttagccaggatggtctcgagctcctgacctcgtgatccgcctgcctctgcctccccaagtgctgggattacaggcgtgagccactgcacccagcatgtttggcaccttttgtacatctgttggccagtgggatatcctcttctataacaggtttgtgcaaatcttttgccctgttgggttgttggtcattttcttgggaattctcgatatgagtcctttgtcagattatccggaatatgtaaagaactctcaaaactcaagaaaacaatttttttaaaaggacaaaagatttgaacaaagaagagattcctgaagcaaataacacatgaaaagatgctcagtcgacgtcatcagtcatgacacacatgcagttgaacaccgtggtgagacaccacatgctctcctaggaggctgccctttggaaggcgaccacccaaggcacagtgagggcgggggtgggaactcaggctctcacacacccctggtagaaatgtgaaatggtactcctgctttggaaaagcggggcactttcttaaaagttaaacatacaattatcacatgagctagcccttccacatgtagatatttaccaaagagaagtgaaaatatttgtccacacaaagacttgcacacacatgtttatggcagctgaacattgggaacgtggccatcaacaagcagatggatgaacagactggggtgcacccttctgtggggatactgctcagccaggaaagggagcacctggtaacctgcagcatatgggcgaatctggaaagaattgtgccaagtgcaggaggccacacaaagaagggagtgtcctctaagatctgacttacatgagaatctagaatatgcagaccaacatggagggatagatgccgaccacgggttgcctgggcaggaagggagtgcaggggaggggaagggctgataaggccacagtgggagttgtttgggtgtttgctcatgatcttggctgttatgatggtcccacagctgtatgcatatgtcagaagtcatcagactgggcaagttcactatgtgcggtttcgtttttttggttttttggttttttttgagtggcagggagtcttgctctgtcgcccaggctgaagtacagtggcgacatgtcagctcacggcaacctccacctcccaggttcaagcgattctcctgccccggcctcccgagtagctgggattataggtgcctgccacctcacctggctaatttttgtatttttagtagagacgaggtttcgccatgttggtcaggctggtcttgaactcctaacttcaagtgatccacccacctcagcctcccaaagtgctgggattacaggtgtgagccacggcgcctggccttttctttgattttaataatttggtttactaagtctgttccctgtccatttgctctgcaaggagtcatcagagcctggcgcttgcagtacccccaggtccacgtttagatgatcttaaaacattgccataatcttgcacgatggccttgcacttaggcagtgccagtattcctatggtatacagtgaaggggcattcggtttcagtaactctgatttgtaatcgtcctacgtggaaacacaaagcaacaagcacaggatcccattagctctgctgcccagtgaagcatccatgttgctttgtttttgtttgttctttttctttctttctttctgtgtgttgttttgttttgttttgttgttgttattgttgttgagatggagtctcactatgtggcccaggctggagctcagtggcttttcacaggcacgcttatcgtagctcactgcatcctcaaactcctgggctcaagagatttcccccacttcagcctcctgggtagctgagactacaggtgtgcaccaccacgcctagctaactctaacttaatctaatgccaactccaatggacaagcattgccctgtcacaagcctagctgaactatgtcagaattgaactctttgagcttgatatggttctagaggctattgagcctcaatttgagcctaaatttaaaattgtgtgatcatttaatttaatttccaaacgggacatgtttataaataaaacaagaccctattaaacaattttgccaagatgattgactcaaattgggactctccagggcaagtggggcatatggttatcctgtttatagtatattatggcagtgaacctcagtaaagtcatacattgtaggtttgtttatttgttgctatctatgcagttgaataatgttgaggatatattttattttcctcacagtaccaggccagtctatagcttgaattgaatcttagctctgcatgtcactatgatctattttattgtaacttcctattataaacctttaattttataaaagcaattttgaaaaagtacttgcccccccatgatttaaaaaaacaaaaacacttagacttaaaatgtaatgacatatcacttttcacccatcaaattcagaaaaaaattcaattgataatatccagtgtgttaagggtataaagaagtgggtatcttaaacccttgttcattaggatataaattggtacaacctttttgggagagaatttggccagagctgtgttttttttgtttgtttgtttttgttttttctgagacagagtctcactctctcacccaggctggagtgcggtggtgcgatctcggctcactgcaagctccacctcccgggttcgtgccattgtcctgcctcagcctcctgagtagctgggactataggcgcctgccaccacgcccggctaattttttgtattttttttaatagagacggggtttcaccgtgttggccaggatggtctcaatctcctgacctcgtgatccgccgacctcggcctcccaaagtgctgggattacagacatgagccaccgtgcccagccggccagagctgttttaaaaaattaatatggatactctttgacctagctgttctatttacagatacctagcttacagacataattatacatgtcccagaagtggtgtgcatgaggatggtttctgcaatgttgatggtagtagcagaaattaaaactacgtaaatacctgccagtgatgctgtttaagtagaataccagatggctattagaaggaatgaaggtccacacagaaacagctctaaggtggctgggcatggtggctcacgcctgtaatcccagcactttgggaggccaagacggttggatcacttgaggttaggagttcgagaccagcctggctaccatggtgaaaccttgtctctactaaaaatacaaaaattagctgggtgtggtggtgcacacctgtaatcccagctactcaggaggctgaggcaggagaactgcttgaacccaggaggtggagggagccgagatcagcccggacaacggagcgagactccatctcaaagaaaaggaaatatatctaaggcatggtaagggtaaaaaccaacttggaaaacaatcaatgtgtagtagtttatcccatttatataaaccaaacaaatcattaaagtgtagatttctccacatacaatatacacatattaaatacagaaacaaaggtagaaaagtgtatgccaagttgataacagtgattaatagttgtgggaatgagtgggaatgaactctcctttatccataggtttactgtttttttttttgttttgttttgttttttttttaccttgagagcatattcacctgttacctaattttataactgaattaattttctaaatgtacgtaactgcattataaccattttgaaagaaaacttattagcattaggttttactctaacctttgttttcctgagtgttacatccatgattttaagggcatgtctcaggactctaggatgtgatttcatttcacgcagtcctcgaatgcagttagtgtttttctgagttctctgaagcagagaaatactaggaaaaacgtagcttgctaagccaggacctcaaaaaggaaggctactgatcttcactggatgaagtgacatgactttgaagctgagagatccaggtttgaattagcaattccttagtcactacatttgctgtatttaaacttggaaaacagaaaccatttccgatcacttatttggcagcaaaacctaatctaactcaatttggacttgtttagtagcaaagcctggcctcacatacccgtggccatttatagtctccattaggtctgtaagcggtagctcatgcctgtaatcccaacactttgggaggccaaggcaggtggataacctgaggtcaggagttcgagaccagcctgaccaatatggtgaaaccctgtctctactaaaaataaaaaaattagccaggcatggtggcatgtgcccgtagtcccagctacacaagaggctgagacaggagaattgcttgaacccaggaggcggaggttgcagtgagccgagattgtaccactgcactccagcccgggtgacagagtgactccgtctcaaaaactaaaataaaataaaatatagtctccattagtacaactgttcacacacacaaatctatgttattgtagaaatattctcagattttatttacgatgaggatttggtaatgcatagcatatgtaccatgttatctttccaaaatctgaaagtttctgaattccaaaatatatctggtgctaagggtttaaaggttaggagttacaatacaaatgaagaagtaaaaaacttgaaacgcgccagccaagagttgattttaaataagaagacagggaaacagttgttcttgtgtgtgagagagggtactataaagggtattcatgtcacagttgttgatggcagcaaaacactggaaatgcccccaggtggctatcgaaagggtcacataagtgattgtacatttattcagtggaatgcagcatagctatttttttttaagtaccacaactcttatactgtatacaaaaaataactcaaaatggcttaaagacttaaacataatcacgaaaactaaaactcctagaagaaaacatagagggaaagcttcaagatactggatttagcagtgatttcttgggtatgataccaaaagcctaggcaacaaaagaaaacatagaccaatgggagcacatcaaatgtaaacatttttgtgggtacagggacacaatcaacagagtgagaaggcagcctataaaacgggaaaaatatttgcaaatcatatatgtgaaaagagttaacattcagaatgtatgaagactcctacaactcaacaagaagcaaagttaaataacccaattaaaaaatgggcaaagggcttgaatggacagttctccagtgaggataagcaagtggccatctagcctatgcaaagtatctcagtatccctgatggtcagagaaatgcaaatcaaaatcacaatgagatactaccacacatccattagaatggctactatcagaagaaaaacaaaataacaagtgttggtgaggaatggagaaactggaacccttgtgcactgttggtgggaatgtaaaatggcacagccatatagtaggaagagacccagatgcaatccaatagtgcctcctcggggtatttatccagaagaatggaaagcagggtctcagagatatttgcacacccatgtttatagcaactttattcacaatgcctaagaggtggaagctggccaggtgcggtggctcacacctgtaatcccagcactttgggagaccgaggtgggtggattgcttgaggtcaggagttcaggaccagcctggccaacatggtgaaaccctgtctctatttaaaatacaaaaattagctgggcatggtggtgggtgcctgtaatcctagctactcaggaggctgaggcaggaaaatcgcttgaacctgggaagcggaggttgcagtgagccaagatggcaccactgcactccagcctggcgacagagcaagactccgtctcaaaaaaaaaaaaaaaaaggcggaagcaacccaaatgttcatcaatggatgaacaggtaaacagcatgtagtacatacacacaatggaattttagccagccttaaaaaggaaagactgcagctaacatactagctacaacagagatgaaccttgaggatattatgctaagtgaaataagccagtcgcagaagtatgattctgcttatgtgataacctgaagtagtcaaatgcatagaaacaaaaagtagaatgctggttaccaggggctgggcagatggggggaaatgggagttgtttaattagtgcaaagtttcacatttgcaagatgaaaaagttttggagatcggtttcacaacaacgttaatatgcttaacaccactgaactgtgcattttaaaatgattaagatggtaaattttatgtcaatatgttttttactacactttttaaaaaagtggatgtggagccgggcgcagtggctcgcgcctgtaatcccagcactttggaaacttggggggaggggaggggggccctggatcacgaggtcaggagttcgagaccagcctggccaacatggtgaaatccccatctctactaaaaaacaaaaattagctgggtgtattggcacacgcctatagtcccagctactcaggaggctaagacaggagaatcgcttgaacccaggaggcggaggttgtggtgagccaagatcatgccatcgcactccagcctgggtgacagagtgagactctgtctcaaaagcaaaaaataaaaagaagaaaaaaaaaaacaaacacaggatacagaactccctacctcgtcttgctggttttctttacctttaattgaatgttggagtcacaggattaggaagtgaagctctcaagttcacaaagcacctgctcttccctgcgcgctcattcatttaacaaagtcttcctgttgtaggctgggcgcggtggctcaggcctgtaatcccagcattttaggaggccgaggcgggcggatcacgaggtcaggagatctagaccatcctggctaacaccatctctactaaatgaaaccccatctctactaaaaatacaaaaaaattaggcgggcgcagtggcgggtgcctgtggtcccagctactcgggaggctgaggcaggagaatggcgtgaacccgggaggcggagcttgcagtgagccgagattgcgccaccacactccagcctgggcgacagagcgagactccgtctcaaaaaaaaaaaaaaagtcagcctgtgattctttttttcccttagattttaatccaagtgattatgaatgtcaaggattaaaatttgggggggttatttgggattccctggattcagatttctgagattatgcttcctttcctttaaggaaaggttttcattttcattataatacaaaaagcaaactgcttattacttttccaccgtacaaaatgcagttgacctacctcaacgctttgtgcattcacctgaacagaagcattttggataactaacgcgtgcttaagcctctgaggacctcattcactaagaggacgaggcggcgcaagtccagctgtggtcagtctcagtgttcccttcagggtccgccggctcacgctgggagaatgagagggacttcagatgctgcttcagttcccagctgtggctgaagctactgggttcacccagctcacctacagtttacagagaaataaagcaaaactcagatgcattcagacagaaccccacctcgagggcagcctcagctctgatgagaccagctgacaggccctggctccctaagccatggcagaggagatcattcattcacatgtcagagacaaagcccaggagtctggattgtgaagtaaacgctgagcccgaccacaaccactgtgaatactgggcaactggggcgtctcagaggattcaggtaattgaacaaatagacttcatacggaatctcaactctcctctggtcagcaatatcagatgtacttctgtgtgaataataaaccagactgcctggatgcgggagcacacgcctggaatcctggcactttgggaggctgagatgggaggatcactccagcctaggagtttgagacctgcctgggcaacatagtgagatcccatctttattaaaaaaaaaaaaaaaaaagaaattagctggggataggtggcacgtgcccgtggtcccagctactcaggaggctgaggcaggaggatcacttgagcccacttcagtttgaggctgcagtgagccatgattgcaccacggccccctaacctgggcaacagagtgagaccctgtctcaaaaccaaaatgataaaaaatactcaaccaatcagaggacaccagcacagcagccttaggaagacttctagaaagtataggcaagcctcactttaggtgcgtaccctgttctcatgcccctgtagtgttgctataggaaagaagggtgcataattggattcactttaaccaagactctaaagcaacagctcagctgagctccttctctctccgtctccctcgctctctgccagccatggaggccactgagtggggatctcagtgcagaggtcccggcctcgcctgcccagggagctttcttgttccaggcgacaggaaaagcagagcctgtgggggaggcattttgtgcagggaaggcacatttagaagaagctttggtttcctggacaagcccaggctttctcattcttaccagggatcttccttagatgcttgtccttgggaagtgtaaatgtgttcactgcagctctttctgcatattttagaccttaaaataattgttttttgtttcgagctagccttagattacaggaccattgagaattgagacactgcttgggacatggactggagcttcatcctcagccatagagcagcactgctgccggggttgagggagctcggggagcttttccagacaaaacctttgctccaggcgtttggcagggccataggaagagctcctttgtgggctccctgagctggaactcggccttctccgcccgatgaagcaaacaaactgtgccgagggcgcaccggcatttgtgccgtcagcaagccgggctgtgtctcagcctcacagcactcctcccacgggcctgggaaggcaaatgtgttttctgaactgtgttgagaccgtgtgtgtgtgtgtgtgtgtgtgtgtgtgtgtgtgtgtgttggggtgtcttgtgaagtcctgctaacctcttgtcagcagaatattcgagaaatgcttctgagaagagagaggaagatgacttcagaggctgcttgtggtctctcactcaaggctggtagggagccccggtctgcgtcctggaggaacggcacgctgagtcctgggccagtggccggcggggctgttggcgaccacagtagcacacaagggctctttctgaggagcaggagaccctggcacgggccccacgggagtgtctggggcgtccccgcctgtggcctcttctccccgccgcagcaccaatggctccacgagcagggctcggagctggccctctcctgcttcggagccgcgctgactgggtgtgtggcggatgggaggccgccctgagtgctcctcctcccttttgtacagcctgggtggaaaggacgggcctggtgcacttcctgcgggagggaggacatggggcctgcttccctctggcgctcctccacccgggcagcgtggtttctttccaaatgatttatcctctcatcgtcctgccgctctgtgcttcatggcattggggtcttatccggaaggggattgtccttttttgggtttgtaaatgtaattttcaggaaatgtcattggatctaactccagaatagaaggcgtggtggaactgcttttgtagtccacagttaggctactcacacctcaggccccgcacacgggtgggttcagaggctggactttggagttaagtagcgtttttgcccttggccaagttaacgtctaagctttggtttcctcagtgaggaaagtgggaaccgccataccgtgtctggattcggtgggatcgtgtgtgtccagcagcagtcgcgcagcgcctggcgtgagtggtgggtgcacgccggccccgccatgtgcaccttctgtgacgaccctaagtcagggtggtgtttcctagcagtgcagaacacgaagcccttacaacttctcctagaaacgaagcctgggttgacccctccacctcagggtgagagcttttggtattttgagtcagtatttttggcatgtcttgttttcacaggtttctctgccgctttcgcttttttctggaggggctggaggtagggacagtaatgaaggtaaggaatgcggatggagccgcagttctctgcgagtgttctgtgtgagtgctgggaggcctcggtgaggttaggctgtggtgctgggtggactggtgggcggctggacactccacatttttcccttacatttggacattccgtggatacgacagatgggaaaactggaccagctggaagccgaattttacgttgtgacctaaagagctgttaggtactcagcactatccagggtatgaaagcagcattagttggtcatctcttcacgttttaatgaacgtgaagtgccgatgctcttttcattttccagtggcccatcttgtcaactcttcattgttttttaagcaaattcaaggattcggtcaaaggagaaccaatagctgcaaattgtaaatcctgtgaaattgtctttgggttccgtcctgagaggccggttcgggaacgtgccctgtgtaaagtgagaactgtttgtatcctaggaattcggtagatgaggtagtgacaattctggagggcgatgctgtccgttccagctctttttagtcatcctgaattgcatcaggttttaggaaaaagtttctggttttcttctttatttgtactaggcttctgaaatatctcaaattctgccatgaagtcagccgtccttgggagtctgtgtggcacagatgtctggtttcagggaaatcacagctgccatctgcgtgcccaccccgtgcctctaggcatagccagcagacggctctgtgagcatggggtggtggctttgacctcatagaagaggaaactgagacccagagggggactgtgccatccacggccgggaggtagcagagccggggctgctgtgctgggagcttgtttgcgcagtgccgtgcacggtggctcggtgaggcggccgtggttgtctcccatccgcataactctaagaggagccccacagccgagagccagacgtgtaggaaatgctttctatgagatgcgtgctacgttcctgactccgtttacatgtcattgttttgggtctaaaacaacatgctgtcccaaaactacccatgaactgtgaggactgagagcaagcaacttcgtcaagactgtgggaaggacagggggagctggagtggggaaggtgccagccagaaccccccactccccaccaaagaagccacattgctgtgaggatgtgacaacttctgttcctcgtgtcaccagcctcttgcagacaagctaacctctggtgacttggtaaagccacgcagctgggacggtccagcagtagggagctcgacgctgtccctagaggaaagattagaaatggtcgtagctaaacttagctctggataagctgcctgtagaaggaaatggagatggatttggagggtggaggttgggaaggtttaaagggacagtgacaggtctgtcctgcttgagggatgtgtgtggaaagtcttcacaggctctggtgcagtgctcgtcagggacgccctgatgtgacgtggtgccatagtcatcttaggtctttggaatgaagaataggctctgcccagaaggaagtgaagccacggtgttgatttgacaggcagaagggcctgggtggttctcaggtgcttaccacagcgtccgggaaagaccactgacattgattgctttgatctcctgggtgattggcagtgagccagttcagatcctctgacttggtgtccccctggtgtactggtaaggcattctattgagtcgagcctgtgcagaacacagcaggttgtggacctagggaggcagcgctgctgggaggcgagcctgagcagctcgtgctggggtgtgccctcctgcctggactctgcacgcgttgggtgtgtcttcaatctccactccttccccaggcagaggcgggcgatgggaagaaagcacgtccatcacgtggggctctctttgtccacacatccaagctacacattgccaacagaggccttggagctcttgaccttcagttcctcaaccttgacatcctagtgttttcatattttaaaaaatacttttaaaactgagtgttcctgtcatttttatgcatttgtggtcatgtgacaaagccactggtggcttccagcctacacagcctgcttggcaggagcaggtggcagaaagcagggagcggagcttttcaaaggacctcagctggccgtggggctctgagacgggggcggacaatcgcattggacggcatctgcacccgttgcagaaactgcctggagggagcggcccagccctaaggacagtttttttcatggccttcagtctgtgttttttctcttttgctctttttaaaattctgaagtgtatacatctctctcctatcctgtatgactacagaagagggtctgaaaaaataggcacagcgtgaaacagcatgaacaaacacctctgaacctgccactcagatgaaaaacatcaacagtaattcataaaccccatgtgagccactaccgccaccccagcgtcaccactattctagtatttggctaattattcctttccttttacttgtctttttaccacctattcctaaacagtagtaacttaccacttgggcatgttatttaaccactttgtctcagtcttcccatctgtcacatggacagaacagtaataacacaccgtgagtattgtgagaatgaaggtgatatgggggaggcccttagaacagtgcaggcacataggaagtgcaaggtaggtgtgagttcttacagctagcgctttgtttccttttgcctgtgttttaacttcatgtaaataaggacagtataaccattttatgacttatttcttcagcgttatattttgagatccatcatggggtttttatttttattttatttatttatttatttatttatttatttatttatttatttatttattttgagacagtgttttgctctgtggcccagggctgagtgcaatggtgtaatctcggctcattgcaacctccgccccctgggttcaagtgattctcctgcctcagcctccccagtagctgggattacaggcgcccaccaccacgccccgctagtttttgtatttttagtagagacggtgtttcaccatatcaggaggctggtctcgaactcctgacctcaggtgatccacctcggcctcccagagcgctgggattataggcatgagccaccgcgcccagcagagacccatcatgttgatacatgcggtgataaccctctcatatccattcttctgtggtgttctattagatgagtaaactgcacttgattatccactgaaccagaggtgggcactggtggcttccagcctagggctgtgactctgctgttaggggcacgctgctacacaggcaccaacctctctagcacaggggttcctccaagtgtgctgtgggggcccccgagaccctttcaggggttcccccaggttccttgaaaggctcccctgattagatcaggcccaccaagatcacctccctttggcttagctgaaagtcgcccaatcacaggagatacgttccatcacactccagcttcctcccacgctgcaggggaagaaattgcacagggcgtgtgtcattgaggctcgtcttagaaccctgacagcacagaacacatgaaactgctgagacactgtctgccctttacaccctctttcatgtgcaagcctgcattggagcttttcagaggccacacgacgtatgaggatgtcatcacttggatggcgaatgagataagtgtttgcagagccttgttttcttaaagtgctaggattacagtgtgagccactgcacccggccctaaagccttgttttcttaaaagctctgagttttcatttctaatactgtaagcatcgatagttggggagatgttgagtttttgggtttttgtctttgtttaagaataggatagtaaaaatagaggggctttccataaagagcctgaagcaacagctgctgactcatcctgttggttttgagttagggagtgactcatccccaagcaagaggttttccagacatttattaggtctgtagagcttgtgttctgtgttaaccaggcagctacatttgcagggggagggaagaatcattccttattattgctattctgatgtggggacagcgaacaggagtcagagaaccactaagctattaaaggaaaaaatatttaagctgccatttaaaaagtcaggtttgaaaaaacacatgtcttcattgactcagcaagcgttcagtacgtactaagtgcaagaggtccctggggctgagaatgtgcagggaagatgacattttcctttatgcttcatggttattttgccctaagaagtactaaaggttttttgttgctggatgaaaagattaccaccaattagcaacttaaaacggcacagatgtaatgatctcccaatgtgcttgggtcagcagcctgggcatccagagttcgccacgtgctctgctcggaacctcgcaggctggtgcacctggccgcgttcccatctaaggcttgtcatcctttttcaagctcactggtactggcagagttcatttccttgcagtcctctgactgatgtcccattttcttactagctggcagctcctaggggtgccctcacttccttgccacgtggctcctcctcataacacggctgtgtgctttcttctaggtcagcaggagagcacctcttttaaaaggcccacctgacatggcgaaaccctgtctctactaaaactacaaaaaattagccgggcatggtggcgggcgctgcggtcccagctacttgggaggctgaggcaggagaatggcgtgaacccgggaggcagagcttgcagtgagccaagatcgtgccactacactccagcctgggtgacagagcaagactccgtctcaaaaaaaaaaaaaaaaaaaaaaaaggcccacctgattagatcgggcctgccaaggtcacctccttttttcccccgccttgggacagagtatcgctctgttgcccagactggagtgccactggcacaatcacggttcactgcagcctcgaactccccagctcaagagaaccttccacttcagcctcctgagtagctggaactacaggcatgtgccaccacacccggctactttttaaatttttaatagagatgaggtctcactgtgttacccagaccaacctcaaatggcctgggctcaagggatcctcccaccttggcatgagccaccatacctggcccaagagcacctcctctttgactaacttaaagtaaccaaatcacaaaagtgatgttccatcatattctcaggtcccttccacactccagggaaagacaggggcgtctgtcatcgaggctcatcttagaattctgacagcacagaaatcttttcctaacccaagatcacacagatcctctcctatgtttttgtttgtttgtttgtttgtttgagacagggtctcactcaggctgtagtgcagtggcacgattgtggctcactgcagcctcgacctcccgggctcaagagatcttcctgcctcagcctcctgagtagctgggactataggcgtgtgccaccacacctgactaatttttaaaaattttttgcagagatgaggtctcactctattgcccaggctggtcttgaactcgtaggattataaatgtgagccaccatacctgacatcctatgtttttttcagtctagttttagtgatccagtttgaattagatttatataggacatagttagaatcaatgtccttttttgattttctgatcctccaaatgagagttttttttaagttatgtgcagatcaccagtttttccagcaccatttgttgaaaacttttcctttcctcatttgagttgccttgtcaattttttataaatcaattggccatatatgtgggggcctgtttctgcactctcatttctattcggttgatccatattacttttcttttgccgatgataaactctgtcactttctagcaagttgaaagttggtattatgaaaacgttgttcttctttataaaatggtttgttattctgtggtgttttgaagagataaattttaaaatgagcttgtcaatttctaccaaaaaaaatgcctgctgggatttgtattgagactggtattcaatctagatcaatttggggagcataaacaacaatgttgaatcttccatttcatgaatatgacataactctccaattatttaggtttcaaattttttgcccaagtgttcttcagttttcagtaaagaaatttttcacatttaaaaaaaatttcctgttttagccaatgcagtaaggcaagaaaaggaaatgcagggtagacatatcagagaaaaagaaatatgactgttcctgttggcagatggcacagaaaatcccaaggaatctaccagaaaagtcatagactaatgagtcagtttagcaaggctacaggatacaagatccatatacaaaatataaattttacttctatagactaacaatgaccaatagacacatggaaacaaatttaagatgcaacaccattaacagtcattttaaaaatgaaatactgtggtgtaaatttaacacaacatctagaggacttgtttgataagaagcacgaaacactcaagaaatgagatctaaacaaatggagggatgtgccgtgttcatggaaaactcagtgctgtcaagatgtctgttctcccctgattgatacacagatttgacacaattcctgtgaaaatcgcagcaagatcttttgtagacatggatgtgattattgtaaaatgtatgcggaaaggcactggaatggccaaaaatgtttgaaaaagaataaagtgggaggggccactctccctgattccaaggcctgttgtctccctgcagtggtcaggcctgtgtggtgctggcgcagggagagacacgaggtcactggacagacccgtggatcgctccccgccagcacgcccgactgattgcagccaagggcagaagcaactcagtgaagaaggagagccttttcaacaaagggtgctggactgtctctgtagggaagaaaaagtgaaccttgacctaaatctcttatacaaaattaattcaaactgagttacagatttcagtgtaaagcgcagaactctaaaacttgagagaagataacagtagaaactccttggggcctagaacttggtgaagaattcttagacatgacgccctagtgatccgttgaaatcaaattttgagaaacggtcatttttgtttcatcaaaatttgaaatgtttgctctgcaaaagtcctccttttgaggcagggtctcactctgttgctcggactggagtgtagtggtgtgatcatagctcactgcagcctcagtctcctgggctcaagcagtcctcttgtcccagcctcccctaatagctgggactacaggaacgcaacactatacctggctaattttttttttttttttaaagtagagatgaggtctcactatgttgcccaggttggtttcgagcccctaagctcaagggatcttcctgccctggcctcccaaagtgctgggattacaggggtgagccaccgtgccctgcccagatcctcttagtaagaggatgaaaagacaagctacagactgggagaaaagtatttgctgactacatatccgacaaaggactcattatctagaaaacagaactctcaaaacaatactcaccagtacgaaaacaatccaaacagaaaataacaaaacatatgaagtgatttcaccaaagaggacatgccgatggcacataagcacgagaagacatccagcctctccagccattgagtcactgccaattaagggagatgcagactcagactgctgtgagctagcactacacacctattaacacagatacaatagaaaatagtgaaaataacaaatgctggtgaggatactgagaagctgggtctcattcatcactggtggggaggtaaaagggtacaaccgttctggaaaagagtttggcagagagtaacgctgaacttaagggtttagatgtagattctctggtcactgagcatatccaagtgaacaaagcacctaagatgcgccgccggacctacagagctcgtggtcggattaacccatacatgagctctccctgccacattgagatgatccttactgaaaaggaacagattgttcctaaaccagaagaggaggttgcccagaagaaaaagatatcccagaagaaactgaagaaacaaaaacttatggcacaggagtaaattcagcattaaaataaatgtaattaaaaggaaaaaaaaattaaacatacacttatacagcccggcagtcacactcctgggcatttaccctagagaaatgaaacttacatccacaccacacctgtacatgaatgttcacagagttttatgtgtaatagctaaaatacagaaacaaccaaaatgtctctagattggtaaatggttaaataaactgcggcacgttcagaccatggaattctcccagcagtaaaaaggggcaagctactgacagatgcaacagtgtgagcagatcccaaggacattatgttgagtgaaaaaagccaacttccaaaggccacatgctgccaggtgcaggggctcacacctgtaatcccagcactttgggaggatggcttgagcccagtagtttaagaccagcctggacaacatagcaagatcccatctctacaaaaaataaaattagccaatcgtggtggcatgcacctatagtcccagctacttgggaggctgaggcaggaggatcatttgagcctgggaggagagtttgcagtgagccatgatcatgccgctgcattccatcctgggcaacacagtaagaccctgtctctttttttaaaaaaaaaaagccgcatgctgtatggtttcactttaagtacactctagaaaaggcaaaactataggaacagaaaacagatcagtgactatacattctagagatggaaatcagattcgtggttaccaagggattagggatggtggaagaaggaggatggctgtgattataaattggtagcacgagggagaccgttgtggtgggacagttgtgtctcttgattgcagtggtggttacacaaatctagacaggtgacaaagtgcatggaaccacacacacattgtactaacgtcagttccctggttctgatattgtactataagaacaacagatgtaaccactggggaaaatgcatggcaggtccacctatacctctctaggcaatctttgcaacttcctatgcatctataattatttcaagatgaaaagttacggcaaaaaaaaattcacgtttcttagtactattaaaaacggaattgcttttacaatgtttagattccattgggttattggcagtatgtaaaacatatacttgatttttgtgtagtaatctcttatcttgtgaatgtgctgaactcacggattgattctgttgctagcttttttatagcttccttaggattttgtgtttgaacagttaggcgatctgcagattgttttatttcttgctttccagtccctgtgtcttttgtttcatttgttcgcttgcttgctgtcttgctttttgctgttagtctttctaacttagcattgaccagaagcagtaaaagtgggcatccttgccttacacccagtgttagggtgaaagtactcagtggtccaccatgacttaggatgttagttgcatggttttcatagatgccctttatcaaactgaggaagtttctttctattagtctggtgagagaggactttttttttaagccctgagcatgtgttgaattttttcacatgctttttttctgcatctattgaaacattcgtatttttttcttccttattttgctaaaatagtggctgtcttctattgacattttttatgtagttaggtttaaattgctaaagttttgttaaagatattgtgtcttttcaaggggagagttggtctgtaatttttcttttttgataatcttgtcggtgtgggtaccaggatgatgctggcctcataaaaggagttggaaattatttcttcctctttgattttctgaaaaagttcacgttcgttagtgttatttcttctttacgtgtttgatagtgaggtcatctaggcctggagttttcctttggggaagttttgttgttgttttagaacaaatccagtcttttaaaggctgttcaaattttctatttcatacagtatccgttttgggaaattaaattttttaaagcaatttgtccatttcgtataagatgtccaatctgttagcataaagttgtttggaacattctcttaatacctgtcaatgtttgacggagctatagtataactttttcattcctgatactggagatttgttttttctttttcttaattcccttaggaggttatcagttctgttgacatttttaaagaaccaacatttggccttgttaattgtttctattgcaaaattcattttccatttcattgttatctcatctttgttattttctttctcctgcttaccttgagtttaaagagctcttcattaagctctttgaggtggtacctttggtcagtgatttttgatcattttttctcttctataagctgttttttttttttttcttttttctttgaaacggtcttgctctgttgcctatactggattgcagtggtgcagtcttggctcactgcagcctcggccttctgggttgaagtgatcctcccacctcagctccccctgctgagtagctgggactacaagcatgtgccaacatactcggctaactttggggttttttttgagaagatggggttttaccatgttgcccaggtcttgaactcctgacctcaaccagtccacctgcctcagcctcctaaagtgctggggttacaagtgtgtgcccccgggcccggccctaatataagcatgtaaagcaacagatttctccccgaaatgctgtagtggcaacatctcaagataaaagtgttgatattttaacattgtcttgaagttcaaaatactttctgatgtacattgtgaattcttcttgattttggcatgtctgggtaccactcctggagtgtgcatatctctcgcttctgttcccatctgtccacctttccattcgcaccctcatattaatcagttatttcagttcccaagctgataactctaaaactttcgccatatccgaatctggttctgaggcctcactttgtaacttcacactgtgtttcttcacactatgggacatgcctgtccgatagtcccccttgctcttcacactgtgtgtgtgtctgttaacatgcctgtccaatagtcccccgtgtccgtggcttcaccttccatggtttcagttacccgcagtcaaccgtggtccaaaaggggatgaatacagtacagtgagacactttgagagaccacattcacataactttattacagtgtgttgttacaattgttctgttttattgttaaccttactctgcctaacttatcaattaaacttgaccataggtacatgtgtaaagggaaaaacaatatagataaggttgggtattattcaaggcttcaggcatccactgaggtctcagcatgtgtcccctgaggataaggaggggactccagtattttttcttaaaagccaggcataacctatcagttgcaggctctggcatcatcttctgttcctggtaaactgcgattctctgcatttgcctgtctgcctctgcagtttgggggcagcagtgtgtcctgtgatctcagctctctgatgggtctaagcagagctgggacttgcagtttgttctccttgccggtgtcgctgctgtgaggatgggagtgacgacttccaggccctttacatgtcagaccggagagtctgacttctttgacctgtggattattcagaagtgtgtggtatagcatccttgctatgagtttcttcatacttatcatatttggaatttgtggagcttcttgaaatctgtaaatttatgtctttcaccaaatttggaaagttttctgcttctaaaaacattctctgccccactctctttgttctcttctgtgagattccaactacttgtgtattaggcctttaggaattgccccaaagatgcctgcacctcattctttatcttttttctctttttgagattggatcattgggtcatctctattaatctaatttcagtggtcactgattctttcctctctcatccccagtctcttattaagttcatccagtaaattttaaaatttcagatgttgtgtgttttagttctaaaatttccatttgttttccactatgttttttgtgtatctgataagattttctttttttttattttattattattatactttaagttctagggtacatgtgcacaacgtgcaggtttgttacatatgtatacatgtgccatgttggtgtgctgcacccattaactcgtcatttagcattaggtatatctcctaatgctatccctcccccctccccctaccccacaatagtccccggtgtgtgatgttccccttcccgtgtccatgtgttgtcattgttcagttcccacctatgagtgagaacatggggtgtttggttttttgtccttgcaatagtttgctgacaatgatggtttctagtttcatccatgtccctacaaaggacaagaactcatcattttttatggctccatagtattccatggtgtatatgtggcacattttcttaatccagtctatcattgttggacatttgggttggttccaagtctttgctattgtgaatagtgccgcaataaacacacgtgtgcatgtgtctttatagcagcatgatttataatcctttgggtatatacccagtaatgggatggctgggtccaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgaaatggcatctcattgtggttttgatttgcatttctctgatggccagtgatgatgagcattttttcatgtgtcttttggctgcataaatgtctttttttgagaagtgtctgttcatgtcctttgcccactttttgatggggttgtttgtttttttcttgtaaatttgtttgagttcattgtagattctggatattagccctttgtcagatgagtaggttgcaaaaattttctcccattctgtaggttgcctgttcatgctgatggtagtttcttttgctgtgcagaaactctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtgtaaggtgtaaggaagggatccagtttcagctttctacatatggctagccagttttcccagcaccatttattaaatagggaatcctttccccattgcttgtttctgtcaggtttgtcaaagatcagatagttgtagatatgcagcattatttctgagggctctgttctgttccattggtctatgtgtctgttttggtaccagtaccatgctgttttggttactgtagccttgtagtatagtttgaagtcaggtagcgtgatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcatgatatcgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtttgtctgttattggtgtataagaatgcttgtaatttttgtacattgattttatatcctgaagttgcttatcagcttaaggagattttgggctgagatgatggggttttctagataatatacaatcatgtcgtctgcaaacagggacaatttgacttcctcttttcctaattgaataccctttatttccttctcctgcctgattgccctgcctaggacttccaacactatattgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttgttgagagtttttagcatgaaggttgttgaattttgtcaaaggccttttctgcatctactgagatagtcatgtggtttttgtctttggttctgtttatatactggattacatttattgatttgcatatgttgaaccagccttgcatcccagggatgaagcccaacttgatcatggtggataagctttttgatgtgctgctgggtttgcttttccagtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtgccagctcctccttgtacctctggtagaattcggctgttgaatccatctgctcctggactttttttggttggtaagctattgattattgcctcaatttcagagcctgttattggtctattcagagattcaacttcttcctggtttagtcttgggaggatgtatgtgtcgaggaatttatccatttcttctagattttctagtttatttgcgtagaggtgttgatagtattctctgatggtagtttgtatttctgtgggattggtgatgatatcccctttatcattttttattgcatctatttgattcttctctcttttcttctttattagtcttgctagcggtctatcagttttgttgatcttttcaaaaaaccagctcctggattcattaattttttgaagggttttttgtgtctctatttccttcagttctgctctgatcttagttatttcttgccttctgctggcttttgaatgtgtttgttcttgcttttctagttcttttagttgtgatgttagggtgtcaattttagatttttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcatttaggagcaggttgttcagtttccatgtagttgagcggttttgatttcttaatcctgagttctagtttgattgcactgtggtctgagagacagtttgttataatttctgttcttttacatttgctgaggagtgctttacttccaactatcaagtggtcaattttggaataggtgtggtgtggtgctgaaaagaatgtatattctgttgatttggggtggagagttccgtagatgtctattaggtctgcttggtgcagagctgaattcaattcctgggtatccttgttaactttctgtctcgttgatctgtctaatgttgacagtggggtgttaaagtctcccattattattgtgtgggagtctgagtctctttgtaggtcactcaggacttgctttatgaatctgagtgctcctgtattgtttgcatatatatttaggatagttagctcttcttgttgaattgatcgctttaccattatgtaatggccttctttgtctcttttgatctttgttggtttaaagtctgttttatcagagactaggattgcaacccctgcgtttttctgttttccatttgcttggtagatcttcctgcatccctttattttgagcctatgtgtgtctctgcacgtgagatgggtttcctgaatacagcacactgatgggtcttgactctttatccaatttgccagtctgtgtcttttaattggagcatttagcccatttacattcaaagttaatattgttatgtgtgaatttgatcctgtcattatgatgtcagctggctattttgctcgttagttgatgcagttttttcctagccttgatggtctttacaatttggtatgttattgcagtggctggtaccagttgctcctttccatgtttagcacttccttcaggagttcttttagggcaggcctggtggtgacaaaatctctcagcatttgcttgtctgtaaagtattttatttctccttcacttatgaagcttagtttggctggatatgaaattctgggttgaaaattattttctttaagaatgttgaatattggcccccactctcttctggcttgcagagtttctgccaagagatcagctgttagtctgatgggcttccctttgtgggtaacctgacctttctctctggctgcccttaacattttttccttcatttcaactttggtgaatctgacaattatgtgtcttggagttgcctttctcaaggagtatctttgtggtgttctctgtatttcctgattttgaatgttggcctgccttgctagattggggaagttttcctggataatatcctgcagagtgttttccaacttggttccattctccctgtcactttcaggtacaccaatcagatgtagatttggtcttttcacatagtcccatatttcttggaggccttgttcgtttctttttattcttttttctctaagcttctcttctcacttcatttcattcattttgtcttccatcacttataccctttcttccagttcatcgcatcggctcctgaggcttctgcattcctcaggtagttctcatgccttggttttcagctccatcaggtcctttaaggacttctctgcattggttattctagttatccatttgtctaattttttttcaaagtttttaacttctttgccattggttcgaacttcctcctgtagctcagagtagtttgattgtctgaagccttcttttctcaactcgtcaaagtcattgtccatccagctttgttccgttgctggtgaggagctgcgttcctttggaggaggagaggtgctctgatttttagagtttccagtttttctgctctgttttttccccatctttgtggtcttttctacctttggtctttgatgatggtgacgtacagatgggtttttggtgtggatgtccttcctgtttgttagttttccttctaacagacaggaccctcagctgcaggtctgttggagtttgctagaggtccactccagaccctgtttgcttgggtatcagcagcggtggctgcagaacagcggatattggtgacccacaaatgctgctgcctgatcgttcctctggaagttttgtctcagaggagtacccggccgtgtgaggtgtcagtccgcccctactggggggtgcctcccagttaggctactcagggtcagggacccacttgaggaggcagtctgcccgttctcagatctccagctgcgtgctgggagaaccactactctcttcaaagctgtcagacggggacatttaagtctgcagaggttactgctgtctttttgtttgtctgtgccctgcccccagagggggaacctacagaggcaggcaggcctccttgagctgtggtgggctccacccagtttgagcttcccggctgctttgtttacctaatcaagtctcggcaatggtgggtacccctcccccagcctcgctgctgccttgcagtttgatctcagactgctgtgctagcaatgagcaagactccttgggtgtaggaccctccgagccaggtgcgggatgtaatctggtgtgccgttttttaagcctgttgggaaagtgcagtgttagggtgggagtgacccaattttccaggtgctatgtgtcacccctttctttgagtaggaaagggaattccctgaccccttgcgcttcccgagtgaggcagtgcctcgccctgcttcggctcgcgcacagtgcgctgcgcccactgtctggcacaccccagtgagatgaacccggtacctcagttggaaatgcagaaatcacccgtcttctgcattgctcacgctgggagctgtagaccggagctgttcctattcggccatcttggatcctccctgacctctgataagattttgtgtatctttattcaacatgagcatttttaacctaattgagcctaattataatagctgctttaaagtctgtgtcaagccatcccagtatctgggatatttgagttgataacttctgattgtttttgcccctgatgatgaatatcttccatattttgaataatttaattatatcttgggtattatggatgtcgttttaagacttaaatcctgttctgttcatccatctaatgttgatatttttgctttagcagacatttaacttggtgagacccaaactgccaacttggtcatgcctgtgctggtggttgcttagatcacagcagagacccctttcagtttgcccccatatatacggttcaggggccagccaggctcttaggcaaagtttatgcacagaacttgaggtctccctcactgactcttttctttttggagtgttcccaccttaccccttggcagtcctggttgccccagctctgtcctcttgttctcctggccaaaaagatggtaggctttctgtctgaatgttgttgttgccacacaccaccatgcctgtggctcacaggtgatgtgagtgtgcacctggaaaattgagaagaacctacaggtctattattagaatgaatacagagcttagcagggtgactaggcacaagccaatatacagaaatcagttgtatttctattcactagcaacaaaggattataaaatgggaaatgtttaaagatgccatttaagaagcaccataaaagattacatacctgagaataaatctaagggaagatgtgcatcacctgtgtacagaaaatttataagcattaccaagaggaattaaaggcctcattcaaaatcaaaactctgcaggtgtttgcggggacagggagggtagacattgacagctgactttagaactaatatggaaacgcaaagggccggcgagactcagtgctttcttcactttgagcaccaaagtaagcgaggacagagatgaattacagcccctggaaaatgacagcgtctgtgagtccatgtggacagcgatgagataaacaggagcagggctcttgttgacagtggaatgtcactcacagaccagcaagcatggagtggcactgactggaaaatcatctcgaaactgtcatgttaaacactggagacatcgcaaaaaccccaagggccgtgggaggcagccctcttcttcaaaaatctcagtgtaggctgggcgtggtggctcacacctgtaatcccagcactttgggaggctgaggcgggcagatcacttaagttcaagaccagcctggccaaaatggggcaaaaccctgtctgtagtaaaaatacaaaaattagccaggtatggtggtgcacctctgtaatcccagctactcgggtggctgaggcaggagaatctcttgaacctgggaggcggaggctgcagtgagctgagatcgccccactgcactctagcctgggcaacagggtgagactccatctcaaaaaaataaaaaaataaaaaaattcaagtgtttcagattaaatgaaactaaagaggcatgataactacatgtaagtaatatactaaattctgtgctagaggagggaaatggtcttataatgctgtatctgtatatattagataaacctcggtgtctaatacgtggtaattatgagacagtcatcctagatgaatactcttatccttgcggcgttctcctgaagcagcacctgaagttgccgtggttgtagaagcaggtgtcctcattcttaggacataccctctgaagttgttaggggtaaacaacttgctctcaaatgatgacggatttttaaaagtctgtgtattgaaagagagcgagcgaaggataaagcaaatgagagaagatgtgaacaggtgaatctagagaaagactgtatgagctctttgtactattcttgcaacttttcacacatacctctgtcctagccccaaagagacttggaatttgggttctggctactacaaaggctggaattctgctgtgaatttccccaaaaagtagaaagctaacaggcagtccaactgtgacatgcctggtgccgcacttgctgggttttagagattctgtggtggaagcctctggaaactgggtgagctctccccacccctagccctgttatttaggtttttgggttttttttaagagacagtgtctcactctgttgcccaggcctgagtgcagtggcgcaatcatggctcactgcatcctcaacctcctgggctcaagtgatcctcccacctcagcctcccaggtagctgagaccacaggtgtgcgtgccgccacacctagtctaggtgctttttatctagaggcaggggaataccttaaaacatactgtaaaatttctttctagctcatttttctatgatgatccctgtgatacaaatgaagaatctaaatctatagtggttttttgtttgattatttgtttgtttgtttgtttgtttgttttgagacggagtctcgctctgtcgcccaggcaggagtgcagtggcccgatctcagctcactgcaagctctgcctcccgggttcacaccattcttctgccttagcttcctgagtagctgggactacaggcacctgccaccacgcccgactaatttttttgtatttttagtagaggcagggtttcaccatgctagtcaggatggtctagatctctcgacctcgtgatccgtccgcctcggcctcccaaagtgctgggattataggcatgagtcaccgcggcgagccctaaatctgtagttttaagggctgaatctataatttgaactattaaacatcttatgaaactgtttaagaatgagcccaacagatactcataaacccattgcccagtattaacatgttgtttacatttcaccatctttgcctctgacagatgaaaatccacaagttcataattatatttgtcggctcaagctgccataacaaaatactctgactgggtgggttaaacaacagaaattaattttctcacagctctggagattggaaattgaggatctgggtggcagcaccatcaggttctggtgagggagggctgtcttcctcgcttgcagacggccagcttctcactgtgtcctggtgcctcacataggacggagtgagagggagagctctccggtctcttcttatgaaggcactatcgtatcatgaggtccctaccttcagtcacctcccaaagtccccatctccaaataccatcacactgcaggtagggcttccacatgggaattctgggagcatacaaacatgcagtctataatgatgatacaaatagaaccacctagaaaagatcaccaggaaatgccagaaaacccagaaaagatcacactggagtgccatttcacagctagtaggatggccaccgtttttaaaaatcagaaaacagcaagtgttggcaaggatgtggataaattggaaactttgtacatggcccatgggaatgtaaacttgtgcagccgccgtggagaacagcttggtggtcttcagaaaattaagcacagaattaccaaaggactgccgggcacagtgactcacacctgtaatcccagcactttcagaggccaaggcgggcggatcactggaggtcaggagttcgagaccagcctggccaacacggtgaaacccccgtctctactaaaaatacaaaaattagccaggtttggtggcgcacgcctgtaatccagctacttgggaggctgaggcaagagaactgcttgaaccaggaggcagaggttgcggtgagccaagatcgcaccactacactcagcctgagcaacggggcgagactccattttaaaataaaaaaagaactaccataggatgctacagtttcactcctaggtgtatactcaagaaatgaaaacagatattcaagcaaaaacttccacacagctgtttgtagcactgttcacaacggccaaaaactggaaacaaagtgttcatcaactgacaaatggaaaaacaaaccacatatccatacaatggcatgtaatatacatatatatatattggccgtaaaatggaatgttgcactggcctgtgccacagcatgggcgagcctcggaaatgccgcaccaagtaaaagaaccagacacaaagggctgcatgctgtgtgaatgcgctccaatgagagatccagaaccggcaaatccatggagacagaaagcagattcgtgttgtcagggtctgggccagggcagtgggagtggcggctgataggctgtagaagtggtggccgtacaacattttgaaggtagtaaatgccattgaatggttcatgtcaaaatggtgaattttctattatgtagatcttacctaatgaaaacataaaggaagaacccaggcaagggggctggtgctttaggggcccggcgtggcacccctgtgacagcaaccctgcacacgccgaggacacaccctgcggagcctgagcttacagttgtagaggctgctccacggccaaggaccctgtgcagctcttcctggggtctcactgctgtgaccaaggggtggctgtgtgccaggcttggagacgaggtgtccacaggcacagccacgaggctacacacagggcaagggggccaaagcgtggccagagtcaggggccagctcctctgtactttcacattctggcaaaaaacaaaaaaacaaacaaaataaaaaacaggaggaggccagaattctaggttccgcctctaaccttattgtcctattgggttcatttgctttaatttgggttcaattttgaggggttggttttttatttaatttttttttaattatggaagatgttagcatggttccaaagtcagacatactcagagagggctactcctgtctctgtcccatcccccattccctccctccctagaagtcatttttatctgctgctggtgtatccacgtttccttttccaaatataagcaagcagaatatgggttttagtctcccgccatttcttacataaaaggaagatactctgcgttgtttcgtgccttgtgcttttcctttggcagtgggtatcggaaacctccttccagccacggagctcttctccttcgccggtgcgtagcccctgactgcgtggagatcacagtttcctcaagcagcttctcctactagacgtttcctgcagtgacagcttgtgcctgcgtcactttgtatttctgccagtgaatctgttacctaatttttttttttttttagatggagcctcactctgtttttgtatttttagtacagacagggtttcaccatgttggccaggcttgtctcgaactcctgacctcaagtgattgcctcggcctcccaacgtgctgaggttactgtgagccaccacgcctggtcctcttacctaatatttggggatgataaattagcaacaaacaattcataggtacccaaattaaaacttgaaaagcttcctttttctaatgtatatgaatgtggtgttgtatctcttttccagaatactttcacagctgtggtatcatttaatctcacgccagccctgtgagatgtcacaggcgttcactgagcaaagcctgagttcaaaatgaggatttcttttggggaactagatactgtttttaaaagtattttgaaagattctctgttgtttggctagcgtctctattcagtggaaatcaaatgctaactttaatatttatttattaagtaatgaaattgaaaacctgggcctttggcatagtttgctgttacttttcatacacagcagttttaaaatttgtctttgtaatttgtcacgttgaagtgagtgaactagattttggaatcctctagctcaccattaacaagccctgttttcggtcacagtgtgaatgaccccgctttaggattttagagttaacctcactaagtgcagaaactgtaagacagggccgggcgctgtggctcacgcctgtaatcccagcactctgggaggctgaggtgggtggattacctgaggtcaggagttcgagaccagcctggttaacctggtgaaaccccgtctctactaaaaatacaaaagttagccgggtgtggtagtgcacgcctgtagtcccaactactctgtaggctgaggcaggagaattgcttgaacccaggaggcagaggttgcagtgagccaagatcacaccactgcactccagccggggcgacagggcgagactccatctcaaaaaaaaaaaaaaaaacaaaaaaaaaaaaaacaaaacaaaactgtgagatagctcctgaatgggcagatagggtttaaaattaaaaggccctctggccaggagctggaagttggtgtttgttttctttgtaaccactctctggtccttgatctgtccctacttagacgcttacatctgagaccaatccacggttaccttttcctctcactccccagtgggacccacacatgggctgtctttaatgcacaccctgtcagtctgtgacattgacaggcaggaactgaaccaagcatgtgggtagaaaggctccaattaggagcagaggacaagagggaaccagagtcagcccctcatgtactgatctcgagggtctggtcctgtgcagggttgaatgatctgaagctcttttctcgtggtcctaaattagctgaaggaagtgcgtgaggccagcaggggtctgtgaaggggcagcttgctgtgtgcagagacagaggtgacgggcgaggctgctgcagtgcctgcctgacggtgctgacggagttctgagcggcagcaagccgagcgtgtgtctttctcccaccggaggtgtgggtgacaggtgcttccagaaactgctgaaggctgcaggcctctgcagaaaggcggtctcctcatgggcgtgtgtcggcctaggtcctgcccagtgtcacgacatcacatctgcccggctgtgcccaatacaggtgcacaggccccatatcaacctgctgctgctgcttgaaacagacaacccctctttcactgccaccagcccctgctcaggttcatcccttctgttgctcgtgagaggacagacacattcgtgggacagttgaggcaggggacaggcccctgtcaggtgtgtgctcagtggccgctggccccagcctaatgaaattcatttcatttaatccgcaagtccaagtttgtgttaatcttgagtggtgtaggtttttcacaccaaggagagtcccgagagcccactttggatccactcgtgtttctagatcgtgtgaccgcagcagccgttgagaggactctgggctcgtcttggcaggcacagtgcctctttataaacccaccaagcggttaatttcatgtggacatctcagtttctgccacatgcattttctctaaagaaatgactgaattctcttagtgttgaaaatgcatgggattgtaaacctggcccttttaatgagctgctgctgtaagacttgaggagtccgtcgcaaacgatcgtcccgtgggctgcgtgcccaatcagcaggtgcattgtccagtctctgttggtgaaccgcagtgcaccaaacctcagggacagcaagagtgcggatgtgagtgacagcgttctggatcacacagggttgctctgtgtccccttcttccctcccctccagcccccattagagagcttgtggcacagtccctggcaccttacagttcagtggcagctttcccacggaccccctgggctgtttctcgagatgaggccgccctgacatgaaactagatttgactcctctcctccgccactcatgcaagatgaccgagagtcacagataagttttcctgcattccaagtagtgatacaaatgctgtgatgagttaaatgagccatcctcattcagtcatcgtggagaaagcagcagtgagtgtttgctgtgttgtgaagtgcagctgggggactgattgcagactcgaggggtgtttagactcacaccgagggaaacgtccctcctgttttctgcttcccatcgagcttgtcctgattgtgccctctgtggtgcttttccccttgcgtccgtactatctgggcggagcacgtgtgtccagggctttgtgtcctgtggtgataagagcactggctggggcatctgtgccactgtgactctccatgcctgacccagctagaaccctgcaggagaactgcctctgcttccttcgtgcctggtgccaccacctgcctagaaacgggcaagggtggcttgggctgtgagctgctgctactctcagctccctgggggagcccgtggccacaggagagggagggacagtatgctgatgcttcttgggcttgcgtggcacctcccgaggcccaggggagggcaggagagcaggaggaggcaggagagagaggcgctgaggaaggaacttgtcgtaaatcagggagtgagtgcacccaacggcttctcccagctgcttcctgtcagggtgtggaaggaggcatgatgtgcagaggaccggggggacttggcacagccacgggaaggcggctgccccaccggcctcacgctggcttcccacatcacgggggcttggcgaggaagggagagagcaggcacgagaggtcagtcgtgccgggcccttggggtacgttcaccctggcactcccgatgccttccctactgcagagctgggcctctgcctggggctctagagagccggtggtcacgaggtgcacgtgctcgccccgtcctgccacagaggaggaggatgtgtgctcgctcaacacaggcagtgctgggatggggagacgtgtgtttctgtcccctcaaacaaaacactcactttgaaaacatccagaggccttcgttctaaagtaggaaggtgggctcctccctgaaggagcttcctctctgctttctcccctcagtctgtctgggacagaggaggaagagatagactgagcaggtgctggccgcctttctccatcccttacaacgccacgagcttcagcgccatcacgtagtccattctgatggccttctctccttaaaattctcctgcgtcagctcgccacatgtgtatgaccttgcccctgtacatttccatgagaacacagaaagtgactgctcttcccacaagccctgatgtcagggcagcctggaagccttgaccccgcctgctggtgtctgtctttagagcagggttcaaagtggaatcttatagaaagtggtataattggtttttaatacgctacctttgaagggactcattgcgtgcctgttcatatgcgggctgctctgtggtcggtggttgcgctctcccggctcctcccgtgccccgtgtgtgcctcgcatttggcggctcagcgcttcctgaaacggggtcctgggtgattccgcagggcccttcgcactatggaacacgtctcagattgtatcgatgattggtccaggcaggagaagactggccatcattccaccacaacaatccaaatggaagattcccctgtgtttgctactataaatcaggtcataaaaatgtgggaaggaataatggactctttctagaaactggaagatgttttgctagatgctccttttcgtcaggatgttttgtctttaaggacaatgtcttgggtcccttaggccatcttcgacagaagcaagactgtacccaggagccaaaatctaaaatcctattctagcctgtcctttgctggccgcatggccaggagtgggccagccttcatgtctggaaagagagtcccccatcagaggggcctgcatcgcaccacacaccaaaacccagcagcgaaaattgaaaaacagccagaatttgaaccttggggttggagctaaagaacctgcattaaacattttctttaatggtagtttttttattttagaaaacacacggacactctctgcctttttcctttgctttcccattcacacggaggcgaaatgccactgctcttaccctgttcagttcttgtatttgccacatcaggattcctcagtccagactgagctgtgaatattcttccttcctgacagggggagtcggtgaagtacttcctggacaacttggaccggatcggccagctggtgagtaagcacgcccgcccgaagaagctgggctccagggttagaaaacgtgtccagagaccaaagcagtccacgttgtgaggactttggctggactgacaggccgagcttgttctgtcacattaccacgaatagtactgtaatggcacgctctcacttggatctgggccccgtctcagtggggaggggaggaaactgcctttgcccagatcaccataaaggagacagacagaggagttcatgagtgaaaggaggacttcctttatctcatggaaaattcaaacatactcaaaaacaaatagtctaatgaaaccccaggcatggcagttatcactgattaccagtcttgtttcagcagccctcccccggcctccgggagcaaatgcagagaatattttagagtgtacctcaaaaagacaagacgaaaaatgacaaccgcagtaccgtatggctcctgaaaaattggcagtaattccgtaatgtcaacctagtcagtttagagattttccctgttgtctcattaatgttttcatgttgattttgctttgttttagcagagtttgaatcaacaacctaataaggtcatgcattgccattggtcaggatcacttaagtgttaatctgtatgtctctcctttttttctttcaacttgtttattggagtaactggattatttatcctgtagggtttcttaccatgtggactttgctcttccacccctgcagtgttattgaagatgtttctctgtcccctgcacaccccgtgggtggtagtcagacctctagatcgaggcatgatcatgtccgtgtttggtgttttggcaagaagctgcctgagtggtgtgtgcactcatcacgggaggtgttttgttggttttttgttctgttttgtttttcgattttttgagacagggtctcactctgtcacccaggctggagtacagtggcacgatcgtaactcattgtagcctcaacctcctaggttcaaatgatcctcctgtctcggcctcccaagtagctgggactatagcatgaggcaccacgcccagctaatgtttttacttcttgtaaatatggggttttactatgttgcccaggctgttcttgaacttctgggctcaaggtattcctcccacttcccaaagcaccaggattataggtgtgagccaccgtgcctggcctggaggattattaatagtgcaaagtcaaagtgagtgaagagtatgcttgcctgtgtgtcgctaaagacttaaagaattgtctaagaataacattaaatgtattgcagattgaatttacatcacattcaaaacctaaattaattcacagtaaggttttggaagctataagctttaggagttagaaaaataaaaaggtatctctggtatggaaacaaaaaagatggtaaatttcctctggagaagaaaatggatgtggttttgcgctgggcctgcccacgagtgttctgagcattcgtcctcagactggtgagcctccgttcgttttgaaatgaagtatttgattctttctgtttcacggccagttgataatgttataaatgaaatttgcttttggtttctggttcaacctgttgcaaaagtcagtctctttccttcttatctttttgccatctttttgtttctattttctctgttctttcttcctccccctaaatttctgcctcatcctgtattttacagaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataagatctgttcctcatagctatactgtgtacacataagacgcatatagggttttactgaaatctatttttaactcttatgttcgtagagaaattgtttcaaggattttgagtcataggtctgtaatttatagagatctctagaattcttattgtaattttcctacttctttgataaaagaaaaataagtcagattgttaactccaagattgaaaaaaaaaactcttgaaagaagattattagttgtaactaatttaggggttctgggcacagacatctaacctggtattgtaaggcagaggctcccattggaatggtagtggtccgggtcagttgttcatggtgtaagctttgcacagtgtattaacattgggagggtctggcttgaaaatttggccaccctcagcctctgaatgtttattaaaataaatttagtctttctttgcttaatataaa

SEQ ID NO: 38701 - DNA, 20755 bp, Homo sapiens
gcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccaggtagcggggccgggttacaggggccgcggccggggccgaggcgcggggtctgggttgaggtcctggggctggaacgcagagcccggggtcgcggaggccgggcccaggcgggaccggggtctcggggccggggtcgcacgtgaccgcgcgtcggggccggcggagctcgcggcccgttggagaccagttctctggtgaataactttgtgtttccctcttcccccgggttgtgtgtaccccacgtcccggcctgcggcggtgcagagaacaaaaggacaagataataaaggtgagcggagtcccgggacggccggcgcgggctggagtggaggaggacggggaaggaacggtccaggaagctgcgtctggaaccggaaactttctctcttccgccagcttcagggagataaaacttgaggttgtgcgacgattctgggagatttgacaggtcgaagacaggggcttctcaagaagtgaataaatgattgctcagagtagtttgggcccgtctctccccaccgcatgatcatggatttgctttggggaaggggaggtaggagagccgggtggacatggccgcaggggttgagcgacttgcctttttccgcccagcaggggctgctctaggagaggggcagtccaaggttctgcaggctaagctccacatccccggtagttgcagcccgttttccaagtctgttagcatctcctgtgacattatggcttgggataaaccctcagagcgcactcatgtgaaaactgttaagtgacacttcacgtttacttggaacacttttttagccagtttgtgtgtcagctcaggtgtaaccaaatacggttcatcgtgttttaagattggaaaaggcccagcactttatttacctttgcttgctttttctggctgagcataataacagtgggaaggtaagtggtgtaaaaggaaaaccagtcttggggcacccaaatcactgagccaaagggagaaagctacgctgagaactgctgagggcaaacctgcctcccattctattcctgaaaaagatagcttctaagacaaaaaaagttacatacttcccccacagtttgcccacaaggaaattcctggtggacaaaggacagaactcagagtcattcctgctcactgagataaatgcttatctgattgcttcctttggaaaggctaatcagaaactcgaaagaatgcagccgtttgtctcttatctacctatgacctggaagccccctccctgcttcaagttgtcccgcctctccggaccaaaccaatgtacatcttacattgatggttctcatgtctccctaaaatgtataaaactaagctgtcccccgactaccttgggcacatgttgtcaagacctcctgaggttgtatcatgggtgtgtccttaaccttggcaaaataaattttctaaattaactgagacctgtctcagatatttggggttcactgtggagagtcagataatagctcccaacagtccttcagttgcagccccttccctcctaagttttcttccctccgttctccatacgtttgggcatacattctgcatttgggcttttggaggctccacttctttttgccacacataagtcttcttagaccatgtcagttttcaccctggttatgtgttccttgcattatgtgttaacacttgatttggttaatctcaccaaattacgattaagcctttatttaaaatttatcctaaattattgaaagtttcccgtcccccttctaattagttgtataaacatcagttctatactggttgtactccttttaaaattaaagcataatttctgctagaaatagatggaaatagactttgctaactttgccttccaagcttaaaagtaatcttttaaaatttgagggtaatattttgcaactttttgttctagtacaaaatggttcgttacatcagaaggatacagttcatgacaatgactttgagccctaccttactggacagtcaaatcaggtgagtttattttgttagcatatatttgtttttaagttggttttaattgttttgtacctttactgtcatttctgatttttaaattatcctaaacaacaaagcagcagactataaagtattaggaatgatagactgctcatgaagatgtgactcctgttaaccttgggcatcagtggggtgaaaatgattttccctgtggaggaggcggcatcccactggggctgggatgcaaacaggtctagttggctctagtgtttgtgggtcagtggtgtgtcttgcctttgacgcagtggaggtgtgtgtgtgtttctgaagcttcctggttattcttagctctggatgattggaattgtggtctggggaggcagctaagagctgggctgtggagcgactgtggagccagaggccgcctgggtttcagtcctttttttgagacagcgtctcactcttgccacccaggctggagcgcaatggcgtgatctcagcctgctgcagcctctgcctcccgggttcaagcattcctcctgcctcagcctcgggagtagctggaattgcaggcacccactaccacgtctagctaatttttgtatttttagtagagacggggtttcaccatgttggccaggctggtctcaaactcctgacctcaggtgatccacccgcctcggcctcccagagtgctgggattataggcgtgaggcaccgcgcccagcctggtttcaattttaactccaccactgactggcctgtgtccatggcttgccttctcttgcctcaatttccttttctgtagaagagagagagtagtaactgtttgtagaattgttgggaggatgacatcagatggtgcacataaagcgctgagacagtacctgatacagcagggcccagtgagtcatagctgccctgttttcttaggtaattcaggctttctctgccttggcactgtggacattttgcacgggaacattctgttttgggggctgtcctgtgcattgttggatgtttagcagcctccctggcttcccacccactagatgccattagcaactccttctccccatccccagttgtagcaagcaaaactgtcttggtggatgttttttgggggatacagttgccctggttaaaatctactgggagctgctctctctcctctgtgctgctgttgcagcaaaactcccaagagaagcggtatctgtttatgtctaagagtccaactcgggaatcagacttcccctgcctcactttcctacctccaggccgttggcttggatgaggggctgcacctctgtgagctcctcactttggtgagcaggcctcatggggcagcacaaagcagatgctctgagtgctccatttcgtgtgctgtgattcacattccttcctccgccactccaagtagccctcagctactgggcatgtttactttaaagtaaaaccaggcttcacctcttctctgtgaaggaataaaactagtctgcccttttctgaggtgtcttagaacttcttagaatgttccttcatccccctccctcctactgcacttggcgaatcaagcagcttagagaccaagaaaccttgtacaggtggagcctcggcagcgctgccccgcgctccgaccctgcttctgtttcttgtctcttggttgccttctgagaatctgcccttcctctgggcagaactgacttgactttagtgatgggcctttggatagaggtaatggcaggaagttaactaattttttgaatttcttgttttctagtgtgttcttattattttagtactttaatggtattatgtactgaattttagccaataaagggggagggaggttgcatcagtacacttaaaagtgtgtgtgtgtgtgtgtgtgtgtgtgtgtgtgtgtgtgtgtgtgtgtattttggagacagggtcctgctgttacccaagctagagttcaggggcatgattatagctcactgtagcctcaaattcctgggcttaagcaatcctcctgcctcagcctcctgaatagctgggactacaggcatgcaccactacacctggtgattgattgattggttggttgtagacacagggtctctttgtgttgctcaggctagtcttgaacttctgggctcaagtgatcttcctgctttggcctcccaaagtgctaggattacaggtatgagccactgtgcccagccaaaaatatttttataaagtcggagcttttgtgttgtttgggaggatttctttacaaatcgattatttttatgtcagtgggtgtcttagctccatatgtagagtatacagtatggttttataacttttgatttacacagacatacctttggagccatggccacagttaagatagtgggcatatcaatagctctgggtccttttttgttggagacagggtctcactccattgcccaggctggagtgcatgatgtgatcatggctcactgcagcctcgacttcccaggctcaggtgattctcccacctcaacctcccaagtagctaggactacaggcatgtgccaccacgcccagctaatttttaaatttttagtagacatgaaatattgctgtgttgcccaggctggtcttgaactcatgggctcaagcaatccacacgcatcagcctcccaaagtgctaggattataggcatgagccactagtgcccaacctaaccctgggtacttaaaagagaaaaatctagatatggtttgtagtagccagttggaggctaccgtgttttgtgtgaaactgtcatacttagaatggtttagaaagtcttaggagaatgcctgcctgttaggttggtttaacttgtaatgggctgtgaggggttgttgccgtgtggtgggggtccttccctcagagaggcctcacccgccttgctgtgcttctggtgctagagtttcagtcctagttgcccctgaggcgcttgcgactgtagccgctcagtatctgtcttctagtctgtgacttgaatgggagttgggggagcagaggaactgggagtgaagggctctgggttgggcttgattgttgtgattttctctctttttttgttttttgagatggagtttcgctcttgttgcccaggatggagtgcagtggcgcgatctcagctcactgcagcctccacctccctggctcaagtgattctcctgcctcagcctcccgagtagctgggattacaggcacgcgccaccacgcctggctaattttttttggtatttttagtagggacggggtttctccatgttggtcaggctggtctcgaactcccgacctctggtgatccccctgcctcagcctcccacagtgctgggattacaagcatgagccacagtgccccgccgattctctcttttgaggcttttcctgctcggggacttctggtttcccagttctctgttgttttctgaaaggaaagactgtgaaatgacccagaacagttcctactcagagtttagaagacactgtcttggcatgatgcctgagttgggaatagatgccgctggccccccaggcttcctgcacactccctgaccaacagactgagtgtgtttgctgtgatcccactgacagaaattaccaaggccatctgggcatgcctgtacctgtgctgccggatgcagtttggtcagcaacagaccacaatatgatagtggtcccataagactatgatggtgctgaaaaattcctggcacctggtgacgttggagctaccatgttgagggcagtgtattactcgtgtctgtggtgctgcagtaggtgtgaccaaacctactgccccagtcataccagagtatacacctacagttacgtacagtaccatacagtacgtaataattgatgataaacgactgttactactttgtgtatttgctatacttttaagagcatattctgcctacttactagaaacaaagtcaactgtaaagcagcctcaggcaggttcttcaggaggaatccagaagaaggcaattggtgtgacaggagatgacagctccatgtgtgttgttgcccctgaataccttccagtggggcaagatgtggaggtggaagatccagaccctgtgtaggcctaggctaatatgtgttttttgtgtctttttgggtttttggtttttttgttttgttttgttttgaggcagggtctctccctcacctgggcggaagtgcagtcatgactcattgcagccttgacctcctgggcccaagtgatcttcctgccttatttttgattttttgtagagatggggtctcactgtgttgcctgggctgttctcgaaatcctgggctgaagcagtcctcctgcctcggcctcccagagggctgggattataggcatgagccactgtgcctggccgtgtcttcatttataacaaaaaagttcaaaaagttaaaaaaaatttaatagaaaaaagcttatggaataaggatataacaaaaaaaatttttgtacagctatatgatatatttgtgtttacaaaagagtcaaaaaccttaaagcttttaaaaaagtagtttgtaaagtaaaaaagccatagtaggctagggtttattattgaagaaaggaaaatttaaaaattgagtgtagtgttaagtggacggtgtttctaaaggtgacagtggtgtccagtgagggcccaggccttcacattctctccctgactcacccagtgcaactcaggcctacctgctccattcaccgtaagtgctctgtacaggtgtcccgttcttgatttcttataccgtatttttactgtaccttttctgtgtttagataatgtttagacacacagatacttatcattgatgtacagttacttccattattcagtacagttacacactgtacaggttacggcctcagtgtgtggtaaggatactgcctccatgctcacacgtctctgtttgtgtgaggacactgatcacacagtgacgaaattgctcatcaggttttgggtggttttttttcactgaacacaatgcctcatcagagcatctaggacttctttgagaacagcctggagatgcttggcacagggcttcctgctgtgcctgggcagctctggtgggcccggggtgacctgagggccagcaggggagtgtcagtttcttgtggctgcatctaaaaatatgggcttccttaaaatacccagtggcagcgcctgctaagtaggcatttgccatcacaacggcttcccagaaacgcagctggaaggacatagtgggatcttaacgtgcttcttactggcaagttgctgaaacaaatgcagaaattctgtcagaaactgctgtctctgcatattgatgccaccagctgaggggctgaaattgcagcctcagagggaccagtcctgaaaacagatctgaaaagtgagcagccaagtaagtaaattagggtttttcggttattttcctctaacattttctctgtgctccctaaggcttctcctgaagaacaggtcatcctggtaggcctgttcccagtcctgggtcagagctgcttcccaggagccatatcactccctcacttttcagcagtacccttaatacttttccattttacataattaattattttgttttgtttgtttgtttttattaagcaaatgcttctctctgttcctcttgggcttctgaagggatcctttctgcttctccctctagtctctccttttggtcattccaactccatctcagaaaaatggatataggaagtaaacttaaccattgaacttcaacttaaatggttctggtcattcggatggaagtttcttttttttaatgtggttaaatttgagtaaatatgtaaaactgctcttagttcttttttgtttgtttttgtttttttttttttgagacggagtctcactctgtcacccaggctggagtgcagtggcgtgatcttggctcatggcagccttcacctcccaggttcaagcgattctcctgcctcaggctccggagtagctgggactacaggtgcctgccaccatacccggtttagtagagacggggtttaaccatattgatcagactagtctcgaactcctgaccttgtgattcacctgcctcggcctcccaaagtgctgggattacaggccagagccactgtgcccggctaaaaatgtgttagcctttcttcgatgaggtcgtcagttctccgcaggggctgcagtgaggcgcctagcatgtggaagtgttcagcagtcttctgtggaggcggctgcagagtaacaggatcatggttttgcttgtattgtccttaaaagatctgtttatgccactcatttacgaggaccaaaatatgcttgctcagaggtagtaatgtgttaagaacaagctttgaatttgttcttttttttggaggggggtgggggggacagagtcttgctctgtcacccaggctggagtgcagtggctcgatctcggctcactgcaagctccgcctcccgggttcacgccattctcctgcctcagcctcctgagtagctgggactacaggcacccaccaccacgcccggctaattttttgtgtttttagtagagaggggggttttacagtgttagccaggatggtcttgatctcctgaccttgtgatccgtccacctcagcctcccaaagtgctgggattacaggcatgagtcaccgtgcccggggttaatgcagctgtatccctgagaagtaaactttcacactcataactcagtgcccatggagccgtggcactaaggaatgttgagggagcagcacagctcgcctccagcacttggcagcgagtgagcgctgaacctgtgcctggctgtgcgggagacaaagggagatcaaaggccctgaaaggaggctgcatgtgttttccaggcagcccgaactgtgcgtttccagttgtctcccacgcactgtgaccaggactgtgaatgggacagcttccctcaccagggaaggagtgtggggcagcagcctgacatgtggctcataaagaaggcagaggacagcatctccaggttttcttatgtacagaatgactgacttcacatagctttacaaattaacctgcttctttaccttcagagttttggaggaaagatggcagatgtaataggaaatgggctgtcagtgagattgaggtaaaaatggaaatccggcccacagaaccccaggtcactgtatccagcctgcctgtgtggccgtggaacccggtgagcacagaaagtatcaggagggtttagggctgccagcagagctgattagcgtcaccgtcttctgtggctcaggatgtgaatggtggtgatctggagctgaaggatttgcagagtactggctagaactgcaggccctgcaccttgggtagagggaagctggatgggtcatttatgggctctctgtctgtgcagcgtgtgtgctaggtgtgtccatttaatacttaaaacggattttcaggaatgttacatgcctcatgtaatgtggattttttcatgtggtaagtgatgtcctgtcttagttaaggctttaggtgtaagtcagaagtgtccctgggcatctgtttctgtggcctgactcctctggttggtgttggggccaagtggattagaataccacacagccatcgaggtctttttttcccatctgctctttttgcgtggaaggaagatgtgttgtgattgcagcgctgctgaggagcacgtgtccagctaatgggaggaggagggctggcttccctgtgggggggactgtccccttgcctgccgtccttgaaggcacctgcggccagtgactcgaggagcaagtcctgtgcacagaccgcccccctgattcgctcacccccccagtctgggcctgttggccagggcagcacccgagggaaaggctgcagcaaaggagccagcatcatggaaactgttttgagggagaataagctcagattaatctcatgtttgtggaacactgatagcatcccacttgtcttcttatacccccagaatctcaaatttatattacggggaaacagcagttagtgcattttaaaagatgattctggggccaggcgctgtggctcatgcctgtaattccagcactttgggaggccgaggcgggtggatcacctgaggttgggagttcgagaccagcctggcaaagatgatgaaatcctgtctctactaaaaatacaaaaattaaccgggtgtggtggtgggtgtctgtaatcccagctacttgggaggctgaggcatgagaatcgcttgaacctgggaggcggaggttgcagtgagctgagatcgtgccactgcactgcagcctgggcgacaaagtgagacttcgtcccaaaaaaaaaaggggggggttctggaattgtctgctcacaagtggagaagtcaacaggaagaaaattagaaaataaattggatttctgaagccctcagtattctaggatgggagcaggaggcaggaagtggtggccgggtcattggttcattagtccaccagtgttggctggtgttggggcactgcccccagggagagctgcttgtggtcacccctccagtgaagcaggcctgtttcattgtctgggatcccacagtctccctcattgcctcagctactttcccacctggtgtccccgactgggtgctgttatccttcatagtgtagcctttgatgccaacatgaaaggtcaatgtggcagggatgaggttgtgagatgaggtctggagcatattctctttatgtagaaccttctggttacttgggggactggggggcggggagcgggaaaactaaaaatccaaaaacgggcgtcacagactggagagccccgtgttttacttccggctctgttttctgtaatagcatcttggcactctcagacgatgcgtctaggtgggagccttcttacctcacactggaccccgtctcaccggcctgtgtacaggtgtgtgtgcgcacacacatacagacacacctcacacgaaagtcattttaaggcagtgttggagggacccaatcatgaccagacccttagttgagtctctccaaggagatgccgtcccagaactgctgaccctcagtctaaatttgtgccctgggcagctcttcagagacccctacgatggggcactcaggcactcaccttctctagcagacctttttgcctcatggttccgtcactttaaaaccactctctgaggttccagtcactacacagacatgttttcataaggaagcccaggtgagttggcatccagagtgagggctgctctgcacccggagcacagagtccacacttcggatgctttctcttggctgaggagctggagccagccagggccctctgtgcaggggcctactgcaagagcccaacgctgtgcccaggaaatcatgggaatgtgaacccccttggacttagaggcaggggccatctgctaggaagggtgtgtggaaggagcctctgaagcacccttgaaggattctgggagagctttggtccaggtatgggagagtgtcccaggaggaatgtcaaggcccagaggtgggcgcccagggcctgctgagtaatcagcgagcttggggtctgttctctggagcaaactgcctcacggccctgcacatcctggtttgccaatggaaatatctctgccttacaaagctgtttcagttcccatgatgccgtccgtgtctgtcataagcgttgtcgtcagcaggcaggggtttactcctctacctctggattcctttgcaggtaagagtagagggggctgctaccttgccagttctagagaggcatagcttcgtcatttagcctgaattcagagccttgccaatgatgcttcgtattttgagacggcaccctggtttgtgttcgttattaatttctctgtcttgatttggttctcacattggcgactacagctttctttctggaaggagtagccccatgctgtgcaggttttgtttttgctccacctgtgcttaagcaagaggcggttggcattctcagcatctcgtgttgtagaagtggtgtaacttgtcacgtttgcttttgcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgccgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggtgaggctgggtgttgcaggcaactgccatgcagatgtgtccttggtgccgtacttagaccaggtggcccggtggtgagcagatgcggcaggtccgccgagctgagtctcgtgacaggcagctcccagttggccgcaggtgggcgggcccaggtcctggcagcctcgtgggctttccctgcggagagtactgctagtaaccagtgatggtatttgggtagatgtcaccgaacgactttgatcactttccaattataattgaataattgggaccacagtgtacacattctgtttttctgttacaaagaatttgagggtaactttctcctctcctttttgaattgtgatactttctggaacagtgcttcccagcctccgtccatgaggaacacttaggtgatattcacgaagcactgcggtgggcacgtagggcatcgagaccccacctggccaagggcccttgcttcccagggcactgtccctcagtagttgggaatctctggtctttgatctggaggtcgttgctttatttttcttttaaaaacccagtatcctgcagtttttggaaacaaactcactccatctaggtcgtaaagaaaatggtggtggtggggtaggtttggaatccagacattttataatgacaaatatggatcctatatcaaaaattcattgactgggcctttttgagacagtcctgatttcctgggatacttgtagccaaactcctgagtctgtgctgtcatgtgatgtctgacgggattgagtgtgtttgctcttcagaagggctcagatgcccgtaaactggcaccagcaatgggaaaatgatgatgctgacatacttcataatgcttcctttattcgagagagttcatcctgagattctctcctgctttttaaaaaatatcccttcctgaaatgtcagttgataatagatgggttttcagtgtttttttcagttctctatgttaaaggaattattcacctgtgagcaccaagtgtcctaatgtattttgggcagaaaggcgtgtacatggcatatatagggatgtatagagtagagccgcctgcactgtctgcagtcttacattatgcaagtcctgaacaacttggggcttgtagaactttggaaaagtatcagtccctctcttttgtgagaaaagaagtggatgtcatttatttccagttactgaattctgaattagttactgaaattctgtgttttaggtcttttttttttttttaaatggagttttgctctgttgcccaggctggagtgcagtggcgcaatctcggctcactgcaacctccacctcctgggttcgagtgattgtcctgccttagccttccaggtagctgggattacagacaatagctcggattacagacttttaggtataaaatgaatactgaattgctaaagttgcagggataattgctaatgaagctttaggtccttagctggctaaactggaagctggctgtgtgtgtgtgcgcgcacagtttttcttcttaaataccgtaatacttgggttttcataaagtgtgcggactcctgacctggttggtgtttttaaaactctagtgtcctacaacttgcattataaaaacttgatctagataactgcttttgtgtgtcgggttatgggttaagcatcttggtaagcggcctgcagggtctgtgggcatctgcctgcaggcaagatccaagtgttcctcaaaccactgggtgctccaaggcgagtccaacagagccgctggtggagcatcattggaaggaacttggtaaccctcccctaaactgttagccaagctggagaactctgggcccatatgggtcagtgttaacattaattcattttattgaaagtgacaaatgagaacctggtttgttaatgtttggtggaatttcaaatagcttttttttttttgagccaatctcaccgtcagccaggctggagtgcagtagtgcaattttggctcactgcaacctcaacctccgaggttcaggccattttcctgcctcagcctcccaagtagctgggatcataggcgcccaccactgcacccagctaaattttgtatttttagtagagatagggtttcaccatgttggccaggctggtctcgatctcttgacctcaagtgatctgcccacctcagcctcccaaagtgctgggattacaggtgtgagccaccgtgccccgcctcaaatagctttttgtttttgtttttgagacaggtctttctccgtctgccgggctggagtgcagtgacttaatcacagcttgttgtagccttgacctcctgggctcaagcggtcttcctgcctcagcctcctgagtagctacaggcgtgcaccaccacgcctggctaatttttgtatttttttgtagaatcagtgtcttgctatgttgcccaggctggtcttgaactcctgggctcaaacagtcttcccaccttggcttcacaaagtgctgggattataggaatgagccactgtgcccggcgtcaaatatcttttaagcttattgggcagtgtagagaaatggaagtggtccttgaggaggtccccagactggacttcgctgctggctctccctgcctgcgaaggtgctctaggccttgtgcttaacgggctgggctagtggctcatccaggattggagtcttaggtgtcttgaggctgagactctgggtgtctaatgctttctccctctgggtttcccatgaagagtcagtgcagttttgttttgttttttttttttttaagacagaatcttgcactgttgcccagtctggagtgtagtggtgtgatctcggctcactgcaagctctgcctcctgggttcacacaattctcctgcctcagcctcccgggtagctgggactacaggcccttgccaccacgcccagcgaattttttgtgcttttagtagagatggggtttcaccgtgttagccaggatggtctcgatctcctgacctcgtgatccgcccgctttggcctcccaaagtgctgggattacaggcgtgagccactgcgcccggccgagtcagtgcagttttaagaacaaagtagtgtgccgaggagagggttgtgcgcctgtgctggtagagcccccgggcggttttctcaaggttctctcaggacttcgaagaacagacccaccttttctttatcatttagagtttggccccattgctgtaaaggtcataaacaagttgagtgttgagaaagtgaagtagagttagcattttgcaagattgctgtccagctataaatttagaaacatactgatttcttaggatggcagtagcttttatggcagcagagtcagaccaagtcctgggttgatacattttttggttttaaaaaaacctagaaacggccacttcttagcttaaaacagtgaaagtggtgagcgtcccacactgtgagcattgcttagttcctcagactgactgtccttgccctggcggcaggtgcccctgacctgaccccacttcgacctccaggccggctcagcagagtggctctttgactttggaaattaagaaagagcatagagaatcttaggccataagcatttcctggatgcttgttgagcattcctcaaaagaacgagctgtgcttcgtcattttttttttttttgagaaattttatgaggaatagtattttttaaagagcacatagtaaactttgtagctgtttataagggctgaagggagatggggatctggggagtttacctgtgagtggctttaacatcagctatttgaactcaagagattggtatttgctttttaggaacagcagtacctcttttgttaagagattgattgattgagagtttcgctgtctcccccaggctggagtgaagtggcacaatctcagctcactgcaacctctgcgtcctaggttcaagtaattcttgtgcctcagccttcagagtggctgggattacaggcgccggtcaccatgccctgccaaattttttttttttttttgtatttttagtagaggtggggttttaccatgttgaccaagctggtctcaaattcctgagctcaggcaatccacccaccttggcctcccaaagtgctaggattacaggcatgagccaccacacccagcctgggaagagattttttttaacggagaatgtttaagagaatgtaaaatacagagttcttaatttttccagttttacatttgagggtagggaggaaatgttaattcttaagagtaggacctgcctatccaggtccttaatccaaatactctggagccttctcgggacagggaacaccacatctgcttctgagagcagccacagttgaggaggctggtgtttattccagtgcccagcaaagtttattattaaccggaagacacattcagtccatttttagcaaaagaggaggtttcaggttaaatgtttgggtgtcctgcccgctggttttctttattagtttgcatcttgatagatggccagatgagggtggatgtgcctgggatgcatctttttgttttgtttttatttcgagatagggtctctctctgttgcccaggctggagtgcagggcagataatagctcactgcagccgaaaactcatgggctcaagcgatcctctcgcctcagcctcccgaatagctgggattacagggtgcgccaccacactcggcctgggacacctctctagcagagtggtgcagcgtgtgctccttagatcgcacattttcatctttgtatgctgccttgtaaggagactgaaggggcttctagaccctgctactcagggaggccagtgtgggaaaagattcgggtgtaagtctcaagcttgtgtgtcacatacactctggaaaagatgattctcttacgggagtgggcagcaaacctggtcagaggagctttgccttgagccagtctagccgtgggggagtggggaggggcatgctcttccccttggcgtgggagtgagctggggagtgggaagggcctgaactggacaggcccacaccggtcctcctgcccttcattagccacatgacacagcaccttgttagccagttggaaggattttggtgtcctttgtgccactgagaagtttaaatgagataaaatacagaagaacagcttctgtctccctggcctccttgagagcctggtgcgtgccagctcctccctctgagtgcagagaatttcacattgctaagtgtctttccatgtggaatgatagtggcacatgagggaaagacagctgtgggaagtgaggcttcccagcagacaggtggcccatgtgaccgttgtggttgatgcttttctcctggtagagggggtggggagaatgccatgcccagtgtggccagtcccccacagagcaggccccagtgcagctcagagttgtgtgctggtgtggcttgggtaccattcagggtcccgcctccagatttgcaggtgctgctaaggggcagcctcggatctcacttttgggagggattcattggtgtggttactctgcgttcaacttttgttttttctttttacaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagc

SEQ ID NO: 38702 - DNA, 98165 bp, Homo sapiens
catgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctggtgaggatggatcctcgtgcccactgtcctgtgccctctatgcttccatctgctcaccacctctacatgactggtatccctgccaccagcccctgtgccagcatgccctcttctctttgtttatctgcctttcccctcaggcagctctcgtgcctgagtcttcaatcactctccagcccagctctcctctaaggagtgtgctgcagctggaatgtagcatctggaactctgtgtgtgcatgtgtgtgctggccaggagaagagagtaccaataagagttcaggttattgagcgcttgctactagccaggccctgttccaactgctttccacgcacttaacctttgcagcagccctagcaagcaggcacttgccagagcacagagaggtggggttatttgcctaaggttgcagggtcaggaagtggcagagctggcacagggtcggtgcctctgagaagtctgagggcagagtcttggcaacatgtgtcttaagggaccctgggttgctggcacctggctcggcctggcccagaggagtcaccttggcacacgggagagaggtgctggcggtggtctccactaacgcagaaaggctgatccgtccttggccccagaggagggctcaggtccattttagagggaggtgcctgtggactggacccacagatctgatctgtacaacctcaggtggctgtccccagggtgtttgaggtgggatgtaggaggctgcattagtttcccagggccactgtagcaaatgaggtggccctttctatccatgggtttcacctctttggactcaatccatcatgagttgaaaatattcagaaaaaacccaacagtaaataacaataaaaaacaatacaaataaaaacaatacagcagaacaactatttgcagagcgtttatattgtattaggtattacaagtaacctagagatgatttaaagtctacggaagtatatgcataagttatatgcaaatagtacattttttatatgcaagttatatgtaaatagtacatattttatgtaagagacctgagcacccatggattttggtatccactatccatggcggggtggaggggtcctagatccaaatcctccatagacaccaagtgatgactctacctcaaatctggtggctcaaaataacagaaatttattctctcacagttctgaaggctggaaatctgaaatcaaggtgttgacggggccatgctccctctgaatcctatggcagagaatcccttcttgccttttcctagcttgcggtgggattccttggtttgtagcgcatcactccaatctctacctccatctccacgtggccttcttcagtgtctctctgtgtgtcttctcttcctacaaggacatcaattattggacttagggtccaccctagatccaggttgatgtcatattgagatccttaactacttacactggcaaaggcactatttccaaataaggttgtattctgaagttctgggtggacatgacgttttgaggatactattcaaccactatagagacccacctgttagctgcattggggcattgttaagagcttggctttaaacctcagaaagtcctgggttcaaattctggctctgcctttactaactacatgatcttagctgtttagcctcactaagccctagcttctgtgtccgtaaagtgggtctgaggtctacctcttattgttgttgagagaattaagccagctgttagatgtaaagtccttaagacaggctgacaggtggcagacattcattgagtgatggctattgtaccataataaagtgtattcctttacagagtgcaagagtggatgcaaatccacctatttctgattttaggagtccagggttctatgggacttggtgccctgccacccctctctctatcctgcctattccagactgggctgtccccttttctccccaggagatgacacagtgcctttgagtttcctaggcagtggggtggaggtgggaagttctgcatgcccccctcggaggtagaggcaggaattccagagactggagaattccttaggattccagtggtcaggaatgggaccccagtggtcaggcgttgaaaggcatgtgctgggagaggtatgtcaagggtctgattgggcccacccaggatggtttgcccctctgatggaggaagtctggtgacagagaggttgcaacctcatgggatgaggttctagggtcaaggtatgaagtggaaaccagagattgccaactacttatcatctcacacagctggattcccgttcggtgtggtgagaggcaagcggaactggagacaagttccatccccttctcgtcttccattcgggacatccgctcacggaacagggtggctgagtgtctacatctctctctctctcccttttcatcctgaggacctacagttgagttcctcttcgtgacggtgtgtctgctgggactcacctgcatgttcacgtatggatagaattcctatcggggagagagagcgagagcaggcacaggaggtccagggagctcatggctgttccgtggccaggcccctggccgtgagaggacattgacgctctgctggatgctgtcgtgggctcttcagaggaagttggcaatgatgccacggtcctttctgggaccagcaggccatggttctctctctcctcgccgccctcctcaccctcacctcctcatgctctcttccttttgctccttctagctgttcaacctctctgagcggagacctgacatcacgaagctccatgccaaggtgagccaggggctgttttggggtaggggaggagaaggagaacagatggactccctctctggagttcccacataataatcttggggaaaatgctgtgacagtttgtcagagtgccgacttatatctggaaaatggaaaatgatctacttatcatttccacaatgccaattacagaaagcaaagcttggggcagtgactttccacccaggtctgcctgctggggagtacacagaatcacttgggtgaggctggagttgtgagatgtttagtttttggatttaaagcagttgggagccgctgctttcgaccttccagctgccggtttttttgtttgtttgtttgtttttttgagatgcagtccccctctgtcgcccaggctggagtgcagtggcgtgatctcagctcactacaacctccacttcctgggttcaagtgattctcctgcctcagccttccgagtagctgggactacaggcacgtgctaccatgcctggctaatttttgtatttttagtagagatggggtttcgccgtgttggccagcctggtttcaaactcctggcctcaagtgatctgcccaccttggcctcccaaagtgctgggattacaggcatgggccagcgcgtctggacctgttgctgctttttattctgtttgctcgggggctgtgtgtgggctttgccatgggcatctgctcctagctctgagagtttggtacatgctgttgtgtgatcctgggtgggtgatggacttctctgggcctcagtgtgcccctctgaaagtggcctggctggattaggtgtgctctatgggtccttgcagagttctcttttactttaaagttggtgagtctagaaagattttgagaggcccgaagcctgctgttcaggtctgccctttgtgtccttaaggctgctcttggctggcctggaaagtggatggtttgtgtgaccagggcctagaaaagagtcatgaacatcaggcagccttttgctttttcctctcgcagcctgagccaggcctcagggctgtccgtaggagaagagcttgaggacagtgcttggggcccctcagcatgttggaggtcagtcctatggtagggaccttggggtcatcagctccaagcctttctttttgtttgtttttttaacacacatatggggaaattgaggctggaagaggacctgaggcctaaggccccacagtgagtcagtgccagggccaagacccgggaccagggtccccagtactgggtcatgcatggcctttgcccttcactcccctgcctcctcgctggccagtgggcagggaggaaccaagtcctggcaggaaccagcagctgcgggccactgcccaggtactggcacgtggcgtaggtggctcccgctggcttgtttggctctgcagggcttctgccctcttctcactcatggcttgggccacaggtactggaatttggctggcccgacctccacaccccagccctggagaagatctgcagcatctgtaaggccatggacacatggctcaatgcagaccctcacaatgtcgttgttctacacaacaaggtcagagctgtgtgtgtgtgtgtgtgtgtgtgtgtgtgcgcgcgcgcacatgcgcacatgtgtgtgtgcctgaatgtgtccttggatgattgtgtgtacctgcctatatctttggattttgcgagcatataagtctgtgtgtatttttctttctaggggataataggttctgtcttgggcggcacttctaagaagtgtaggggacatcagcttatgtccacggcagtggatgatcagctgtgttttttctgagacttagtccccacctgcctccctcccctgaggcccccttcctccttatgttctcccttaaatccacacccctctctccagccctgactcttttccaccaaggcttctagataagctctggggcagcaaggctggccttagaaataaatgattttgtgtttggggctctttcagggaaaccgaggcaggataggagttgtcatcgcggcttacatgcactacagcaacatttctgccaggtaagaggggcctggagcctcccatcctctgaacatcgacagtgtgacccccctcctctcatccacccacagcctctctgctccctggagtgaggggatacgcacagagggaatgagaagcgatgaggacgggggaaggggcccctggctctgaggcaggagcctgtggacagagggcgggagggaggagagtccacttctctatcaggggttctggtggggcagccttgggaggcaggccctgtcctgagcaacccatgcggccagctcctcggagccacttttccttgccaaactgccttctttttccctgggccagcaggaagggagtcagaaagaaatgtcggatcagatctgggtctggcaaaacagtctagaagttgtctcatctattcctctgcctctggacaacagggccctcttcctacctaggtgtttggaacaagaataaagaacatccagtcactgactccctttccaatcccactctgcagagaggcagagggattcacccattcgttttgttattcactcaacaaggaatatggctgggcgcagtggctcacgcctgtaatcccagcactttgggaggtcaaggcaggtggatcacttgaggtcagaagttcgagaccagcctggccaacatggtgaaactccgtctctactaaaaatacaaaaattagccaggcatggtggggcaggtgcctgtaatcccagctactcaggaggctgaggcaggagaatcccttgaatctgggaggcagggaggttgcagtaagccaagatggtgccactgcactccagcctgggagacagggagactctgtctcaaaaagaaaaaaacaataaatattgaacagacaatgtgccaggctctgttctaggtcctgggaatgcagcagagggcaaagccaggccactgccctcatgggcattaaacacataaacaaatacattagtaatagcaggtgataattatcgtgaaagagtaaagggactcaagaagggcagtggcgaggcaggtccatggttggagaaggcctcttgatgaggtgacactggaacagagacctgagtgaccaggatggaaagggctgagccttatcaagcctgtgggatgtgccctgcacactgagagaagaggaaggatgggaatgcgaggggctgaggtgtttgaagctgagcaagtgagggaagaggaagaggaggggaagctgggaggtggcagagccatggggcctcgcggcctcactgaggactttggggtttgctctaagagtgatgggaagtcactggagcttcgtgatcttttcatttcaaagtgacttctctgagtgctctgtgaggatggtagaatcttctgtggagggcctgccaggaggctgtagttttaggacttcgagcaacccaagtcagtctcacctttgcttaatgataagcaaagatgaggctgcacctttactgcactcctgtacccctactgtgtgccatgagtgccaagctctttatggatattccctcacttcatctccatagtcacctttgaggaaggggcaattatcaccctcatttgatgggtgaggagaatgaagttcagagagattcaggaacttgtaccaggacacggggctcataagtggtagacctgagctgggctcccaggctgctgaactttaaagcctgggctgagtgcggccctgcacagttggagagatgctgaaacactcttttcctgaaagcttctcggcacaggatggcagggggaagaggcttgtcttccctccaggacaaaggtgctctttggccagagtgctctgcaggtctgagggagcaggggtggggaaaacaagcggctcttggatgcaggagttgcctcttttgaccacctgtctctccctgcagtgcggaccaggctctggaccggtttgcaatgaagcggttctatgaggataagattgtgcccattggccagccatcccaaagaaggtgggtctctggggctcacagccccttgcatgtatgtgtgcactcactctatgtggggactagacttgtgtactcacagggatgggatagctgtgcctaggtgggggtgtaccaggcgcaagttttcagatgccagcctgcagtggtgtgagctcaggcacacaggagagcccgggagccagcctgtggtgtgtgcccgcagattggcacagcacttgactctgaggcctgtgctagagagcagtgcaaccttcatggggaagcatgagtctggggataagaaggcgctggtctaggaaggcatgtgctgttcttggccctggaagcaggattgcttcagtgcttggatgagtctacgggagactgcatcactgccccctgctgtgggaggtcagacactcatgataagggtcaccttctgttgggagagtttagacagttttactgagagctttcaaccacatggtctcattggagtctcacaatagcccaggcaggaaacagggcagggatggatttattcattcagcaaaatttaaatcatctactatggctccaagcactgagatatctgggtgaacaggaaaaagtcctttcccttggtgagctgatacctaatgagagagatggacatgaaacaaataaccatacaaacaagacagtgtcagacagcaatgaggctaggaaggaaagagggcactgcagacacgagaactgataggggaacggggctcttttaatagggatggtcagggaatacctcttagagggggtgaatttgagcctaaactggaatcacggtgagctatcgtgtgatgatctaggcatcccattttgcagattagaagctgagccgagggagggggcgtggccatggtctatagtgagtagtggcagaactggaaagtacgtgaaggcctagtaatgcctgggctagggcagtgcctcctggttgtgtgacccactgtcctgagggatcctgctccgtgggtgacatgttgctcaaagacatctcatgcacaggaaggcacaggcagcatcaggggcaggaggtctttgggggaggctgcagccaggatggtgggaaacccaagcccaaactggagacctggatggtgggacgcaggcccagctctgtttgctgctgggagttgtgggcctgccacctgccgtgatgtcagcaccattctgcacactggtgacatggtgctgaatccgccaggcaagggcttatggagctcagcttctagtggatgttacacatataaggaaacaattcagatagtcatgagagctgcaaagaaaaggcaaactatgatggctagagagtgatggggctggaaagagggctgattcaaatggaagggccttctgagaaggtgacgtgtaacatgagatctgggtggggagaaggaagcctccaagtgaacgcacgggataaaggatccagaatgagggaatagcactgactacaagggcctggaggccaaagcatcctatttgcctttttagcccctgagcacactgactgggccaacaagggcctggagctgtgagtcctggagctctccagcctcatcatgctgagggtcccaacacgtgccccatcatcccaccttgcttggctggctagaactgtgctgtcccagctgggggctattcccgccattgtaattggaagcccaagaagtgagtgagtcctcaggtaacccagcaccttatagttgcacaaaacagttgatagccagcctcagagtcagcaaccagaaatgggatgtctttatgtgcagaaaattctggttagggccctggagacagcagctgtggatcaacgagagtcttctcagggaagaaagaatgattggtcaagcactgccttgtcagcctctggcttgccatgtgtgtctgctgactgtaatcacggtgtggcctttgaccttgaaggataaggatactaagagagaagcatgctgttccaatggcacagtgtggcttggagagaatgggtagagagtaacatctctgagtctgagtagtgaaggcctgaagaccagggatcagtgtcacctctcaggaataggattatttagggattccctggtgtattagtccattttcatgctgctgataaagacatacccaagactgggcaatttacaaaagaaagaggtttaatggactcacagttccacgtggctggggaggtctcacaatcatggcggaaggtgaaaggcaaatctcacatggtgacagacaagagaagagagagggtcaagggaaaggggtttccccttacaaaaccatcggatcttgtgagaattattcactaccacgagaatagaatgggggaaaccactcccatgattcaattatctctcactgggtccctcccacaacacgagggaattatgggagctacaactcaagatgagatttgggtgaggatgcagccaaaccatatcatctcgtgttcaacatatgcttgcatagcaggcagttggggcgtgtctgcctggctcctgtctgacactgcctctgcttgtggatgggtcacctctctgagcccagatgtggaagtgcaactgtgggtttactatgcatttattgccaccctcctgccttcttgtcagtgtcacttgcagggaatggagcagatggaggagaggagggcagggaaagagagagggaggggctttgcctgtagctctctcattcattgtcacccgcctccggactcattgtccctcgaacacagacacatcctgttggcacgatccagagatctgataggaaccgctattccaggtttccggcttgagtaatggggcaggggcctgaataggatcgggtgctgcccatcagattatcttacttgagtagtccgaggaggccccacccaaacccagggacagaggcccacaggcttggaggtgggccaaggagccaagagacaggaggggatcttatcatggtcatgtgggctctagttccaccctcttcagagagctactattggctcctgcagagcctcagaatacattctgattggtctagctgactcagcttgtcattccatggccaatcagaaaagggaaaatgccgaccaatcgacgcagaaggactgatctctattgggcagatgaccgatctctagtttattgggcagatgcgttggagcccagacttctttcctgctctccccatccacttccagctttgtgtgttcttgctgtgtgtctctggagtccagtgacccctcctggaccttatttatcctctctgtctagaaggagagggtgtgggttagttcttccattcttccaacagatctttgttaaagaactaggggatgttggctgggtgcggtggctcacacctgtaatcccagcactttgggaggccgaggcgggctgatcacctgaggttgggagtttgagaccagcctgaccaacatggagaaaccctgtctctactaaaaatacaaaattagccgggcatggtggcgcatgcctgtaatcccagctactcaggaggctgaggcaggagaatcacttgaacccgggaggcagaggttgcggtgagccgagattgcgccattgcactccagcctgggcaacaagagtgaaactccatctcaaaaacaaaaacaaaacaaaaaaattgggggaagttgaccctagagatagatacttattagaagctagttacctcgaataccaagtaaactcaaggatacagagagagggacttaatgcactttggtatgatgtagagaaagtgaagaactacattcattaaagtcttgctcactatttgctagactatcacttgtggctactggatctgtgggcagaactggggctgtgagtatgagcgcaagcttgatttgagctttgtgtgggggtgtgagggcgtcagagctgtttggtggttgggcctgccttgtgcagctaaatgatgcctgtcagggatgtggggtggaaattttggtccagcaggagattctcgggctgggagtgaagcaggaaagagatattcatgttgaccaccagagggcggtggcgaactccaagtgggatgcttgacttgacccagctctaggtctggtatacctgctcactcttcctacctagggctcccagcagcaggcaagcatgtctgggagggaggcctggttggggagggggaccatgttggttggggagagggtagagtaggtgagtggtctagggcaatgttcttggaaaagagagaacagggattactgcaccagtacccacctcactccctgaagctgcttctcccaccactacaggtacgtgcattacttcagtggcctgctctccggctccatcaaaatgaacaacaagcccttgtttctgcaccacgtgatcatgcacggcatccccaactttgagtctaaaggaggtacctgccttgagccctctgacctccacccttgccaactcctccctttcatcttccatcttctctaagaggcaaccttgggtagtaacagacagcccgagagctgcagagtcataaggcctccattggactctcaagtgtattgcttcctaaacttttctaagcaccaatctatttgcagtgcctgctggccaatgatgttggatgggcaatgtttttattaatttaatttgccttacaagtgaaaagttggtatttcttcccctttctgcttcctcttttactctttcctcttttcctccttccccttcctaccccgtcttcccccatttcttccttcctttctctctttctcccttcactgtctcctctgcccctcctgcctgccagtttctgctgtcttagctaacacccaccccacttttacaggatgtcggccatttctccgcatctaccaggccatgcaacctgtgtacacatctggcatctagtaagtattacatgggcgtgagaggccagagaagcccaaggcccagggctaaggaccaggtcagaaggttggggagaggagagaatattctcaagagggctgaaaggacagagtcagagaggtttcccactaaccctgtggcgtaggggcagcagggagaaaatgcccctccctcatctcccctccagcagcccactctttttctgcccacctctctcccttagcaacatcccaggagacagccagactagcgtctgcatcaccatcgagccaggactgctcttgaagggagacatcttggtgagtgctgtcctctgtgtcaagccccatccttgtttattttctctcccttcttttcttactcctttcctgcctcttgggacaagacaggtactcctcctgggctgccaggcttggaaccataggctctcagggctcttggaagaccttccagtctcacacagtctgtgtctctcaccctgggcttagctgttgttctggagcatctccagggaaatatcactcagcgtgagctgttacctcctggcttcttattggtgacaaggactctctgaattctagcttcagttcttcctgctgccatttaaatccatcttactttttgcactctgacttgtatgtagaaacttcttgggaggacatttttgtccccagaggccaagactggcctccaattctctgctgttctagaagtttccccacagaactctgagatcctgtttggtgttgatgagctctccctcaccgggtttggggtgagccttgggggctcagtcagcggagctgataaggaggctccctgggacctgacctcccagcctcaggcccctgactggttctgcccgtcttcccacccagctgaagtgctaccacaagaagttccgaagcccagcccgagacgtcatcttccgtgtgcagttccacacctgtgccatccatgacctgggggttgtctttgggaaggaggaccttgatgatgctttcaaaggtgcgctccttgagtggagctgggggtgggcacccctgtggcagggagaggagctcagtttgagacgatatggtgggtatggggaccatcttttctggaccatgtggtctgtctagtctcagggtgatggtaggagagagttgagagagacttgggagagagttgagattggatggtctgggaattccagttgttagtagaagtggagataaactcctcccagtccttgggctgttttatatcttgcagccttctatgactttccctgtctctccttcatcttgtcctcccagtttgtcacatgtgtcctactgacaatcattttttttttcaacattcactgggcatctgctttgggctaggatctgtaccaagtgccggggatacaaagtaaaacatggcatggtctctgccttggtggagctcaaaaatcttgttgagttgggaggcagactagcaggggataattaccctgcagggcagaagagcagtagtggaggggtgtggcagcagcaagggggaaccattttctgagaggagaagaggtggttgggaaaggtttggtgtttgcttttgcttctttcttttatccattggaagttttatctatatcacattaatgcctgggacatataaatacacatttatttacccatctctctctccatccaccaatccatccttacacacatccatccatccatccatccattcatccatccgtctgtccatccatctgtccatccatccacccacccatccatctatgcacccacccattcatccatccattaatccatcccttcattaatctgtccatccatccacatattcattcatctgcccacccatccatctatccatccatccatccatccatccatccacccacccacccacccacccaccaagcatcacttgtgtgtctgtatgtgtcgggcatgtgctagaccctatagatatgaacagaaagaagtcaggccctaccctcagggagttcacagtttcctcagtgagagacacacaaacatgatactatgaagtgttgcctgaagtgatggagacacgcacaagcatgataggtgtcccatggagcagatgccatccttgctgtaacttcttttcctacatgcagtgggcagtgatctgtgtccagagtgggctcaggcggagaaagactggacctggggcttggaggagggtccagatctccttagtgtggtctggctcatgtagaagggtgtttctttaatgagctctccttgcactggagccagaagatgccatcataattacagtacagaatgtaaatgataacagtcttaacaaggaaaaataaaggcatagctgatcaaataaataagggattgggcagaagttgagagaaggaagggtcacagatttcctcctcttacgtagtgggagtcaggagataccatcgaaaattgacatatcaataaatagaggcatggccaggcacggtggctcatgcctgtaatcccagcactttgggaggccaaggcgggaggattgcttgaggccaggagtttaagactagcctggtaaatatagtgagaccccatctctacaaaaaataaaaaaattagccgggcatggtggcatgtgcctgttagcacagctattccaggggctgaggcaggaggatcacttgagcccaggagttcaaggctgcagtgagctatgattgcaccgctgcactttggcctgggcaacagagtgagacctggtctctaaaaagagaaaaagaaatagaggcttaactatcttatttaaagtttcaaagataatcaatagcataaataaaaacaataatctaatcagatttaagaagacaggaagtaggggtagtagtataagtgaaccaaattattcatattaatagtggtcaatccatagaggttatttaaaattcatgtctggctgggtatggtggctcacgcctgtagacccagcactttgggatgctgaggccggtggattgcttgagcccaggagtttgagaccagcctcagcaacacagcaaaactccgtcgctataaaaaatacaaaaatgagccgggcgtggtggcttgcacctgtagtcccagttactctggaggcagaggtaggaggaccactttggcttgggagattgaggttgcagtgagctgtgatcgcaccactgtactccatctagggtgacagagcaagattctgtctcaaaaatataaatatgcactccaggctgggcgacagagcgagactccatctcaaaataaataaaataaaataaaataaaattgggatctagaaatagtggcataaaaatagtggctattatttagagtcttagaggtaaattgctagtagaaaagcaatagaaatagttagaatcagtgacctcattacctcaggcaagtaggacaggggctagagtgggcaggaaatttaatttcattgtatagatataatttcatgtatatatgtataaatatacattgattattattatattattaaccatgtacatatatggtattttaattttttctagaagaaaactttttatggaatcctttttgggactttttgcctatttttatttttccttctctttttccagatgatcgatttccagagtatggcaaagtggagtttgtattttcttatgggccagagaaaattcaaggtataagccgagttagaattcattctctcactccttccttttatcctgaccctatccccagcacccttccacccctggtctgttccacagtgatcaagttatttttgagaggcaggccatcagtaaaggatctgggtttcagagtggacccctagctaaacatgaaccagtgacttaatctctggataataaaaataaaaaagcagacagagaggcactgggttggataaactgttctggtcccattaggtcatcagcctgttatattcagagactgaggtccttggtagatggagggagtggctggcgggcagggggcacacaaaggtgctggatagaagatgtgtatttatgagaactgaggtgattcaacctgaaggctggtttaataataaccttgaagcctctatactggttataagtggagaccagttgttcaccatcttattcgagaatggaatgaaaggagatgaagttaggttatgggcagagggactctggatagactaaagaaaggactgccaagccaggaaggtaactcaccctgacagacttgactaggagctatgctgtctttgagccaggtttttaaaaatttacttatttatttttattttaccttaagttctgggatacacgtgctgaatgtgcagatttgttacataggcatatatgtgccatggtggtttgctgcacctgtcaacccatcgtctacttttaagctctgcatgcattaggtatttgtcccaatgctgagctgggttttctgtggatggctgggagattctgccgtgccccctaggtttctgtctggagcggagagcgttttaagagggggcagggccatgcctgggatgaccctttggaggctttatgtcctttcaatgtcggggctgtgatttccctgctgtccctgatcccacgtagctcataagcagcctgccccccacccccagggtctgaccccaggggcagactttctagtctcttggcactgcctcaggagccccagggacacagaagaaaaagaggcaggtacccagccaggggtcctccccgctttcttccagggggtcttcattcttcagtgcctgtcctgatttacccctatgacccggcatgagccttttcaagaatgtgagaaactagactcccagttctcagtccagcttaagccactggtcccgcccaccacgctcaagaaaatgagaagtccctcagggagcctcttttggggagcttgtgggctttctctgtttttccagctgctgatctcttttccctctctgcactgtctccccgactgccgctgcctttcccatcccacttaggcatggagcacctggagaacgggccgagcgtgtctgtggactataacacctccgaccccctcatccgctgggactcctacgacaacttcagtgggcatcgagatgacggcatggagggtaggtgggacctagtggctcccagcccctatccaaactgcacagcctctgctcacatgaccttgcttctcttggcctgctttcaagagatctgggttcgagaggaggcagaggggaagtgtgaggtacctccgagagctcaccgttaactgggggaagataaggcacatatatgaatgtattaaataaaagtgaggacagagccaaagaaggcagcaaaatggccacaagggggttatcgtggaagtgtgttgctacagccaagtaagttccgtggacagtgagttctctgggattggcagggagggattttgagagctggagtgatctgggaaggctccttggaggatgtggccttgagtggagcttgagataccccccactgtgctgcaaaaacagcatttgtcacatgtgtattaaacccactgttgggtttcttcaggcttgctgcctgagttctctggggtcagagtactaggaacagaggcacaggatctagggcctacaagctttcatcaacagccaacaaaaatgtttgagagctgggaacaaactgataggctctgaaatttgaaaagaaagcagcagaattgaaattaatacatgtttaatttagctacaaacctaacattatgtcaaatggtccactgcaactcaggtcgtctcttgagagttctacatgcattctatttatttatgtggtctatctgcatatgtgtaaggagacgtggggcgggctccgaaagtgagcatgcccagagcccaggaactcttgagatgccctgcctggggtttggccacaagcttcttttcttgagttggtcgtaggactgcagaatgttggagctgggaggaccttcaggatggtccagcccatcacccatctgtgttcagttggggtgactgagacccttcccagaggcagaacctcctgatttacccccgtgacccaggatggccctttcaaggatgccagcacccagcgtctggcttctcctcccagctgaagccagtcctgggtggggctgtgccatcctggggcccctgggtcccatggcagagctaggttagagataggtaggcctgggggcctccctgtgccctctttcctctacacggcgctgtcttctgtctccctccccaaggttttggatttgatgactcctctctgaaaatctttgggcctttccttgaataaagatttctcctctgaccttggggtcaccagaatgagcacaaggtttcagagagaagtgggatgagggagggtggttggactagaatttggggactcactgagagcacatttttttacgtgcaacattgaaaagtggatggcctgtcctcacacctgcctcagttcccaaccccttttcctcccccaggggcccagcaccctcagattggccaagacaccccaccaggcccctccgaccccccaggctgcttgtgaaaagcactcctccatccccgggcgctgagcggccaagcagaaagcagaggctggagcgaatttgttctgaggtttcagtggctgccagcctaattggtcgttgtgctggggatgtttgcatttttaacaagaacatttggcaattggaaagaatttttactgtctctccatctcttcttggtgcatggtcaatgcgatgataaatgtaaaaacatttagtaaactataaagtgccaggcaaataaaaggtaaaataattaacggtgaggaggagatgtgggaaagacggggcttaggatgtatttggctgtgggggaaggaagaagagcagacggtcagagtgggaggcagcccagggacagcagagccgagagcggctccccctctcggcagagggccagcttctcagcctccagacagggcccctctgtccttgcaggatgagctgacctttaactgaccaaaaggtcctgctggttccatccctctgtctgagggaatggattagaagggaaaaaaggaagggcgagggggcagaagaagcggccagggccttccctcaccaaccctctgtcccctctacctgcctatagcggccttcatgagaggcagttagtatgtggttaagaatgcagcctctgcagccaaactacctggcttcaaatcctttgacaaggtactgtccttggggcctcggtttgacctgctgtaaaatgggaattcagtcaacaaatcattttgagccccttgtgggcagcacggcctgaggaaggactgcatgtggtgttttcttgggggtccgtgacacatttgtgtcagctgtggccagtgtgtcaggcgcctgcaagacatggctaagggagaaggcctggatttaccatgcaccagccatggcaccaagaacttggtagttgccatttcatttgatgctcccagccattctatgactcttattatgtccaaatggggaaactggagcacagaggggttaagtaacctgccccagcttgccaagccagtcaagagcagatctgggtttcaagccaccgcgttgccccctgtgctgtcctgggttggctgacgtccctaggggcctgctttgggcatctggttttgtggcagtacctgggtcccactaagcctagtacctctctggctgctacctctcacccatggacagagaaagtcaacccatcctgactgttaggaagagggagggttaggcgaggggggtgtgctggagcgtggcaccccggaggccactgggcttgccctgaggcaggcgttcagcaagacttcagtgcaggcaacagctgagcccctggcccgacccacagagaagagtgtgggccgctcactcaggaatgcttctgatgagtggcaggcctctcgaaataggtagagggaagggtgtccaaggtgacctggggccatttctgaaagtggccccctgcctacctcttctatttcaggcccactgcgggagggtgatagtagaggccagaccattccctctggagcccaccaggagacttggaggaggggggcagggagcacccagccaggcagtcagcagcagatgtcatctctggcctgcatcctctcgtgtggcctgtgtccccaccttgccctctcctggcagtgaggcatggccagcaccaggctcagagctcctggtcccccaggaggccctcctgctgcccctgacttaaccatcatctcaggaactgctctgcatttaaccctttcctcactgcctgcagccccccaacccagctccaagttcaagtttacagcttgcagcactgtgacacttagagccctctcccgaattctgttgaatttctgttctctgaaggctgacttctcaggctcaggtggctgggctagtcataaaacccgagagggagggggcctgccaaaggggcaggaaaccccgaagtatgggccctccttggcattagctcagctcagcctgtaccaaccccatttcctggatgaagaccccagaagtaggcagaggttagcaatcttgtccagggtcatgagacaagatgtggagttgatattggaatccaaatccctttctacctcccttggagctcagcttaacagcaccccggaacccatacccataatccttcaggtggctccttcaggatggtcgtcccatttctgaagccctaatgatgacaggggctcactaccacaaagggaagcccgtttatggtgggacgggtccagctgtgtctctgtgtagcaaagtgtggctgtggtggagactttgggctcacctgctcctgggccaggaggaggggggcgtgatgagggtgaagaatcaaagggaagctcaataataaggaccctcggactggacgaagttctctgttgtgggacagtggctgggaggacagtgcctgccatcttggggaccctttactcccagagcagtgccttctggtgaatcccatgcctgaagtattattaatctgctctggcagccacagcaaagcaccacagacccaggggcttgttcaacagaaatgaattttctcatagttctggaggctacaagtctgagatccagatttcagcagggttggtttctcctgagacctctctccttggcttggagatgctgttttctccctgtatcttcacatcatcttccccctgcttgtattcttaccctcatctcttcttataaagacaccagacgtattggagtagtgctcaccctaatgatctcttttcaccttaattgcctctttaaaggctgtatctccaaatacagtggcatactgagctgctgggggttagggttgcaaaacaggaatctgaatgggggaacagttcagctcgtcacacctgagaaggagttttctgggtcacatgtatttggatgccccaggcctttgatcctgagtgggaggaaggaaaggtcaaggacaggtggtggggagaggtctggttccctccttgcgggcacctctgcctctctccagttagatctggagcctgccggctcagtgctctggctaacaccagttttgcagcctccagaaaccccattagcaacttggcctgagttctgatgccccgtgcccagattccaggtccccatgggtaggggtggcgctgtgtttttgcctctgctgtataaagcaggctccaaattcctccatagtgttccggggcaagccttctcggaagcaagccttgaaccaagggatatggactgccctctgcctctgagaagcctgcaggctgaccaggcctgggttcctgcctgccttctcatccaccccccacctttctgtgacttccttggacatcagttgtttagagtttctcttgactcaacagagaggatgggaacaggggttgggcaagtgaggggtgctctcagaaagtagatttctcagggataaaggacagggtgactcaggggaatgacaaacctcccagcctggctgacaagggtgaggggctggtgtccaccccacttctgcatctctcctggttggcgcccatcagtctttcccttgtttccatggacaatcccaccagaaccgggggctggtgacagggggccttggttttgtgcccaagcttctcagccctcaggggagatcttctagttctaaagggtgcccatccactccccaagtgcttttgtctgggtaggggaggagcctctgcctggagccaggaatccctgttctgtgatgacttcttatgagctgggcttatccaaggactctgtgatactttttttttgaaagaggaaagagggagggaaagagatacagcaaacaggcagagaccaagaaggagaaagaaataaatagatgagagacatggagagatagacaggcatggatagatattggcctgggaggcagaagatttgggttctgggtgtctctggtaactctttttccataggtcctttttatttcttatgaaatgtgagggctggagtagatagtatttctttccatttctttgagctcaagcattgtgtcttttcatgacttgtgaagacctaaaaggggcctgccaggcttccctctcagactttcgcaacccatgggcttagagcaggaaggagcatggcttagtggttctatcagtcaggagaggctcaattatgccacagtgacaaatgatcccaccttctcagtgggcctgacccaacaaaagcatatttctgctcatactacatatccactgggggtcagaaaggtctctgttcatcacagatactctaggctgagggcagcttcatcttgtaggtgcttccttcactgctgcagctgtgggaagaagacaccatggcttgcacactgctcctgcctagaactcacatgttttccttccgctcatgtttaattggccaaaacaagccaaacacccatgcctagcttcaaagggggcaaggaagttgtgcatagaggatgagaagctggaaataaggttgaacagaccaatctctaggaattaaggctatgggacctagaaccagaagatctggttctaagctctattgtttataggtgtgtttcttggccaagtaactttgcctttctgagatccaaatgtcttaattgtaaaatgggttcaataacagtactttcattatagcattattgtctgatatacaatgaggtaatatacatgaaatgtgaaaagcagagtggcgcatgccatgctggcagtgatttgtgtctgttattattattattgaagtgctggaggagagaagatacagacatgattttagccctctcttctttagaaaaagccgcgttccccttgcccctctactctctgggaaccatctatagctggctctgttctgggaaccccactcttgggagtcaggagacatgcctctgacatcaacttgctatgtgaccttggaaaaattacttcccctctctggttctcagtttcattatcagcaaattgaggataatggatttcaaaaagggcttccagctccaaagccctaacaatgttgaggatgctgatgctgatgatgaccttgagatgagagcactgtgtactttctgggtgccaggcaccactgactgtatgttctcttggttaatcctccccaaacacctgtaggtgggtgctgttttgtacttactgggctgaacaagcagaatttgtaggatgtgattaaaaagctacttgttttgtatactactgccctttaagtctaccctgtttccccttcccccaaatgacactggggcaagttccatcccttttctagccactctcaggtaatacaaggtcttttggtgggtaataaataaatacgcccagtgctggtgaacttgctcctcccccttgtcagctcctacctggctgctagctgtgtgtgtgtgtgtgtgtgtgtgtgtgtgttggttggggggcgggggtggtggtggtggtggggaggctcagtaagtcttctttctgttttcctgacttacatatttagggttaggaagggaagaaagggggaacattccagaacattctttcttgcctggtggggttgcacaggcattctctgtgtggagacagagacacaaatgatatctcttgggttctttgccagtggaagattctggaggcattgaatgccctctggcttctctcctgaggcacttctgtaggtatttgggagaccctgtccaactgcccaaaagtctttcattcgctgttccctttgggtggcgaacatggttctgttcagatgctcaggacccccttcctcagcccagtcatccttcgctccctccagcctcctcctgctgaaatctctcacccctgcaggtggccctcatggacagcatttgaggcagcccaggggctggctctctctcaccttggtccaaagtaaaaagtcagcactcctggcccccgcaaagacccgggttgaggtggccagtgcgcccccacccctgttcccacagcacagttaggcccctgtctttcacatcctccatgcgcccgcaggtacctgctgagtctctgagcagactcactgagatgagggagaagcctctagaaaggtgggacctgccaccaaacaccgtgctctccacaattcctcttacaatcttccactttctaatctttttacacctttgatatgtatgtgtgtgcatggtgtgtatggcggtatagtttggagccacaaagcagttttcagccatcactctctttttaaaaacttaatagctgtatagatataatttaataccacaacttcacctctttaaagtatacaattcaatgggttttagtatatttaggcttgtacaaccatcaccgtaatctcattttagaacagttttatcacccccacccaaagaaatcttataactagcagcagccactcccacttctgccaccaactcccaaccctaatctactttctgtctctgtagatttgtctattctggacactttacgtaaatggagtgatacaatatgtggtcttttgtgtctggtttcttttacttgacccaatgtttcattcacgttgtaacatgtatcagtattttattcatttttgttgctgaatgatattctattgtaggccataccatattttgtttatccatacatcaccatcaattgatgaacatttgcattgtttcaactttttggcttgtgtgaagaatgctgctgtcaacatgtatgtgcaagtttttgtgtggacttaggttgtcattgctcttgggtagatagccaggagtggaactgctggatcacctgtgtcatcatttgaggaacagccagagtgtttcccaaagtggctacaccatttggcgttcctaccagcaatgtatgagacttcctccgcatcctcacccacatttattttctatcttttggatgctagccatcctagtgggtgtgaaagggtattgcattgtggtttcaatttgcattttcctaagaattgatgatgttgaacatcttttcatgtgttaattggccattatggatcttctttagaaaactgcccatccacatcctctgtttcctttttaaatttttgttttgtcttttcattattgagttgtaagcattcattttatattctggcaacaggtcccttagcagatatataatttgccgatatattctcccattctgtgagtggtcttttcacttcttgatgtcagtcatctcttctgcaaggcctgcatggtggtcttctgccttacttttgaaatgtgtcattccttgtcctcaggcctcttttacaactgagacccaagtactttcacgttaacatctggtcacaaatagtgttcccatttgatagatgaggaaactgaggcaagtaacagagaagttaaggacttcgtccaacgaagtcttctggataaatggtgaaggcaggattccaacgtggtgggtctgcaaccagtcagggatttgcactgctacttaacattttatgatcttcatctgtagcccaaaatgctttaggctgtatggcctgatctctttccagctttagaagaggtgcctggattagcctggaaaggttgctcacagagagggaggccgagtttcagatccctggatggtagaacaggaaaaagcccatgagttctgccttccagccagccccgggcctgtgtagccctgtctcccttcatctcctggggcccaggccggatgggagagtggtgagaaggtgtcctccaggtttgagagtgagagatttcagcagtggggagcagagtcccagtgctcactctgggtggggctgtgggagagaactcgtgtgcaccacgctgtttgcccttgatgtattttctcaggttctgacattcttgccttctgaacttttgagtaagacgtgggagaaaccagcaagagaggggagtacaggattgcaggtggtcccagataactcagggaaatagtccaaggttcctggggagtgatacatgtgccccttgtatctaagcagagggcttcaggggtgagtttctacatgtgggtgctgagagcctgagattcgaccctgaactgatttttgttgggaaatggtcacctggcctccagaggggatagcccttctggcctgtgacttcaaggtggtgggggcagtagcaggggagggaggaattcaaagctgctactgaaagcttctgaccttgatctatcacatcatataggacaaagggctgagatactagcaggagaggtttgggttagcctcctggtagaacttcccaactgtgagagggtgaatcagctgtgacaggcagattggtcctcttgtcctcttggcccccttgggcagtgatgttgagggacaagaggggtggatcttagtgtgtgctggtctgcatagaggccaagatagaggcctggatgagacagctccttaaggaggattctcggttcttttgcctcccccaagaggggagtcctctcctgactcactggcacaattagtcttgagaattcaaatacaaggcaagcctgaccttgcgggtaaaaagatgacaccactgacccagtatctgccagccacctgcttgcactgttctctgtcgagcagcgctgggtttgtctcaatgccctcggacccttagctggccctgctctgcgaggcagctggcatgcttgggcagcagcctctgcccatggaacacacggtaaaccaataccctcccgagtgaatgtgcctttggtgctctgtaatctctgccatcgggtgcaggctggaaggccggagccacgctcagagccagccggagctctgggcacagtctgctctcttgtgctcaaatatccagatcgaggcaggggtcaggggagtgtgtactctttccccctcagcctccctccctgtttcctctcctgccagacctgtagacaagtgcaagctatccggacccatcaagaccccaagataccgactctaattatatccaataaaaggaatttaagcttctatcaatcaaatactttttcttactcacctaaagctgctttgcacccatcattaccttcctctcttcttcctttccttccttcctttctgtttccagttacttaactgatcccctgctaggtggtgggcactgtgtaagccctggggatatagaaagctgtgccctggggttgtctggagacggggtaggggtgtcagcccagtgctgtatccactctgccctgcagcccgtgggtaaggggctcgggcaagtgccctgtcttctggggatgattatgatcagaggggctggctttgcagagggtctgcatttgaagggcccctgggaggataaatggcattgaaggcagaattgtttttcagattaaaaagtggcataacaacgttgttcaaagtctggaaagtaaaaggaacgagaaacaatcaaatctgactggcttcctcacacaattgctctggtcactgcggtggggtgggtgggaccttagcgggatgttggaggtggtggaggtgagctgagggccagggcacccttgcaggaggccagggaggtgagaacagttgcagtgtggggccaagggaggggctggtgttccccgggggtccctgctgctcccaggagctgagctgagctggcccagaagccctcaccagagtcctggggctccattcccccgtctgctattgaaggggttcaggggcctcttttctcctttgttttgctttcagtttttcaaagcaacctttacaaaataaagcacaccaaacccgcagtagatgcgtccacagagcctgcatttcttgccctggtggacttggctggctgagggctgcctttcctcacctcctccccatgtggccgcctggggagactccatcaggccactcagagtcccacgcaggtgggggtgggttgatgccacccctggctctgatgggtgtgtggctcctacagtgggccttcttgccttcaggctccagccctccagcttccccattcagctcacagcagcatctaaccctccgtggtgaaggtcctctttctggactattccaaatgattccttgctggatctattgaggccttgggcgctcctccctgccttttcagaggctgatttgctttggcaaagttgagcttcttcactcattgtcctcgcctggctttggggccaatctctccatcagcctcggagaggcggcatcctccctggagcctgcctgcatctacccactccctcccctgcctgctacctggcaccctgtcttcctgcagcagaggccctccctcttggtccactctctgagtccctgctttctgtctgatggacagttctgaggctgtttatgggaaaaggcttcaagggatctggggtctggcaaatgatcagtcccttttcctttgataaccctccctctacttcctcagctgctcatggatgattcatcccctataaatctcctttcttctctatgtccctctccctgacacaagaccttctaaaatcctaccagagtcactgagctcacatagcttcagtaatcggctgcctccattaaaattaaggacagtgtcttagagtaggctgggaaggggtggaacccacgtccttgggaggtgatagtctttagatgggaagatccttgggaggccccgtgctgattgggagcatggccttgggactcaggctgtctgggcttgagccctagctttgcctcttgccttttgttgaccttggacaaatcatttagcttttctgggcctcagtgttctcacctgtaaagtggggagaaggctagtacctgtcttatagcattgagaattaaaagtaatcatctatgggcacctagctcagcgactgttatacaggaagtcattactaagcattaacttttgctaataccactacctgaccttgggtagcactttataaaatgcttccccgagttcaccttcaaccatcccagttcttgagctggactttgaaccaaggcctctggctgcaagtccagtgttcttcccactatgcagaactaggtgtctgtgaatcttttccccatcatcatctaaatgccaggctccatccccaggtgtgacccacttcctctgctcaggggtcctgcctccttggcactggtcgtcagtaaccaccaggctgcaggctatggcctcctccctttgagaaaacacatcagcatgcaagagggtgggaatgacataaggataggcctaaccttaagtccatgcaattgaagaagatgaagagaaggaaaaaccccacatcatctacattctttagtacataagctgtcctcagtcacattcgcttcttcattcaataggtctttactgagtgcttactctgtaccggccactcactgttctagatgctggggacagaacaatgaatgaaacaaagatccctgccatgcggcggttccattctagtggaggcagacaataacacatttaaaaacaaccataataaataactgacagagcctgttagaacttgagaaataccctggcaaaaaatggagcagagtaagggtgattgggaatgggggcattgaagagttgacatttttaaaaaggggagttggtcagtcccggccctctgaggaggaacacttgagccaagacttgaaagaggcacagaagctggccagacaaatatctggagaagagcattccaggcagaggtaacagcaggtgcaaaggccctgaggcaggggcccacctgagatgtttgggaagccgggaagaggacagtgtgactgaatggaggttgtgttgggagataaggtaacagggagtagatcacctggggtctggtagccatagtaaggatttggctttggcctcagcctctttatagaatgatacattgtaaagatctttctgtaatggcaggtaaagagtcttctcattttgttcagctgcatactattccactgtatgtgtgcactatgttttaataactaggtttttaaaaactgcctttaaatcatagaaacatttaagctgtttccaatcttttgctgtttccaaaaaaatgctgcagtgaatggcgttgcacatataccattttcatttgggtaagtctatctataggacaaatttctggaagtggaattgctgggtagaagaatatatgaagagataatttttatagacagggccagattggccttcataaggactgtattaattgatgctcccagacagtgatttggctagggatgaggaggagaatctatccgcccacctcctttaatatgcaccccccaatatgtgagatactgttaggtacccataatttcttgtactcctcatgactctcctgtgacctgagttctcttgttcctatttcacagatgaagaaacaagcacagagaggttaagtaacttactgatgcttacacagccaggtaggggtagagcttggattctgacacccaccatttctcagcataacatttctcaccatttctgacaagggtaggagtcctgaggagccctgccctgctgccccatgcagttggggtttgagaacctagggaataggaactgagttaaagtgggaagcctgcctgtccagctctgcccaatgctgtgcctgtgtcctggagacccttgcaggccagtgatgggggaggggagaggccagcccaagggatctggagccacagtggctgaactggccagccccagccttctccctgtcccctccctctgccagccccagtggagaggcctgagaggctgcggactagctaattctgctctggttgaggagctgcctgccgctgtctgccgggtcagcttgctccagggattaagtttcagcatttcactgatgaaaataaatcagcctcttgattgccctgcatggccctgggaacctctgcagcctggtgtgtgtttacagacttcctgtaagtccccttttctgtcctagcctcagggactccatggctgctgcagaaatagcctcagacaagtttggagcctgaagccacccgggcaggtccaagcaggagaggagatacaggcctgccaagtccaggggctctgggatccaaacagtgcctggtagagcatcttctctgagttgtatccttgaggatccagatccaaacaggactttagggatcacctatacttgccctctgccattgcacagtggagtaaactgaggcctgtccaaaatcaccccttagaattctggctctttggctcctagtctgctgctgcagccaggcagcattttctttaggtctgtttgttacaccgtggctggttagagatctaggggcagagttggagaggtgagttttagctgctgctggaaggatggaggtctgacattcaggagaaccctcttgcctttgggggatctgagtaacaggaacaggtgccaggactagattttctagattttctgaaagttgaggagaagaacctttccactccacgcatctgtctaggtaggatgagtgaccatggcttgtggacatgggaaaacaaggcaacttctagagggttctgacaaggtcctagctcattcttgtgcaaaggggactcaggagtctcaccccaaagtcccttttctcctgcccctctttctttgctcaagcattatttacactcacaagactatccctcagggacctggggtgtcctgcctcagacactcctggctccagaatactggacctcagttgttcaatccctgggccatttatctccctgtgccctgggaagcagcaacagagctgttgatggatgtggggagcttcagactgcccaatctttacatctttacagccagtcgatgccctggctgcttatctgggacttatgcctttgattgcttaaaaaaattgttagcagcaaagtgttctttgatgtgtgttcttctccttctccaggggcagtgagatcagattttgatatgaaagctcaaagcttctcagctctctccttcttccctgccttcctctctctgtctgcacattgcttgagaaccttcgagaagcagatgggcgctcctcatgtgatgcaaaggcagaaaggcccaagggtggtgccctggcttctgtctgccatgcaggcctgtgcttcatggtttggtggcctctgcataagtgagtcactttcagcctagccctagatgggcttatttggggaaggaagcagatacccacccagatcctccacccacctctgcacctactcatgcatgtaaccacatggactcctgtactcatagccacctctcatgcatggagccacagggaccccttgactcatagtcacctctcacacatggaaccacatggacccctctgctcacaaccacctctcatgcatggaaccacatggatccctctagtcatagccacctctcatgcatggaagcacatggacccctgtagtcatagccacctctcatgcatggaaccacatgggctcctctgcacacacccacctctctgcatggaaccacatggatctctgccccactgcgtaccccaactctgccccactgcgtacagtattgggagctgtaattataaaactgcccagccagtttgataacccaacttatatgtggatgctgagagaatgggcctgtttgggatcaggaatagtgattgacctcacttgcagagatggtttcattcgtgtgaattataaaccagccctgaggcagtgttctacttgtttccagaaatgctttgagctctggtagcattgtgaggataaatgcataaaattcccagggaaccagtttgatggggacagtgctcacttgcctgctggagtttgttataaaccagcattgtgactttattgtcactctccactccttttttcttgttggatcttctaagatctaaacctttgcctcctccatctcctttcttgtttctccttcctttctgggaagcagaaagagcatgaatgtcagagtcagactggcaatgtaatcctgagcaagctccaacccctgagccttagtttctttatcaggaagatggcataacaatatccactttgaaaggcagttgtggaaccaagcaagggaacttccattaacgtgcaggcacatactcaataacatgcctgcctcattccattctaccctctccttcgcccttgctcccaaagccccatataccctctccccattcagtgaggactgccactgacatggtgtccacgtcctgggagcagtaagggtggggagaagcagaagcgcggtgagtggatatgtcccgaccctcatccaacacaaacatctgcctgggagttgacaattcccttcctgagtaatcctctggcactagggctcctgtcctgttcttagggaacatgctcctgggcctggccctgcccactgccttcctgggatgggaagtgtgaagaccctggaaggctgaggccctgccaggggtgcctgaagcttgtcctgctccgatggccctgtcttccctgtccactgggctgggaggcagggaggaggtcctggggaggtctaaggacatgttttcatcacatatgcagctgctgtgcccaccccaggcagcgggcccttcctccctctatccccagacgtttgaaccttgacaccatgcctatcttgggagaccccttccttctcctgtcctgactgctccctccagccatgtctttctcttccttgatggctgtccatagaaccagaagttttagagttcaaagcttatctcctcccactcattttaccacgttggaaactgagtcccaggaaaaggaaatcacttgcccaagtttaagcagtgaagtagtggcccagatggggttgaaacccaagactcttgagtcttagttcggagatcggtctattacaccccaggctccttcatccctcagtctagctcagggcctctcacctgtggtactattggcatttgggaccaatacaattgcttgggaccaccacaacaattgcttgttgtgggggtctgtcctgtgtattgtaggatgtttagcagcatctttggcctgtacccactagacaccagtagtatttcctccaggtgtgataaccccaaatatctgcagtattgtcacacattccctggggggccctggctacctgggggtgctcctctttcctctaacctctcatctttgtgatctcacctgtcccacctgcagggtgtgaagtagtctttcactggagacactctgttctgtttcctccttctgttctgggacccggctgcttggaaaccaaagcactcagccattctgttctttacgaggaagaacaaagagccaggccaggaatgttgctttatacctacgaatgaaaagaaagaacttgacaggaagggactaagccttggagggggtgaccagggaggctgggcccccttcctccctggagagacccctcagtgtgggtgaggggccctggccacctggctccagctgtaggtctgctggctggaaggatggtctggagggaatgggggcatttgcttgacctacagttgggaagtgtgtcttcattgtagaattgtccaccaatatcctactttcctcgcacagctagacctgcagacatttgtggttcttctgtaatgagagttcacagtctctgagcacccatctcatggcatctgactgagatctggcagtggggaggactccctctgagagccaggggccctggtggcaatctcactccagcactgaccatgtgtgacagtgggaaactcttcccttcgctgacttggacagatgaaatcgggtgggtgggttgggcccaatgaactcacaacatcctctggcttgaccatgcggggattctaggaaattgcctgggctgactgcccacagtgcggtgccatgtggcaaatctggggtcttgaagaatccttggcacctgagaagtttccagaaggtatccagacccaccctcctacctctagaacttgtgttttatgaaactgccctgctcagggccacctcagggggtacaggggatactgggctgcctctgaagacagagtaataccatcatctttcaagcttagtttaacccacccactattgggaaagacttttctcctgctatttcctgtagtttgttttaagaaaaaaaattgtctttttttttcccccaaatagaaacatggtaagacgaagtgtattcttttttgaaccagatttgccatgccctgccctctgcccaagcccccaggaagtcctttcctatttatgcatgcagctgaggttgtgcccgtccttctctccttgtggtccttgaggctgaattcatctctgcaggtggaagtggcaatgcattttcaggcacaccattggcagtaatcagtgttgggataggctcagtatttgttaatggaatggcatcacatccttgtagtctgcaccattttggaagcctcttctctatgctggccattccaggccatgatttttgagcagagatcgggtgggccaaattgtatgtcctgaagcttaagcactgggtgtgatacatatgggctggtgagatagggtcacagaggtactgctcagggggcacagggctagggaagggagacggggaagcccacgctgcactactcgtgttctgtcctttggagcacttctgtgttctgtacactgtgctgagagcttttcatgtgttatatcagtctttgcactacttactgagatacaatgactagtatacccattttacagataaggaaactgaagctcagccaagtaattggctcagggttgccttaagctagtagttggtagtatctgtattcaaaccaatgtctgacttccaagtccatgttcttaacctggcagatgctgaagtgatgagaatgagaagggccaggcataatcttaggctgcattaacaaaagcatggtttccagaaaatgggaggtgacaggcctgttgtgcctcttttaagtcagagcgcccacatgggctgtttgtgggtcccttgcttcaaagtgataaagaacgactggaagcaagtgcagagaagcaaccagaaagtatgtcaggctcagggacttgcagggagaggggttgcctgtcaaaggggagattcaggagggcaggcacgtctcattcagtatctgaagggctctagcgagggggcgattggcttgttctgacccactccatcgggcactgtaaggccagttagtggaaaagagggctccagggtgttttttcctatgttgagctaaaatccactgttacggccccctaaagatgagctgggcttttggaggaagacagtaaaatccctgtacctggaagaatttgagtacagctaggaacagtttttgccaaacctgactctcttattatttgcagctggggagcattttcaaattcaaagtcccaggccccattccagacagttttgcctctgtgtggagccaggggatcggggttcttataaaactccctgggggctttctagtatagctagtccccctggatgatagtggagaaccatcagatggggttgccactggcaggaactattgtgtggtagtgttttccaaagtaaggttcaggttccaaagtatggtcagactgctaattatatatgaactgatattaggtatatttattttgatgtgtattggaaaaaaaggtatgtattttgcacattcaatctgggacatcatggatattgtgcttagaactagtttaagttaaatgaagtttatttttataacttacaaaataataatgtagatgatattcagatggacaaataaacatgaaggttgcgtgcaaacaaaatctctgctaatactgttgtgggttggttggggtggggacaagtgggtgaactggggtgccttaaacctttcaagagcccgaggtttgttggttagttctagaagactctatggaggtaggaggataattgcaatagtttgtccaaactgtggtcttccccaggtggagcctgaggcatagaacccctctgcttcccctcccctggtctccttatttttagtggtctctttgaagtctgtgacaccgagctgtcccattttatctcatcagtgaagataggtcagtggccagggtacagggcactgggtaccatttttgttcttccccttattttctttctttaccctcaaagaacagcagccagagaggggtgctgaaaatggcgaggggctgagggctcaggtgtctgaggggaaacacagggagtagttgggctgtgcctggcagggctttccctcccaatctcgctgtaccaaacttagctgggaaggtctgggcacgaggatggggtagccatagctcagggcaagcctgtgtctgtggaagcattttggggttgcaaactaactggggccctctgcatggagacaccagtcgctgaagctcccactggcctggccgcaaagcccagatcacctcctgtccactctgagaattgggttgggagattcaattgatatgcaaataagtcacaaacaacatgttaataagagtggggatttggtgtcttattatcagttagggactcctggcactttccagggcacatcaggataatggtgggaacttgagggccgttcacctgcctttcagctgcatggctctcggatctgggtggttgggaacgagggtgaggcattgcgaactctgaaaagtgatactctgctattcatgatttccacagatgggaacaaacagaataccaatagccagtcaattggaagcatctcaggtggcctggaggatcaatatacctggccagacacacactggccttcccaaagttaggccctccaaaatgtcaagttgccaagccagaatccaaagctttgcactgagaacttcatgttggggctcctgtcccctcctggagccctgcctgggtgacaccccagtccttctattcaggtcctgtgttcacctctgggaagtgcaggaccctgtggggttttttctttttccttttccaagccaaggaagtgttctggctcctggactctgccctgtggaggggaaagggggagagagagggaaaaaaagatttccaccttattgttcagcagctggaaaattgttgtcatctgttctgccttccatttgctgagaatggaaaaaaaatgtggaaaatttggggaaataaatctcaataccctcataggacctctctcccctccctctctggcccttgcatccctgcctttccgcttggggctcagtttcactttgctcccagattctctccctgcttctcttcagggcactggggctgccatgggtttgggactggggctgggctgggctacactgggactgggctgggctggactgggacccggtggggctgggctgggctgtgctgggaccaggctgggctagactgtgctgggtgagagttgagcaggggctggggctggggctggggctgggctggggttggggctggagttggactgggctggccacttttcctgactcccggccggtgggagtgaagggcttgggaagccaccgtgatgtcattcaagaacggcatagctgcaggatgataagtgaagccctggggacccagctggctgaaattacagacagttttatcccactggcttcctacaagccagagtgaggcagagcaagctgagctggggagagagcgtgcaggagagtggagggagggagggagtggggtgtgtgtgtgtgtgtgtgtgtgtgtgtgtacatgggcaggcaggcggcactggctcctcccacccctgacagtcggagggagcttgagtaggacacagacagcacttggagctgcagccatgtaggaattattgggaacttggggcaccaggatcaaatcagagcgggcttccctccgcttcctccctctccctccctccctccagagggtaagtgtctgctgggcagttgttttgcctgtgagtgttcttgtgtggctttctgctggatctgggctggggtgctcgtgcttctgtgctgggagggtgtggaggggcaggctctgtcacgaccccaccttggaagggcttgtggctgagtggggctgtggcccgctgtgctgctgtctgatgtggatgtgacgggcctggtggtccccttcctggacttgcttctgggacacgtaagagccatagctttcagggcgagggtatctgggttggtgggggggccgtgtgtctgagttgtcctaagtcttgtgggggtaacggttcgtcttgtgcgcgaatggggttggcagagggaatgaggtggatgcatggatagctctggtgagatgttattcaggacgccccctccctgcatctttggcctgagctttggggcacctccagtgctcaccattccccaccggcctcctgtgggctcccattcacggctttctcctgactttggcagagattttggcagcttgactctcctctagccagggatctctgagtgcccaggctggcaccctggcctggcagagaaggacttcagcttgttgtgggctctggagctatttttaccatcctgagtgtgcctgtgatatctgctgcccgtataggctgagggtaggggtgggagtgccaggctcgggttatagcttcaggctggggggaacacaggccaggccggagtcaggaggctgggtctgagaattcacatttgccctgcaggcgtgggccatccagggcagggcagatcacttgccctccaggcccctggtctctcgggactgaagtcaaggtcacgatcaggttttctgctcctactccctttttatggagggcatggtatgaattcaagtaagaagatacctgggacaattgccacgggtccttcctaaggagggtccggggacacatttatcatcatcgcttgacagaagcaccatatattatgttgtcctgtggttctgggtccacagacatagttggagagtccaccttccaatgcctccagccccagccatcttcaccttgaagcagcattagggacaagagcactgaatagggagccaggagttggttttgtacttccttgccgggtgaccttgggtggtcctgagcctgctgagcttcattgtcagcctataaagtgaggggtgggcagggggattaactactcccctaaggcccttcagctctaaaagccccagggcttttaaaaagctctcttggctgagccaacctcccgggccctggagatcccagttctgctgtcccccagagggcctggagcagcagaggcagccgtgggtgggaggggctctattttttatttcattctgaagctgactttctccatcttcaaggccacaggctgacattgagatttgggctccgtgtgggtcttggaccttgagcctccctctttttttcttggactcagcagaatgggaaggtggccaggagaagcccagctggtccaccctccctgggtccagaggcaagcttgtaggtgacactggtgaggtcacttgcttagaggacaaagccacctgcgacaagactgacagcacagccctgagaaaaatcttgttctctcctgttcactttctgaaggtgtgtgctattaaatggaaagaaaaacaggtgtctatttgtcactcatggactggtctgtccctgcccacagggttccaaggccctgtgcttgttgtgggctctggagctatttttaccaaaaaatctttggtaattttttttaccaaaaaatctttttacgtgttcccaacgtgcacctaagtctcctgggctgcacttggcacctgccctctttgctgtttcagaggctgtgtctcctctgtgtggctctccttcagaggttccgggatttctcttcaacctctaattctgcagatcttcagagcccctgcagaagcccattccccttgagaaagttccagagctcgctgcaggctgtggggaacaaagggctgcctcaatccccagctgtctgtgggaagggaagctggcatgggtggaggccaagactgtcacagactgagccccaggaagtccctgccaccaatgccaggatgtttcaggaggtcggggtcttcctggagccacatgctggggttctccacggggccctctgtaccctcatgccttcctcacatcacttcccctggcaggttaaaacccagtggagcaccctgagccacttcttaggctcccgcagccgcaaagcttccactcagtgtgccgccccatttcccctggatggagcctggcattctccatgcaagtcatgggtgacagagaggatccccagagacagcaccctaacttttcgatgcatatgttgtatcttgggatccacagatggtttttggggtgttcatcaactcccttatttcaccagatctcccaggggtcctgggtctagggaagttaatgtccactgggctggagtgtagctggagaggtctgtaggggatgccatggggtaggctctggctcagggacctccaccatgctcagcctttgctgcagaatatgaggaatacatgtcttcatgtttcggctgcactgactctcttccctcacctttggggagaaactcggggtccacctagaacccctgatttttcactgggtggtggtgaaagaagagtatctcaatggctgacagaactacataaagctttctcggctactcggtgtaaggcaagaagcatttatggaacaagcactcttctctagggccattctgtacagccatgcaggttacatattgaacttcaagaggcatcattcacacagaccacattgtggatggcaccgtctgggaaccggccctagggagagggagagagagagagagagagagagataaaggctcttcctcaacaagctctcagcaaagtgggaagacagacatggacatcagtaatgaccattctgtgggtgactgttgtcacagtagagatgtctacaagggacaacaggagcaccgtagaggtttacctgagtctggaggacagtagggaagaagttagattaagggaaatttcccagggaagtttgaactgagtctgaaagcatttgcccaggaggttgggagtttcacgggcaggatgaggaagggcattgcacggaaggaacagcatgcacagaggggaaagagcatatgaagagttgagtaggagtagagtggagggtgttctgggtatggaggacaaggaagtgaggcttcagaaggtaggcagaggcctgttgggaaaaggtctgacatttccagcgtgggggttgggctttaccctgtgggtgatgagagctgttgaaatgtaaagcaggggatggagagaggaaaagtagagagtgcttggatatgccaggtctagcttaagagccttagctcctgagtgctatcactcagcaaagctgcacacacactctcgaatcctcacctgacaggcctgcaggccgggctctgagtgggtaagtggtcaatgcaagctgatatggccattaagatggcagctatgtttctgagtgctggtgtgtctggctgccgaggtggggtgggaaggcgcacttccctgtctcctctccagagccatcccttgtggccttcctggacccagccctccctcctgtcctggtgcctgccccagccatagcctctcctgcctcttcccatggctggggcagagtgtgtggataagggaaaatgcaaccagaacttgctctctgggcaggctcttggccaagcttcacttctcatcaaagctcacctacctctcagatgcacgtggccttggattccccactcctccttttaaggagttttgcccagtctgcctccaaacagcctatgtctggggtaggcacggtgcttcttcctattgtcatggcactgattttcccccacgttgggtggtcatcacggctctgggtaatgcattttaatgaattgttatttgctggacttggacccaaaggactttttatcatgaagggactcatcctgaaaaccttagtaactcattcgctattcaaaacctacctgctggtccgacagggaagggtctgtcttcactgagtcattgccaatgaaggtgactcctttcttgcagtcaatatggctggcaccttttattcttcatggttgggccgtctgtcctaacatctaaataagcaaaacctccctacttttcatgaggaagagaagtggggtttcttgatctcagagcccaaagtgctgatcagctggggcgggtttctctagatgtcctccagccatgtgtgtgccaggacccctggagagctggcaaaaatgcagattcctggccccaccccaggcctctgagtggaagtccctggggatagggtcctgaaatctagatttttaacaatctccagaggaggttcttgtgaacatcagaattagaaaacagctgccctgaaaccgtgtgactttaacatcccctatttgtttccttcgttcttttttaagtgtgtgagatggctgcatccttactttcctgcatcccagcctgagctgcatggctagtgccgcacacacctctgcacccttttctgggagggagccccggggagtgggtgcacaccctagtcagctggggattttcctcagagctttccaaaagcatgactcgtgcatctggattatggctgccctggaataaaggccccgtggtgcaatcaagctcagcatcgagggtggagtctggaactctctgcagctgctgagaagagcagggagacatcctcagacaaagacagtggggccatggagagattttgggttttgcaaccaccaagaggaatgggcaggacactggacctttcagcccacaagagcagatgtccaggctggctgggcttggggcctggagctctccacttggggctgcctgcagcttgtgtttctgcttcagtttatcccactccattgtcacccgtgacaatgcccacagcccccaaacatgcagacccctccctctagcccatgccccattgttctggatgtccagcctcctctcatctgagatgcattcccctgaactgatcactccctttgtggctgctgggacttcaagaggatggctctggagacccctcagattaagagctgtaaagccacctccccagcctcccttaagtccctctcttatcctcctctaccttatttcactcctgtcctctctgcccccgtctctcttttgcccttcctgccttgatggattgaaaccaacattgtgttccggcttcttgtggtcccggtaaaaagctctaatgtggccgtggtggatggtgagaagggaatgatgagagtgtgtgtgccggagtgggggctgggggacttttgtcttgtctctggtgggaggaggaggggcacgtgctccacagatcctgctgctatgctggggtttcagcagagtcctcatcagggctggacaggcctgggatcagcctgggtattctcaaaacctcccttggataggaagaggacaactcagcaaaggtgctgagtggcctggagggtgcaatctggggccaagagacatttccatttgtagttagcgaacaggagttaattaaacaatttgcatctgttcgattttcttactatgccttagtggcttggctatgattgttcctgatgttgttgctgcaaacaggagcccacttggggatagattacatgacagaacaagtttaacattgacattttcaaaatcgatgctgagtggggcttggccacaggggcaaggaagggctgagatatcaggtagtcaattctctctcctgcctgggggatgccttcatagtttttctgttagtcatgactgagatgctgcaggggcctatgtgctttctgatttgaatttgcccccatggctctcactgtggaacatgtctaagtggggaagccactggacacaccagcctttgctttgcagctccccacttctcagaccacatgagcatgaacgtgggggatgaggaggcacaaaggatggaggggatcactggcccaggagggaaattctggcacctcacagtgtaggtggcagagggggtgccctggctcaggagggggcctgcagctttctagggacagtgagaaggaaagccagctcttcagatttcggccaacttgtccaaggggccccatcctcaagagaaccaccccagagctatgagtgcatcagaggctcctgtcttcagtgctttgccccctagaaacaggcggctggggtctcttctttttttttgagatggagtcttgctctgtcacccaggctggagtgcaatggtgcgatctcggctcactgcaacctctgcctcccaggttcaagtgattcttctgcctcagcctcccgagtagctgggattacaggcatgtgctaccacgcctggctaattttttgtatttttagtagaggtggggtttcaccattttggccaggctggtcttcaactcctgacctcaggtgatccacctgcctcagcctcccagagtgctgggattacaggcatgagtcaccatgccaggctgaggtctcttcttttatgtgtagcaaggagctcagttctttggagagagtgggcatgaaggtcagcctccctcatcctacagggagaggacccctttacgatgataatagggggttggaagaggcagctgtgcctggtcctgcatcttagcagcctttaggggtctaggcacagggccaggttggtggagattcagaatgtattttagccaaaaccccttttcagttcagaccagccctgggccctgggccctgggctgctgcaatactttggtcctgtgttgtctggggctggtgttggctgaggtcccaaagccttggggaaaactgggggcagaggggtggatctggagaggtcagtaaatgaggagggcatccagtccctggggtgtgtgtgtgtgtgtgtgtgtgtgtgtgtgtgtagagggatgcaagtgcctggtggagcatctttgtgccagttctctgtgttgtaacatggctggcctgtggtctgtgtgtgtgtatgttgattgggatgttcctgttttgtggttgtctgatcacttgtttttggccatgggcttctgtcagagtgtttatttttagaggctgccacttctggcctaagggctgatccttgggcatggtaggaacatttgtattttctgaaatatttgtggctttaagtatttatttgggggtattcctgcctgttatgtgtttattctaatttgtgtgtatgtgtgtgtgtgtgtgtttgtgatatgagggaggtgtagcataataaaaattacatactgtttgaaggaaattagctctgattttaaatcttggctttatcaggtagcattgttggcacataaatggtttcccctctcagaggctcagtttctcccttactgtgatgggtgtaatactgtctggctcggaggcgatggctagagaggatgtgcgtgtagagtgcctggcgaagtgttggcgtttgcgctgtgctcactgcacggtggtcactgttgttggtatttgtgtgtacatgttcatgccggtgctgtctgactgtggttcttggcattgtgtggcacctagtgtgtgctcatgcctgggtgtttctgatttgggtgatctcttactgtctttttgtctggctcggtgtgtgactgctggtgtctggctggagctggtgcagtctttgggagctggcttttttccttgctaacggagagcctggattagagtaaggggaggtgcgtgcgtgcgtgtgtgtgtgtgtgtgtgtgtgtgtgtgtgtgtgtgtgtgtctgtcggggctggtggctgggctgctgactgtacagggtgtgaaatcactgagttcctctgggcggggaagttcttcattcctgagtcagccctttggccccgagccacccagcgctcactttttccttccagagaaagtgttgctcaggggggtcctcagagctgtctgcagacaagaggaccctctcccccatgaagacatcttgtttttgtgttcacgatccctaagacgcttcccctcctgccctagtccctgaaccccctgcatcagcaccctatatgccccccatcctccagcataggaaaagcgtgtcccctctggcacagggactgttggcttggctgagccccaccttggcctgttcttcaggggcccccgggctggctcagagcagtgggatcaggatgctcgtctttgcagacctgctgtgatcctgcccggcataccttcccaggacccgcgtccctttcctggagtcttgagtggtatgggctgagcttgctggtggaggggtaggggtccatcaggagtgggcagtgctggggaggagctgggaggagcctctggaaatgtggcagtgggcagcatgaatgacattgtatctctgaatggttctatcacatcctttgcattgagctggagacaaatctagctgagggcaagcttgtcttagagagtcccagctctgccttcagcctccctgccaccaccaccttgggcatggtggggccctttgctgcaccctactgccctcctgggttctccccctgcttccgtgggcaaaggctatcctcggggcgactggccgtccatgctgatacctctatgggcattcaaggcaatggctactctcctggcattctgcctctaatccagagtgggaactccagacatcgaagcaggggtgagactttttgagatggggtggcggaggggactgaggatgctttggaaatggtcattcaggaattaatgatactcataatggtgatggttagggctcccagctgttgaactcccatcacgtgccaggaactggtctcagcatgtcatgtgtcaactcatttaaactcaaagcacagtgtatttaatgaatattggcaatttcagatggttcaaccagattctattattatccccattttatggaccaggaggctggctcagagagttattcatgcctctggtcaggaagctggtgaaatgccagagctaggcttgggactggagcgatttgcccccagcacttcctgctcagtgttgggctccactgcccggccctgaagctgagtgttggtgaggctctgccccaaagcctggggtagaggtctttctgtcagctccccttttccccacctcagggtggtgagaggaggttttaggatgcagggcatgggagctcttagcttctttctctggcagagtggatgatacccctgcctcccgctaatgtctgttgtctgttgtctcccctccggctctgtcccttgcagaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggtaagaggtattcagtcctgactccttctaccccttccttatttggtcttgctggggggaggtgcaggtccagccatgacccctaagcagatgttgctttcactggtgggaggaggctctcaggagcctatatgctagccagttatcccttcctgcattcattgtctgataggcaccaagccagacaccaagtttcaaagttcaatgtcaagcaattcctgccctcaagaaatttacagtctagtgagcggacagatacacagacagatgatttcattagagagtaatgtgtacggtgacagaggtgggaccaagatcccagagcctgggaaagcaaagcttaccacctagggcagtcagggaaagcttccaggaggtggtgactttggggttggagtacagactttctagacacagaggagactctgcaattgcctgtcgtgctgtctgtcctcagactttagttccttgggggagacgtggagaaggctggagggaggcctttgtagactcaaattccctcttaggtcccgctcctagaggccatgaaagagtccgagagggtatcctcaagcccttaggctctatctgctggggcggggaggccaaggttccccttctaagtcagttttcctgttagtctttgctgaggaccagccctgtatgggaagtaggtgctgagagacaaagctccttttcctatcagagagtgggcttctcttttgggagagaggaaagtgggacactcagaagagcttttggggagacaaaggcaagaaatgacagcatgtctggggccatgttgggagagacagctgcgaggttcccttcccactggtctaagcctatgcccattccacaagggtggctgaacttggcaggaaaacctgttgggtgactttattctggaggtggagcccagacaggggtggaccagagactgtggatttgggtggaccttgtgccagcccctcagctgacagggtggtgggagctcagcgaggaggagaggagcctgggcagctgtctctgtcctccaccccttttcctaaatttaggggaagctgagtcaccatgccagctgcagggagggaaggaaacaccctccctggagatggaccgtgggtttagggaagcagcttggggcaggccagctggctcaggacctggtgtggggacacaggctccctgctcctatacttcagagcagagcagagtccccagctccactattggtataatagcttgaaattggccattgcaggagtatttacaccatggaaattggcaatcagcctcacctcccatagagagctggcctagcagtaacaattccttttacctgagcatcggaacaaaggatgggcagttcttaacctcggatgaaacgctccatgggtggtccatatgggctttgacttctgccttctcccacatctgggcccctgagataaagatacccccctggctttgtcagcagagatccttttcttcttggtttttttgaggtgagagggatggggctttctgaattccctgggaatttaattcctctcccaatattttgcaaggttggagtggtggcctaaagattagtgacacgctagtctaatgaggggcaggatccaggagccttctctctgggggagcagaatacatttcctcccctacaagaacccttccatgcagctctcctggagcttgctcaagaggaggccataaccctaatggccctgggaggatgcccatcttgtagtggactgccttttagccctttctctcctaccagctttcgaaggcttgactgtcaacttccatattctgtagcctctcaggctttggctgccatgaagtcatagatagggaaggatactgttggcacaatgttcccattccctaaccctgttgccatttcctccatcaactgggagtgactcaagagaagggatgaaatgtatagaggggacacttatatttggctcccaggtctatgaagttgcctctttggttcaagccctgtcattatgacagaatttatgtcagcaggtcctgcatgagtaacttccttagtagcctttcagggtatctgcagtgcctgtgtagataaaggcagacagacaagatcaatgtgtggaaaagtctgggaggcagggaagatagatttcagcactacttctttctgctctgtctacatctctgccgtaagaagctggaacatacactttgacatgagtaacctaggaagctcagatctgtgggagaacctcttcatggccatgaacttgatctggtttctcctggctttcctcccccaggtctgccttttccccattggctgtcctccatacctcagtctcaagtccctggtttattccactttgatccaatcacccttgtgccttattccagcttaagttgtagaggagaaggtaggggcagttttctaatttgataaagggtagggaccagaaatttatagcatacatcacactttcctgtggagcattggaagcgttcctattagagccagggacaaaataaggatgtctgttatcaccacttgcatctaacattgtattggatgtcctagccagtgcaataagacaagaaaaagaaataagagtcagagttggagagtccaactgagttatcttatgtccctgattctgtggctggactgatctcagatgtctctagaggtggagatttcaatacatgttggaaatcagatatggatcttatccttaaggagtctagagtttaatagggggaaaaaagaactggaactttaaaatagtcttttgtaataagagagataaggagaaagctctgcaggagagaggtgaagcgattgctgtcagctagtgatggggaaggcagtgttaagtgtggttttaaactgagccttggaagatggaataggattttgaaagtaaacgggatcactgggcagagagggttcacagtgaagacaggagagcacagaaaatgtttggagaatggcaagtagattgagaacatatggtctgtgtgagtgacagtcgggataggtagcctggggtctgtctctggatgatcttaaataccggactaaggagcttgcatcttacctggcagcaatgtaggaagccattcctgtggtttcatggggggaacatgccatgaccagagctgaggttcaggatgatgtgtctggtgggtctgggcaggaaggacaataaatgggagagactttgagccaggagatgataggagcttattagatagcctaagtggtgcggggctggattagggtgctgaccataggaatgcaaatgaagagatgatgcagtggatactgtgggggtagaaccaatgcacttatgtgttgattggctggagcggatgagggagaaggatcatcaaaaatgattctgagctccatgaatagaaatagaatgatggttctgttaacaagcaggaaggcaggaggaggacgttgggtggaagatgaagccttggtgttagacatgttgagtttgaggggagagtggagcctccagggagagacatatggaaggcagctgaactttggaattgagtgtgaaagaaaaggaagagctacaggttttggaatcattctcacaaaggtgatggttaaagctttgggtgtatgtgagatctcaatgtcagagggcttggagagaaaagaacttaggatggaatggccatgaagggaggtagaggctgtaaaggggctgagagtgagtgttcgggtggtggcaggagaccaggacagcatgtcatcatagaagtcaagatggtaaagggtttcaaggaggaagggcaggagattagcagtgtcagcctgaagagatcatgaggaggactgagaaaaatccactgggcttgcaaattaggcagccctgtgtaaaacatcaaaggcatatttttagtgcgtgttggtgacagaaaccagactgtgggggattgaggatgagtggagaaggagtgaagacagcaagccaagtactcttttcagtggttttgtgataagagaggagagagtggtagctaaagaggatagtgagtgattgggaacttttttgtaaatataagagtcatgagaatgtttgtatgtagaagaggaggggagtaggttggacatggggggaggaaggatgagaaaaagaagagaaagaaagaagttgatagaataaggtctctaaggaggtaagaggggacaggcctaggagcccatgtaggtaaattaggctcaaccaggaggtgagatacctcttcatgaaattagaataaaggatagataaagatagagggaaatattgatgtcaagctttgggagcttgaagtgaaaactcttgtgtttttttttttttacattttgttctgaaaataggagatgagttgaaggctcattcaatcattcgattcaacatgaacttctaatgggtgctgcttgccagtctaggctttgtgaaaatggtggcaaataaagatccttgcccttacagcagagatggatactgagcaaataagcacatatacataggatatgtcagataggtgatacgtgccattgagataaagcagtgagaggtagggggtggctggctgcactttacatgggatgatcagggctgggcagcgagagatgagccccatggagcaacaagtgcagaggccccgaggcaggagtgtgcctggcatggctggagtagagtgatcaagggaggcatagcaggacacaagttcagagaggaaatgggaacagggacagcttacagagggtctttgaggtgattgtaagaatggtggcttttactccgtgtggcatgagaagccttaggaaggatttgggcccaagagtgacatcatctgacttgttctgaattgaccagggtgggcaggatggaaggagggagagcagttaggtggctgctgctattgatctgggcagtggccatggaaaggggagaagtgctcggattttagacatattttggaggtagagccaacaagattactgatagattacacatggaatgagagagaaagagaaaagtcagagacaacgcttaggtctggggcctgagcaactaaagaatggagttgctctttattgagatgggtaacaatttatgaagagcagtttcaggggaacactagaaacatgacttttggacacattaagtttgagatgaccatgaaacatctgcagtggttggataaatgagtcaggagtttaaggagaagaggctggaacttagagatatgggaattgttgacgtgtacataccagattaagcatagcactgggcaatgtcaccgaggggttgaggacaggtaaggagaggtcccaaggatggagtcctggaacctcccacattccaaggctacagacaggaggagggaaccagcataggaactggcatggagcagcttgtgaaggagaggaaaggtaacatagcttgaactctgggggccagggcaggggcaatgttggccactcctgtggcccctgtggtgtgaaggtgggttagaagtcaacaaggggcaaggaaaggataacatagcaggtccttctagtgcatctgagaaggttcatcttaaggacttttctggtgatgaccagaagctgggggccagagcagaaaagcacaaggggttccccaggaaagaggatcactcagatggctgtggtaaggagccagggtgtgagagagggtgacccttgggctcaggctgggtgtgttacctgggtccagggagaggcaggtgcccaggaaaagatgggtggtccagggacaggcctgctgcctatgggagcaggtgagggatgcgtgaattctcctggtcccacgatggcacctctgcttccaccctggggttagaagagagggaaacgctgtggtgctggccagcaggaggtccatctgcctcttggagaagcaggaccttggatccccctctcttcctgtctgataccttccccacctccctccagtgtgtgcccagataccagagtcagaacaccaactaatcttgattttctctttgtttttgttgtgttttgtcctgtttaatgccccgtcccctgcactctctgtgtttcccatgtccatctgttccctgtgctgttggtggggtgcctgccttgccccatatcctcccttccttcctgcctcccactccctgctggctcccctggggtggggggtgggcagcgtacaacgccaggctgcagggcatcggacacagtggcagcttcccgccccctcctctccaccggctccaatcttcctccctctctggtgggtggctctccttcccccttctccctttccagctctttggcccacttttgagcatcagtttcttttcactccttcttcatgtgctattccttccaaatctttcccaccttcttccttctctcctctgtcttttcctctccctcttctgttgttctctggtttccatctgtttctccttctccttccccatttctcactatcctctcttctgtctcctcacttacttctccatccctcctctctccagccctctctccctcctgtctgcatgagccagagctcacttctgcatgaacatgggcctcatgctagccttggccttgcctgctgggaacaatgcctggaataactagactaacattcagggtcccctgaggagatgcaggcctttgcaatgagggtgctcaggagggctctggacagtccagcactccggccaccctggccagactgcctgggctgcagggctaggtctcggcaggagccaggctgagctttgcatggggccaccagacacaacacagagtggtgccccagcccctgctgctctgtccactctagagcatggcacaccctggggacagcgtaccccctctggtcccactcctaatctctgatcccatggccaagagtcagaagccctgggttggggtcctggccctgcctgagaccacctctgtgaccttgggcaagtttcttaactgtttagagctcaatttcccagtctgagaagtggacagatgatagtcctgtcctgttgtgtattttgcacggtggtttgacatgccctggaccttgtggatgcttcactggggtcacagtaattcatttgagaatgatgccgtccactaacatctacccctggcctctgggacacgcaggcccttaggcgttgagccctggccagggaatcacctcttccttcccctgctcctctgacactggaggctgggtcagggaagatgccatgctcaggcctgccctacaccatgcccctgagcagctccaggaaaaggcctaggggaaatgggaactgttgattcccaatgtcagttatctggtgcctccatggtcccttcttctcccagtccagggatgatcaggagatggctctagcagactgctcccttcaaccgcccctccctcctttcttcttcctctgcccttctctcagcccagtggtggggagtgtagtgttcagctgggcctgggtaggggcaggttctgggatggtgggcctgcctcaaggggagctggcatggcttgccctagggctgctagtgtgatcgccgtgtggctttctggcaccctggcccagcaggtggcctcccggatcccctcgcttctggagccccaggcatgctgtcggacacccagccctgctacctggacctgaggaatccagtcttttggaaatcggaagactggaaagaagagctgggtctgtgagggtggcagtggccagtctggggggtgcagaggaggcacatcatgaagcctgacaccagggtactcgtcacgtgatccaggggtggtgggcagcagtgctttgccaaagtacatgtatcggtctgtgtcagggctacagctcccagaattgcagggtgtgcgagtgtgcgtgtgagtgtgtgtgcgtgtgtgtgtcagatgaaggggattaattgcctccagtctggctcatgctaggggagccttggagtgagctgttgtccagcacagcactgtcctggcagaagagtgacgcctccctgggaagggggctgctctggtgccctgctcctcaggtctgggggcctgtgtggaaccctggggctgggataactgctcatcctggcagggctgtggggaaggcctgatgcccgtgtatgaagcagcccttagagaacgcccagggctccttgaacatagggtgttagggtcctaaagatactttgttgtcataagggtaccccagccttctcagcctcctgggagcttctcttcctttcttcctctggccacacggcctcctgctggggtaggggctggccctagaggttctgagggtgacccagtggccccactatgtacccccatcatcccagtgtcctgctgccatttctgttaggctgtgtgtgtgtgtgtgtgtatgtacatgcaagcatgcacatgtgtgtctgtgcaaggcacctgcctctgcctaggtgggtgtaggagacagaggccctgagagagagaatggggccaaagactgagaaagtcctggggtggagggtggtggcgggagggagggaggtggggagagcaggcctatttttattatcagtcagactctgggacgtgagagagggtgttctctccatgacactggttgtcagcttgtgtccagacaccctagcttggctaaggaacaatggggctctcttctctcccctctgccacgccagtctcccctcccatagagcaagacaagagagagggaacatgtctctccaggcactccaggcggatctgggcttgccaagggggacaacagtgggacactgtgttcaaagaatgtgagtggccctgactggccattggtgccatggggccattggtgctctgcaggggaggggctggccccgtgggagtggaatgcagggtcttacccttccgcagagggaggcactgccctgcagctccttagctctttggaggtcattccctccatttccctgcctctggtcagaacatgctcccacgtgccattctggtggtgatggagagaggattgggaaggtgcagctcaccctcagatggctgactgcctcatgccaggatctcacattctctacggatgtcaggtgccccctgcaccccaagctgctgcaggcatctgtggcccctgaacatggagaaagctttgggaaggttgggcagaatgttctttgtttgtccaggagattcggtgcctcaaatgcaaacagatctattttttaatggcaaacgtcagatccccaagcagggaaactggccaccccttgaaaaggcagagggatctgccagaaagagctgctgggggcagaggagcccggaactgagaccagccctaatgcatttattttaaccttggggctgaactgagttccaaaccccaagagcgtctcccaaatgggcttcttctgtcacaattattgttagaaaatcaatggctatgtctgtttctctctaatgtttttgccaggaatgaaatcagtggcagtgttggtccaagctgcccaggagacctgagtgggatgggggctccggggagctaaggcctgggagcctggggttgctgcagggttgcagcaagctgcccacccttcccaaaaccacgcccttctttccttcaggtagatgctcctggcagcccctggctgggtctaatgggactcctatttttctgttctgcgaataagggctcttcaaggtgtggggcttgtttgctttaagtggaacagtttgtaagtggcagagtgaggtcagagtctagtttactgtccccatcctgggcgctattttcttagctgagatggcagcagggctgcccctgattaataaaaagcccaaagcggagactcagggcaccactcggtaccttctgcatttaatgtgcaaatgccagtcctgctgctctcctgatgcgccccccacccccgattatgggagcccctgattatgggagagtatgagggcgtgtctcagagtggctgtgcctatgtgagtgtaagtgtgtgtctgcccgtaggcttggcagccggcagcctgctgttcatgacaagtaggaaggcttcccaggtggcgctgtttatggcagcctttgtggctgtgccagactgggggtgctggggggcgtggctggggacatgcagtcctcactgtggatggcagaagatgtttctgtctgaatgagggtgatttctgcttggctgtactggcacattcctaggggctggcagtgtgtgtgcagtgtgtgtgcacacacgctgacccatgtgacctgaggcctttgttaagtcctagtggtggtgaaagcagggcggggaatctcttcccagaagagagtcaagaccagaagcccacgcttcaggctgggtcttggcctctgggacccaggaagtgagttttctaggattctgggagccagctcaatgaggcaatggattccgtgcctcagcccagctgtgggaagagggagtgggaaggaaggagggtgagattaacagcatccccaggcctgtggaatgggattgggatgggaagtacagaaaagcagatggagcacacgacttctctctgtctgctcttcagctgggagggacatggtgggatccgccgctatctttggggcagggaaaagggggcggggagctaagaggccagtataaggggagttggtaagaggttcagcggtacaccggatgaagttggggaaccccagagaaagccaaaaatatcccagaggccaactggggctggggacttcgtaacaaggcttagtcatgtctttgtttctccttgggagcaccatttgcaagatgatgcaatttagccctttccaagagttcttccccacaggcttgatgttgctggttggttgatgcagttgccttggagactgtcttttccctccacctcccctcccttgtctggaagctctggccctccgcctccaggggttggaagtagttgacatctgtttcttgtatcagtcctttgtgttcttggtctcagctctgtgtggagagattcctggtgaagtctgagccaatctaagcagatcccctctcctgcagagaaaacctggggtgtgaacagagttggacccaggagggctgaggggaagacaatgggggatgacaggcgagccccagcatggcctctgagctaggaggcactgccttctctgatgggattaggccgattgatcatttcttacacaaaaatgctcattgtcctctacaccctgctttcctcccaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagaggtgagtccttaagctgtatcttggggctatggagggtagtggtgcccactttaaatctccagaaacctgatggtcaacttggcactgatatcagtatactcagtgatttgtctccccctacgtcctcacccaaactctcttctctgacatgtggagtctggggcccattaaatagctctatgttcccacttcttgcattaatattgagattgaagtttcctttttgattcctagagagagtgccttaataaggtggtaagaatcctggggatgatataggtgaacacaatttcaaaactccaaactagatcctggagagtggcaaaattatttttgagccctttgcagatataaggtttttctcaggagatttaattttcattccaaaagatttgcatttctaagacatttcagtagttggaggcagtgagtctcaaacttcatcatgagtaacaaccaatggggagcttgttaaaactgtagcttcccaaatccacctccagagatttcagggtagtagatctggatgggacccaggaatctgcattttaaatgtgtgccctggaagattcagatgtaggtggtccatgggccacattgagggagcgagtgtactggcctataaaagccaggctaatgagtcattctggatagaagtggcttgtggatatcttttctctcctgcctgtggcaggacctgtctcctgccctgagcaccagtgaggagccaggctgacgaggggatgtgggggctggttaactcactgtcctcatacctcaggtcatctgaaggggaaatctctccttctcatggtttccctctttttctcccctgtgttctcccacagccccatttgcacagctacaaggaggccttcgaggagatggagggaacctccccgagcagcccaccacccagtgggggtaagaattccctgtgaagctcgtcttccctgtgtaccctccagcccctcagctcaaccctgcctgtgggagtgccccaggcctgagggttgggggtgacagtgccccaggtggggccagaacgtgctgctcctcactcccatggccccttctcttccattgcttgtggccattgtcttctccgtcgtccacactcacacatctaagggtgcagccgccccagttttagggtccagactgagtgaccatgggactctgggctcccacattatggagttttcttacttgttttgagtctttttaccgtccacactcaaaagaccctaccatcttagcgtgactctttgtgacttgactttgactttgtttctgacctccatttctgcctgcatccagacacctcttccattccaggcaacctatttagcttctaccaaggagagagggacccaggaccctcaggctgacagagcccccagctcatccatccttggcctccaggcagaggcatttagcccccagcccctatacacttactggggaggcagatccccaaaggacagagacacatccacctaaggccaagacccaaatgagccaaggcatggggcagtgttcctttttatagaagaagagacatgaagaggaactggaggaggtggttgtggggaaggaagtgatggattaataccaggccacgagggactcagtgtactcaggagaggcctgggtcagcacaaaaaggagacactggtgctgttcagggatcaggttggctgggcctggctcaagctatccactggccctggtgagaggagggagaactggagctggctgtgcattcccctaggggctggctgtcctgtactggagaggaatgtggcaatgtacgtggcccctgtgccaacagaacttgtgttggctgccatcttgggcatgaggaggctgaagctgtgactgattggtggccccaggaagccgtggctctcccttgagcagtactgtccaatggaaatatactatgagcacatttataatttaaaattctctagtagtcacattaaaaagcataacaggaaactggttacattaattttaataacatttttgttaaatccaaaatatcctttcaataggcaaataagtcaataaaaatattgagctattttacaatctcttataaaatttaagaagaaactggtgaaattcattttaatatgttttatttaaccccagtctaaaatattagcatttcaacgtataatcaatgtaaaaaagaacgggatgttttgtgttctttttcatactttaaaaccctgtgtgtgtttcacacttatggcatgtctctgttcacactggtcaccctgcaacggctctgcggccatgtgtggctcgtgactgctgtgctggacagggtgagcctagagcaggttacgtgagagccagctctgcagcctcttgtgactgcggggaacctctctcactttccatggtgacatctgcttccattcactgttagctgtaaatggccagggaaaggacatcaccttgccttgggtggaagccacctgggctgtgctagaactgggttttgccttcttctctccctcctcttggccagccatgggtacctcggtgagaagtcagaggttccatagacacacagggttagggagagaagacagaaggtggagaaacgtgtggaatttttctctcaggaagcaaaagacttgcctggctttagcgtcgcccactcatctgcctcagcagaagggcccaattgcccaggaactgggggaacgaggaattcaggagctggaggtgaacaagggaggaaccaagagagagctcctgccctgtctggtcctctcgtccgcttcacctcctcacgggcccacctgcgcctccgctgcaccagttggttaaacatgcgcgtacctgtgggctggggctgcttcgtggttattccatgaatgaccgtctctgaggccaggcatattatttcgtaattaatttcattcaaccgccattggtttgacaaacattaataagtgtttgataagcgtctatgagcaagacaccatgacagggaagagggggtgtggcggtggtagaaacagaatctgtgtgtgtctatgtgtgtgtgtgtgtgtttgtgtgtgtgtctatgtaaagacagagggaggatagacagagacatgaggcctagagctatcccatacctggaggtgtatgtttgtacccatttgtcccctatgctgtgtttgttctttggacatccaaggacagagtgagggtgaagggcaggggtgtgccactcatccggacccctgtgatatcttcctgttcccacgtgcatgtgggtgttcacctgcacaaacgagttatgtatgttgcttgcatggagagagagtgtattttttcattgttgtaagattcctgtaggtctgactgtcttttggggaaagcagcaggggcagggagggtcgtggagcatttgctgctggtggttcctgggcatctgagggccacagctaatctgttgaggccattcggcaggcagagtatccttggggctgtggtctctgcaggctcccaatgtcgttgataggagacacagagttcattttttaacttcttctcagagctgtgtcaggagacatggcagctgccacccaggtatctcgtgactgggcataacagccaccctgcagatcagctctgaatctggccaggttcttggctaatgggaaaaagccagcagccctttctgaccttgtgtgttacatgacacttgtaacccagatgggcggcctgggaggagcccaggcttcgcatagggagtgggtgctcttggccacagactataggcttctcctccttccaggacactgaggtttggggggacagagccccacattgagaagttctctcctcctgggcttttcaagggacatgcttggccgagggctggcctgaggtctcagggttggcgtggctctggcccattatctccttctgtctctgtcctttgcagggtgtgccatcctgaggcccaattttcttctgttctcttctgaatccatccaagtacatgttttaaatggactgtgtgtgtctgtgtgtgtgtgtgtgtgtgtgtgtgtgttgggtgagggtaggaagagggatgagagagtattatagagaaggtcagagacagctgcaaaagcctgcgtgtgtggtataagccattgcaaagtaaagggactgcagcgagaagctaagggcctaggggtggaaatgattctctcaaggttggggccagagccagggcaaggttgccatttcctgagtctttccctttatcctttaaactgttcaaatgtagagaaatacggaggcgggaaagggcagtggagccaaagcgctgggcctcagggtggttcctcggcaccgtctccagccccccagccctcactaagcgtgccctcacgtgcctggcgtgtctgccctcctgcccacctctcactccctgtgtctcccctcttcttcctggcacagtgcggtcccccccgggtctggccaagacacccctgtctgctctgggcctgaaacctcacaacccagcggacatcctgttgcaccccacaggaggtgagttgggaagagggaagatggggaggggggccagggggaggaggactcctgtggttctggacagaaacccgggtctcagaatctggtcagcagccagctttgtgcccacactgaggtcaggcctgggttggggctctctgtgtaggggttgggggtgacagatttccttgcagccttcctgtctgttgacttgtggagtttgcacaactcccagcctcctctagcttgaggctttggaggcctggtctcagtttccttggtggtgttgagatctctgctggaagccacacattctaggtgttcaggccctcgggtacacgtacatgggcgcacatacatgcacacatgggtacacacacatgtacacacacacacatagagtcagagaagcatgcccctgctgctgtgtgccagggcctctgctggcagcccagctggctctgctctgagcatccacgaagcatcacaggcattcacctggcatccacaaggcatcacctggcattcagagtggtctctaggtctgcctcttcaggcccagagaaccctaccagagaaacccatgactagcagtggccatcattgcctgccgtttcctcgatccccttgccctcagcccaggtcttctcctgactgtcaaaggacctgccacctccgggcttctgactctccctggcctgtgctcatcccccatccctactcccgatgctggctgcatcttactctgctgctgaggagagcagcccaagctctgaggaaggaaggaggatggctgctcggcctccctggggtcaaacagcctgtcctgttggcacggtagagggcagggccctgggcctgtctgggagaaggtgctcctctgagcagacaccaccccaggttcacacctcctacctcctcctcccatttcccagctcctctccttcttatggtggagggagacagggctccctgggcccttggtggccatgtggggccactgaactcagaaagctgctccctggactctggttttagggctgggtgggggctattggggtcaactttacttttttccttagttaccagaagacggatccagccaggtaggtgggcagtggcatgcatttgtgacccatgaagccacgcagctgggcatagcctcccactcagagtgtcggcatggccagggacactgagccacgggggatcagtagaagggggctgggggctgcctctcaccagccagcacactcctgcttgacacttggcccacagagccctgggcacaggggctgcgaggggctcaggctcctgagagccggggactcaactatgcctcggagccttggggtcctttgcagggtgggcctcggccttccccttggagtccttctgtggacagcgcaaatcggccctggcctcaccccagctttcccatctccgttttctccacagattctctttctcaagaaataatccctgttaatctctttctctctttttccttttttgctcttcctcatcttcaccacctgcccttctttcctgcctctccttcctcccacctctcttctcgtcttccctcagaggaagatgaggggaaggtggtggtcaggctgtcagaaggtaagtagcatttgctgtgacttcctgctctctgggtctggaaatggcttttcaaagcagggcttgaagaggctggctggaggcagctctctttcctcactgggactcaggcgaccaggcacatggccttcctgtcccccaacgcttggtgatgagataccaccctggacacctcctgagtcctgatgggggagcttgtagctgccaggcgctggctcaggcacagccagtgtctgggggctcctgcagtgtcaccttgttgaccaaaacgctcctcttgcaccttcctctcccagcgccatttgcaccagcctgcctggtgtgcagcagctcatagaggtagacagggagggactcagatcccctttcccgggacgtgctccacaggcatttctcagagaagagattctccacgttggcaccactgacgttttggcctgaatgacgcctttttttttgagatggagttttgctcttgttgtccaggctggagtgcagtggcacgatctcggctcactgcaacctctgcctcccaggttcaagcaattctcctgcctcagccccctgagtagctgggattacaggcatgcaccaccacgcccagcaatttttttttttttttgtatttttagtagagatggggtttcaccatgttggccaggctggtcttgagctcctgaccttaggcgatccacccaccttggcctcccaaagtgctgggattacaggtgtgagccactgtgcctggccctgaatgactctttgttgtgggtgctgccctgtgcactgtaggaggattagcagtgtccctggattctacctgctagatgccagtagctctcactcagtcatgacaatcgaaaatgtctccaacattgccagtgtcccctggggggataattctcctggcgcagagcccccatcttacagccacgatttgccctctggaagccctgcctggtttcctatcaacacagaaagtactaagtctgtctttcggggatctcagacaacttcgcgtgtttcaggaaatctatggactcaccgtgtatacaataatgcattgggattcccatgcacgtaattctgaaaagcagtttcaaggagttggcatgtctatgggtcccagaggaacccctgatttagatgagccctgcactgggcaccagggaagcagagagggggcataatcaggtgggaggccttggacacaccaggagcagaactcgagtgaggactcaaaccagcaggtgaaacaaagtgggtgccagcctgggcgggaggccagggtgtggttctgggcactggcatccccccctcaggaagatggggcaagatgggtgctgtgatcacttccagttctgatgggttaggtgttctgacttcccacctgggccctgggccgattggctggttttctcaggcctatttcccattttcctttgaccacaccaccttgattttccaccccctaagcggggatggcctgtgctcctctaaatctgctgtcacccaggtaggatgattggagtttcccagaagactttgccctctcctgaccagctggggtttgggcaacaacatcaggctgctcaggggctgcagaacagggcagcttccagagacagaacaggtgggccacagcatgcttccctctgctgggaacggcccctccttgctcccccgcagcctcatgcttggggaaagggctttctcccaagctggaggctgactgctggtcctggcaaggcaggagctgggagagagagtctagaattagctggagctcagagccaacgtttctgtgcttcagatgccggaccacgcaataggctctcagctctcctcgcagctggttgactttaacagaccagtggtatctcaaacactctccagtgggaagggccatggggtggattatccagcaagctggcagagcctggtgattgtgtctctcactttggggtgacttcaggggcgtgggcctcgacaggactgaactatctgccaattgcacctgctgagttactctcatcttacagggccccaagtgctctggccagagccacagagtttggaggggaaggttcttaggggttaactcagccacacccatcgttgtcacagatatgcagctgacatcagcactgtgggtggtgttgggggatctgcccaaggtcacagttaggaggtaatggagccagactggagttattggtctcctgtctcttcctcaagtggccatttcaaagtccttctcctgcctgcaggcaccgtgccctgggattccagcgtgggagttggaattgctgcccgtggcctggggagtggagcggggaaggggcagggagcaaagctgtgggcagccagttccttatttcctgactcatgtgccactgcccgggtcagactaaagctcattctttgctgaccctctgaggctctgcttgatttccttgctgatactttgatgggaaattcagaaaaaaatgccagtgaggcaaaaatggccagaggcaggattattcggcttggggaaaagaataatttgagggatgtctgctatgtcccaggcgctgtgcgaaacactttacattcattcattctttcatgcattgattcatttattcataatactttgtgcgctgactgtttgccaggctttgggaatataaggatgtgttaaggcagctggtgaggagagtgatgccaacagacatttcaatattaggcaaaagtgctgagctgaggtaggaataggatgtcatgggggctgggaggagggggcatgtggctcaatctaaaatgtttggaattctaacttttgagcttctagatctgggacctgggggtttccatattcccttctttctttcccacccacatgtcttgattttagttagggtgggtgtgccccttctctccaagcaaagagcctctttgggagacagaaaatgcacttcagggtgtggacaaggagctgacagtgccagaccggaggagcccaagtcaccctgtgctgcagctgctcttcaccgccagcagccacttggcagggtttgggctcctggaatgttctacatgaagcaccctccctgtccccacctctcccgccctgcccaactccctgtagcctctgatgcagctgctccaggattggagggaaggaggaaaacagcaggagaggtggtgcgagtgaggagtggaggaaggcagggatgggcggctaggagcagcggaggcagcagcagggctggttctgaacactgggcctggaattggcaggaaagaattaggaagaactttctttcctgcctcttctcacctgatcctagctgggcaggtgggtatcctcattcccactttgcagatgaggaaacggagtcccagaaagtctctagtaagtgcacgggtggtgggtgaggggagagcttgcaagtagaagtatattgtcctggggtgggagagagagaaagagccagggaataaacagaaaaaggaagcattttcactacggagatctgcatctgaaaacttgggaaaactaatgtttagccctgaagatgggttttaaacagttctggagatgaactcaggaaatcaaataacttctcaaaggtccttcccgctctgggttcatgaggagtagagattgtatggaagggcttcgttcatctccaccccatgatctgggactggaagggcaggtaggggtggcagtgggagggcagaccagctgaccaaggaagaggatgcactgggaaggagaaaggaggtgggggcccggtgagggcagggccaggtggggctgggtctgagtggccttggctaggttggccacccaatgcacaagggctgtttccaacattgtggtcagaatggatgctgctgcttctccctgggcgagccatcctgttccccaagttcagactcccagtgtcttgagaactcctctggtgttctgcagtttaggagctgaaggggccaatgggactgttgccttaagaacttggccatgctatcgagccatctcagggtttctaatacactgtcccatgggccctccatgcaatcttgccatcagactcccaggctgcagctcaggtgcctgtgtttaggccagaagcagttagtagacccagccttgcctaatggcaagtaagcacccgcaagccacaggcttggctgtgtcctgaccacaggacggggtggtgtggcccactttatctcagttttactgttgctagcaggggtacctgtacttctttaaaagggtggggcgtagggcaatgtgaattgcttacctaatgtgtgggtcaggggcctggtgggaaactgatggttcattccaatggagcaacctaggacagttgatggactcttaaaaggtctgggcagagcagtgagggatggtaaagcaccccgagtgctccctatcaggagcagggagccatcctcccaggccttaaggaaccaggagggagctggagggcagggctgctgactggagtgtggctagagggaggtgggtaggggatgtagccactggcaccttgcccttctctctccctccctctcataccctgccagtccctccttactagccaaaggccaaagctatcctgagccagagactaagggggtctggatgacatagtaaataaaagtctgccttcagggatgcagatcagggtagagagtagatcaggagcgacgtcagtgaattggggaagagcacacaccttcacagtgtcattcacataggtttcaacttgaacttcagggaatgagaaaaatggatgtgtgcctctgaggtcttactatgtgtctctggatggggctggagggtaaggatcatgcttctgtgactttgtggagcacatgcagattgagggcctgctgtgtgccaggtgctgtgtgagggctcggcacacagatcagctaggcaggctctgggagcccacgggcagccaaagagtggctttctctccctggctgggagagaggtggtgccgagagccgtggggacctgggtgtagccatgatgagtgcctggaagggtctgggaagagttttcagagagtgacctagggtggcaagagacgggaggggagagtggactctgatcttgggtgtcatttgcatggctgtgggtgagactccctctgatgttctcttctcccaagttgggttaccagttgcccaagactaaagacactcactgaaactattggcttcccgacttgcagagggttgtatgtgcagtgggtaagggcaggttggggccagactgcctgggttccttggctgactgtgccccttgccagctgtgacctgggcaaggtacttacatcccccgaatcctacttttcctgtataattgtttgctctttttatcactaggaatagccctatggagttggcttttctctgcctgatgggctgaagtgctggatagagccagctctgggtgtcctgtgagcctatgggccctgtctaggtcacccagagccagcttgtgagtctggagactttggtgctagtgttcactgccactaattatccatgtgtcctggcgcacggctccacctctctgggctgaggagataggttagatcaggggtcagcacactgtggcagctggtcagatcctgtccactgactattttggtaaagaaagtttgattgcaacccaaccatgcccattcactgtcctgttgtctatgtaagctgtcacaccacaacagcagagttgtgtagttgcaacagtgacagccttacccaccagcctaagatatttactattaagtctttacaaaaaagtgtactgggcctggtcaggggatatctgcattgtcttctagttccagcagagcctcgtgcttgggtggcacagaatccatgcctttggtatgaatttggcctgggccttctgcgaggaggtgggtggcctgggctggttgagggaggatttcgaggaggccttgctggcactgcctacatggattccagctttgggtgccgaggtgcctggttctacatcaccttgtgcctgctacctagaatagacctcccgtgcctgcctctttgcagacaaactgccccagccttgtccactgtcttgctgttgggtggagggggttctgtatggggacaaaagacagacgggcaggctgtggctggagctgtgtgcagactccattgcagcctctgggtcctgctctgtaaagggtcctgtgctgagggaccatcctcttccggggtctagagaggcctctggcctgggtgtaggatgtcagacctgagggccaccccagaagccactccacggaggccatgcccctatgcagcaaaggctggaagcaccctgctagcaccctggtgactaggctccttccaaattaaggttttctttgggctaaggggaggaaggttgcatttcagctagctggaccccaggcctgtcacccatgagggacctggaggagggacctggaggacctgactattttggtaaagaaagtttgatggcaacccagccatgcccatacactgtcctattgtctatgtaagctctcacaccacaacagcagagttgtatagttgcaacagtgacagcctgacccaacagcctaagatatttactattaagtctttacaaaaaagtgtactggccctggttaggggatctctgcattgtcttctggaggagacctggaggagggggctcttctccaactctgaccattgcagtcttggccagcaggggctgcaggggcctggcctcctgagggatgcacagactctggttcttcagtttctcaggctgatttcagtggatgccttagttgtgggcagtatggctctgtactcaggccaggttcctcctgggtaagacagggacagggtgggatttggaggtggtaggaatgacattcctcccggatcatggcccggggtaaacaagagcgttctgttgcttcttcctctttcaagcggagttcgtttgggagctggcctcagaggccgtagaggagttgggcaggtgccggtctgggagtcgggccatctggggacctagtcatttcccttgtcgggcctcagcatccatccttatctgtaaaatggccttttctagcgtgtgtcccccaccccctcttaggctgttttgaacaccaggtagtgccgtgtataatgaggtcctctgtaaactaaactgctcagtgctacaggaatgccagaggtgggcgatggaatgttgagttccgcctgggaatggggttccctgatgccagtctctagaggaatgctgagtgtgtcaggcagagaggggtgggtgtgtcttggcatcaaaggggctggtgagtctacagcagccccacagggcaagactcaccagtgcaggcctgttgctaggtggccaaggctgtttctggattctgggcagggggtggagctcacatgaactctggcactatcctgggatacaggcaaggcagggatggacctctgggcccactgtagggccccagactctagtggcacgaggagaacctggaagggcctgggtgctgagcaagatcattgaagaaagagagcagccaaagggggtgccagctatggacagcctcctagtccttggagggaagagtctctgatggccatgttctgaggcggggcctgggatccatttcagggccccctcctctgagcaaggccctggtgaaaggtcactgcagggcagggtgggtctgggcaggcaggagccctgcctgtcctttgggggctattcctatgttcccaggcaggagtccaggaagctgtgttccaggggaggttgggggggacctgcactgcacccctgtgcatctgtgctcagtgtctctgtcctcttgccccttccagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacaggtaagccgggaaggggcagtgggtgggggatgggaatccgggcctgggactgggacgggatgggtgaggcctcctggatctgttgcctatggcgtggacaggcagaaagcatacccagatggcggtaccttgcaaaccagttcatcaaggtgcattgagggcacatgtcctgcgcgctgaatcctgtggggagcccagtgacctataattcccaggccgcattcaattccgcccatccaaaactgtgctggaaggagtgaagggtaccacggtgaatgtggcaaagtccttccccaagttgaaaatctaccaacagtaatgacttatgtagtgggctcatcctaggtacctggcactttgctaagtgctttatgcagttatttaatcctcgcagcaatcctaggaggtgagcactattattgttcccacttttcagaagaggaacctgaggcataaaggtgccacagctaagcagtggcagaaatcagattcaggtggaagcgtgtgattccagagcccgcatctctatcctctgccccagacctgcatcatggcgccctccctgcacaggatgagagtcagatgggcccaaagcccacacatgagtgaagggcttggagctcagaacaaggggccattatttctggctagggatgcagcgaggatttctgagggctggaggcatttgtgaagggtgtagaggaagtagcaggatgttgaaagatgaagaaagagagacagggcattccagaaggacagcccagcagggacagaggactgggctgtggccatgttgggagtgtgaggctgagggcatgtggcctgccattaggggatgcctgggtggatggatggctggcatccatatttctgagtgcatcacacagagatgaaagcccagaggtgggtgacagtccctgctgacaggcttagtggaggggtgcagcaaggagctgcttgactggggtagtgggggtgaaggtggaggggacaaagagatgggatgacggcataggaaaggagggttgcaatcagctcaggcaaggcatcgagtgccaggcaaaggaggaggacctaggaggtgtcgcccccaggaggggagactctgccctgaccatcccttcttcgccgtgcccactgccctccctagcctgggatgtcacagagcctgcaaattcccctgccaggcccagtgggtccagtttgctgcacagtctacattggctcaatgctgagcctcccctgcaagtgggggcaccatgggatgactaggggagcagatgagcagaggcaactgtcttctggattctaagccaagcattccccttccccagcctcttaacaggcagcagcctgcgttgctcaggaggcctgactctggccgagggttgcatttcctattttaaaggaaaggggattttcctaagttgtcccagccacccattgttgatgttcagtgagccctggcattaggaagttgttcattgtttctcactcaaatccctcctgctgaagtgttggccctttccaggaagctagcctttctcccctgggattagccttccagaactccattttagtgtctccttctctcaccctgctcagcctggctctgtctcccactcctcagaatccagtttattctggattataccaggaggtggccttctgctttggccccttctgggatgcaaggtagactttgccctagcctggcccctgaccttctccttgcccttggctcttgcctggcccaagagcacacccccaaccaaaacctcatatcaccccgtgaacctgagcttatccagcctggcccagggagggccagcccacaacaagatccttccagcctgcagctccaggttttggcccattggctaagtaaggacctctccccatggggggttcctggtgcacagcctgcctgctccctccctacatactagtttatgtaaggcccctgtcaacctttgtttctctcaccatagttggatagaaatttgggtctagaaggagtcagggtcacctaatccagtcctgtcattttccacatggaaaaactttaataagcaaaaaaactcactggccatcacattgtactgctgtgctttcatctgtcactccatgcagacctagacttaactttacaagggaacctttgactgtggcaattaccccaggtatagtctcctctgaactgagttgtttcagagtcagaattggtagtgacctctgagctcatctcatctaacctcccaatgcaggaaattccctctacagcattcaggccaataggtctgtcagcctctgcttaaatgctcctaatgacaggagcctcattaccatgcaagacagctttctccattggtggccacatccccagtggctggagagcagaccttacaatgacctcaaatcccctgatgtgaaaccttcccctgtgattccttgtctttgcttttttggagccatctaggagtgaaagcccaattctagcactctctgtcaatgtttaaggatgatgatatcacacttgaggaaactgagtcaagacagggctactcccagtaggaacaggagccaggaaactccattaggaatttctgtgatgctggaggctataacatgacagccacctccagtttcgataggagagggctcttcactttgacatggctcaggagtgagcatggtgcagtggggaagacgtgggctttggaatcagacacagctaagttgaaaccctggtcttttataagcagtgtggtactaagcctactgcttaacctccctgagcctcagtttcttcttctgatggttctgtaaggtaacgtataaaaccctgatgtccttccgcactgccagtgggaccattcttactgttgttcatggttggagggagggcagacagcctgctgtaaatccacccttcattcagttctgtccactgacatcgcaacctgccatctctctgcagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccaggtgggcctctcccccttccattttcacctctcctgctgatgaagtaagtagaagagtgaaatatctatcccagtgtctattctgacattctcttggcagacgaccctgggtgaatcactgacttctgggacttagtttctttatccgtataaagagagttggaggtatccttacgatacgtgtgctgtggttgtggatgctgagatgaggatgtggatacagatgaggatgataaaaatcataatgaatagtattactgttatgattatcatcgtcctcatagccattaccactcattgagcacatgctgtgtgccaggctctgagctgagtactgtgtcatttaagcttcttggccacttagtaaagtaggtattaatattattaaccccagtttacaaactgaggcttagaggctctgtcacttgtctagtatcatacagtcaagaaatggcagagccaaggcttccaatccaggccacgccaccccaaaactaatggtcttcaagcatcactggagttgtctttatcatgtgtccatatcttgggggtcatatttagcatgaccttgaaaacctgccttccaaacctggatctccatacctttgccagccccacagtgccacatcactcctcgtagacccaacttcatcgaaactcatgcaggtttgtgcagtgaattcttcacttatcgccagaacttgccacctttgcctctacttagaaagctcattgtctaaacacaaaggccaactttgaacttgactgtgtgcacagtggccctggatgtttgaggcagatttagaatgttttgggcagcctcagatgggccccagctccctagattctcccggcgtcactctcaggtcctgccctgagcctgccaagccaggacacctagaatgaccctgcactgcctgtttcctgccgcccaccggggacatctggttcccagcccctctccttgaaggatgcaaaacttctagtagctgggacacttcctgtttcccaccatcttccctgcttaaaatagcctttggagtcaacacaggaaggcacgtgggactgcagccgcctctgacagctcgttaaacaggccacggcagcagtggggcctggggcttcagacagagaaaggcagcctgcagcagttgcatggcccagctgcctaacccagagaccttccttagcacacggctgccaggaaagggagctgacctctcccctcacactcgcccggagacagatcccagaagcataagggagtgtaaatcataggttgaaattgactaagcactggagacacaacttgtgtctcctgatctgctctcttaactttgcagtgtctttcatgccaacttctgtctctgaagacaggagaggaaaaatgtggaatcctcatctttttctgttctccctccctttttgtgttttctttggtgccaaaagctgaaggaagaggttgagagtgagggccgcacatcctgatgcttagacaggaagatacagtttagctggtcctaaactgactgctagggcctcttaccaaggtcaccatctgtgtgacttgggcaagtcacttctcatccctgaattcctccttttatgtaaaattaggcagttggactgtgtcctgtctgagctccctccagaatctaatgttctatgacaaattcccaaggtctgcagagtctgggcatgggtgtgtgtgggggtgctgtctgcctgagaagtggggtgcctgacatgcagtagatggcctctagattctaggccagccatcacctgtttgatccaaagagaagtgattttttttttgttctatgtgatgcagaacataggccttccctgtggaaagtgaggagaggcctggggaaaagggggaagaaatggatctttctgccctcatcttcatggtgggtatgctgaagttgagaaactgaacctgtggagaaaggttctagaagcaagtgttttaggccatgggagaaaagctgtaggaaggctttagtcacagtcttctagggaaagggggacacggggtggaggaaggctttcagtgggctctgtgggaatgcagtgccaggccctccaccaggaggtggctcagccacccagatggcgggcaggggataggggatggatgaggaggccgaaggtcccttccactgtgttcgcatggtgttcgaggacatcagcttttgatgtcagtttcctggggctgccataacaaaggaccatgtgcttagtggcttataaatgacagaaatatgttctctcacagttctggaggctagaagtccaaaatcaaggtgttggcaaggttggctccttcctgatgttctaggggagaatctgtcccaggcctctctcccagtttcttgtggctgccagcatccttggtgtcccttggcatgtagacgcatcaccccagtctctgcctgcaccttccatggtgctctcccctgtgtgtatctctgtctcctctccttgtaaggacaccaggcatacaggcatactggattaaggctcaccctaatcctgtgtgacctcatcttaatttgtctacatctgcaaagaccctatttccaaataaggtcaaattcacaagcactgggggccaggactttgatgtatgttttgggtgaacacaatttaacccataacactttcttcccttctcctgctttagacaacagcccggagacgcgggctaaagtgaagtttgtccaggacacttctaagtattggtacaagcctgagatctccagggagcagggtgagtgctgggctctgtggtgcatcagaggccatagctggctgaggcctgctgtgtcttccctgggcaaggaacagaggcaaattcagtcctctttgtagcagggggtcatcacagagggggctggggttgaagctggacagtaggaagcacttcctgcagtgaagtgtgggaacacagaagcagtagttgtagacacctcttggaagggttcttaaaaacagcaaagccttggttttcctgggcaaagtaaaaggtctgctaagataatatgaaaccttagctctctgtctgcctgatgtgggaggtttttgcattttacagggagagagaacaaagttgggaataggggaatgattctcaggggaaggctgggtgtgggacaggggtcagcaacggcagcccatgggtcaaatctggatgctgcctgcttttgtaaatgaagttttactggggcgcccccacacctgctggcttgcatcctccctgtgctgctgtcctgctgcagtggcagagtggagtagttgtagcagaggctgcatggcctgcgaagcctgaaatatttactctccggccatttacagagtaagtttgccagccaggtgtggtggtgcacacctataatcccagcacttcaggaggccaaggcagggggatcacttggggccaggagttcgagaccagccagggcaacatagtgagatcctgaatctacaaaaaacaaaaagaaaatgagccaggcaaaatggcacacactgaatagtggcctgtggtcccagctactggagaggctgaggtgggaggatcacttgagcccaggaggttgaggctgcagtgagccatgattgtgccactgcatgccagcctgagtgacagagtgaggcccggtctcacaaaaacaaacataaaaacccaacagaataagtttgccaacctgagtacaggaagacccgtaggagtagttaaattttaactttaaagaaaatttgtctcacctaagaaagaacgaaggtcggtaggctcaatgagacttaagtaaaactagcgccaccgaggtcttgcttcctcctctctccttgtcccttccccatgcagccatcgcgctcctcaaggaccaggagccgggggccttcatcatccgcgacagtcactccttccgaggcgcgtacgggctggccatgaaggtgtcttcgccacctccaaccatcatgcagcagaataaaaaaggtaacctcatctcccagaatggggctcaggaccaggtgagctttacagtcgctaaacctggaggtgctggagggacccagggtgctgggcaggaccttaactcccatcaggctcttcggaagagggtgtcttgggcttggtgatggttgaggtcagagattgggaaagcaggacgattgggtgcctgccatgtgtttcctgaggggtgggagagcagcagtgggctctgcagtccatggggctccagccacgttctctcttcagtcatttctcccatcttggccccgcacactgcggaagttttgaagcagtcttgggaggtggtgggaggaagccatgggcagggactgagccttatttctttctctttgtcccaggagacatgacccatgagctggtcaggcattttctgatagagactggccccagaggagtcaagctcaagggctgccccaatgagccaaacttcggtgagctgtccccctgcccccatctctacagtctggcctgagtcttggtcctgtcctgggttcctccaggggtctgaccccaagttctttctgacaggctctgccagtcacccttgtcataaattcagcagagaaaatgaatgaaagcttctctccctccgcagtgcggctcctaactctgccaaactgcagtctgtgtttgtccgacccagctgggacttgttatcattataactggagtaacaatggtaaaatcagctgccttaattgaccacctaccatgtgaatgtcacagtctcagcaccttctatcacatctggcctcacaaccatcctgtttggtaggggtcatcctccctaatagggaggaattgacacatgaaaaaacgagagtcatcaaagttacatttacctgagaaccaacaggtgagaagtgactgagctgggattggatcccacaattctctgatccttctgccctgttctcagaggagccccagtaactggggtgcattaggagcgatgttaggaggaactttctgcaaaggaaagttgttaggtaactttatgactgcgagagtgaaccttgggaatcttctctgttggatcttgttcaacaagagggtgtgaattttcagctttggtggtgggttgaggtagaggtaataaagaagtggaagattgtgtgtatcggtgtaagggtagaggtggaggtttcccttctggcttccagtatcactgcccatgacatgccgtctgcctccctacaggatcgctgtctgccctggtctaccagcactccatcatcccattggccctgccttgcaagctggtcattccaaaccgaggtaggaacgtgagactcctggctcaccacccacacccttgagctggcccttgtcatgtcttgatcctgccagccactccggacatgggccagggctggaggacacatgtcattttgccagtctggagaaactcaaaactactctccttttcttcctattaaaaaagaagaaaaaatttatgaaaaagcttgactccaggagcatacataaatggacttgccagattgttcaggaaaactctccgtatgaagaaattcatatggaatcctcagaccacgtcgtcccagggatgacaggagacagaagtaggggacaggagacatgtcctggaggatgagatgggcatctggggaagagagtggggaggcagactgaggtgttgaggggttggtctggatggagaggagagagcagcctcaggaaagagaaggcggtgcctaaatgtcgccagactttctaatctgtgtgctgggagggtgttccctgactaaggggatgctgagctgttagggaagagcaagtcctgttttgattgtgggaagttggaatggactccaagagcatgaggacatgcaggatgagaatttgagtgagacggcagggctagggaaggagtgtttagcttctctcatggaggcgcatcagccctggagcgtggcaggtgggcacctagaactcctcccagcataggcctctactgcccagccctcagcaacacagggcccacctgagggtcactggcctcacccgcagtgcaaggtctcggaacggtctgggctgccttctccccactctgtctgttcaacaataggaccttcagaagcgctcctaggctgtggccctaggatttttttctagtctttcttggagctcctggggctatgcccacacataacaccgccagtatttttggacaatttctacttatccaattcagttcattgaattattaatggtaatggaccaatattattagcttataagttcaaatacaacttaaatagcactattaaccaatgacacaattcagacatgaattgaattatattcctatggaattcaccattgtagttcagcaattaaaaaactgtttaatatttagattgtataaacctgttgttttcaaagtatgggcctagaccggcagtgtcagcatatcccagggacttgttaaaaaatgcaaatattggctgggcatggtggttcatgcctataatttcagaattttgggaggctgaggtggaaggattgctcgaagtgaggcattcaagaccagcctgtagaatatcagaagaccctgtttttacaaaacagtaaaaaaattatccaggcatggtggctcatgcctgtagtcccagctacgctggaggctaatgtgggataatctgctagagcatgggagtttgaggctgcagtgagctgtgatcatgccactgcactccagcctgggtgacagagcaggattctgtttcaaaaaaaaaaaaaaaattatgtaccatgtacaatgtgatgttttgataaatgcatacattgtgggttacatcaatatgctaatatatccatcactcaattcttattaatattgaaattagagttatgctggatcaatggtttaatgaattaggggaattaggggatttattgacctacacaaagatatatcaatgcaaaacaataacagcaatgccaattgtcacttgaaggcttgctttatgttaagcactggctaagctgtacatggagtcgctcaaaaacccagtgacgtgggtaccatgatcatcgtctttgttttatagatacttagtaagtgctggggtgagggtttgagcccagttctgctggactccagagctcacaaccagtgtgctggctgcttagagcaatcatcaaacgttcagactgagcctaactcagggctgactgccagggtctggtatgaaaagcagcgttccttctgccaaagagttgcagagctcaccttcagcccagccaaacttgtgcttctttccagctctagggttttaattcctactgaatttttgtcttagaccccacagatgaatcgaaagatagctccggccctgccaactcaactgcagacctgctgaaacaaggggcaggtgagtggtcacctgaaactgtacccatgcccaggcctctctttctgccttcctgccctgacccctcctgcacgtgcaggctggaggtctctccaggcccaaatgtctctgggaagatcacatttctatgtgcagatgccttggctcaaggctagcctgaaatttatctgctaccttctccctgaagaatggatctgggttaatgtcctcacccacgccagctcccatgactcccccttgggttggtttcttccagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagtaagactcccctgcctgctcctcggtggggttctccttcctgtgactcatctattcatccgtgtacccacacatttaccacttgattgattccttgcacccaactgctcatctaccttctcatccatctatcttgcatctacctcccatctacccagctacttatccatccatccatccatgcacccatccatgcacccatccatgcacccatccatccatccatccatccatccatgcacctatccatccatccatccatccatccatccatccatccatgcatccatccatgcacctatccatccatccatccatgcatccatccatgcatccatccatccatccatccatccatccatgcatccatccatccatccatccatccatccatccatccatccatgcatccatccatccatccatccatccatccatccatccatgcatccatccatccatccatccatccatgcatccatccatccatccatccatccatccatgcatccatccatgcacctatccatccatccatccatgcatccatccatccatccatccatccatgcatccatccatccatccatccatccatccatccatgcatccatccatccatccatccatccatccatccatgcctccatccctgcatttattcatccctcatctatcccttaccacccgtttttcccttcatccatctgtatctccattcatctatccatccacccattcatccatccttctatgagaatttgccagcattgggtatacggctgtaaatacaactgataaaaaggacctgctttctaggagcagagcccgtccacttggactctctcctaacagtgtccctggcctctttgcttcttcttccagcccctccccacatttcctattcctcagtgccagtttcttccttccccagcccctagcatttgggatgattctatggcacatctgtctctgtacattgcttgggtcaccagtgtcaacagctcaggccatcttgctcataagagagaagttgtgtggacctgcgatagccacagatggtggaaaggtggcctgacctgctggtggaaggaggggaaaagcagccccttcagcactcattctctgtttatctgatgtctgtgctgcaggctctttttcagacgccactaccctctcaacactgtcaccttctgtgacctggatccacaggaaagaaagtaagtctcttgtacacagcttctctcccacacagctttctaacactgacgtctgtgtgggtgcatgcatgtgcatgtgtgtgtgtgtgtgtgtgcatgtgcatacattctccattcagctggaaggtctgcccatgtgtgagtaatcgtgttgggcatcttttgagtctttcccactatagatatggagaccctcccagggactcagtgcccactgctaccccctctgccatgccctgaccttgaatctgcttctcctctccatgatggggagagcccctcaggaggcaggctgcagtgttctctcgaccttgaatgcatctgtgtgatcttgggcagctcctgtccctggggaatgggggaatgggggaatgaggggggaatggggggcagctcctctccccagaccttcctgcagagggtctgggcatgggtggggctgggctctagggagaaagtacgatgatttaccctgagcccactttctctccacaggtggatgaaaacagagggtggtgcccctgctaagtaagtgtgacttcttacccctgcccagcaggctggcctttgtacttcacagtgagggaagcacggggcacatttagaaaccagggctgggggtagggaaagagcagcaaaaacctttgtgccaaggtcactcagcttccgagtgaagcttgaccaggcttccaggccttttgccttgtcctgcctcgaggccagaggcccagcgtctggtccagctgccttcactctcccagggttagaagcagcagggatggcaggaagtggacagaaaacagtcttattagaagcaatggaaatgggtcagagattgcttacatgatcttttctgccccaattctagctgcctttatttctgctcttgcttttttggtgggctttcctgtgagtcttgtggccgagcaaatcagccttatcagaatgtgggagcccagaaagtctgaattctggggatggccctgggaccttcgggtggattcctccatccagcagacatgtcctaggggcctccaagggactcagatcctgcctgggtctctgaccctgccctcaggaggcccattggcacagcagataagacagatgtctaaatagcactaagatgcttctgtgattttcaaactgtattccaaggatcctagcatccttggattgtacctgatgtacagaagagagggaaagctctgctgctccttgcagttgtctatcagcagtaactagggttttttcacaatcacaaaaccaaacaaaatataggcataacctggggtctgaagctgacatgagactatcaccatgatctgtcatctacttttcactttgtcaggattattccaacagccctattatcctcactgattgactttataataggtaaatgtcgtgcttttggattgctgtttatagctgtaaaatactgctttcacctttatatatgcagacttcatataaggttgctttagaaaaacaaaacgttcagtgttaaaaaaatgacagttgcaagggagggagaggcagcaagagagttcagcttacgtctggggagctcatgcaggagaacacatcagcacctcagagaggtggaaagagcagatatttaaggacgggtcttcaaagacaggttcaatttggacaggtcaaaatgagaatgggagtaggaggggctatttcaggggaggggcctcatggccaccagcctgcaagctccccaagggaagggccatgtctgacacatggggaggtggtatatatttgttgagtgaagaaatgagagaatggaggctggaagagcagaggcaggaggaggctagtgagaatgcctcagtccgaatgaatggactgactagtctatcacatggtcagtgatggtagcttaggagaggccatgtgggatggtggggttcagccttgtccaggcttcatagggtcatcagtgctttgagttcctgcatttcccgtgtctctgctggccaaggcagcaggctggaacttcctgtttgaaggggcttgtgctcactcaccacagggccctgcgagggaagaaggtcagggacagaagggaactgggcccccaagcctggaaatccctcttttcctccttcaggagctggttttgagttgagcctcctgctgaagaagctttgatgggtggggcagaggccacagggagaggccaagcagggcagtgggctaacagggaatcatgacagggacgaggtgaggccagccagggatctcatgtgcaaaattcaaggagatgttagatcttgggatcttgcaagcgcttcctcctgcccttgcgggctgaggcttcttgcctggatctattccttgtggcagatgacaggactgggctattgcgggagcctggaagccacagctgaaagaaatatcaggggagggcaggctcggtgctccagtcaggtgcagttgccgggtctccatcctggtagacacccgcagccagggctggcatgcttcctccctctgccaggatcacccccacccctgctcatggtctgagccagctgggaaagggaggtgctgggggatgccctgtggaccccagctcccccaccacctgggcattaccccaggcctttggccctgttgctcctggcccctgaaacaagactggaggagcagagctgtaggaaatgctggattatgtgtgtgtgtgtgtgtgtgtgtgtggtgtgtgtatatgttgtgtttgcgtgttgtgtgtggtgtgtatatgttgtgtatgtgtgtggtctgtatatgtatgtatgcatggtttgtgtgtgtgtggtgtatgtgtgtgtggtggtgtgtggtgtgtatgtgtggtggtatgtgtggtgtgtgcagtggtgtgtgtgtggtgtatgcatgtggtgatgtgtgtgatggtgtgtatgtgtgtggtgatatgtgtgttgtgtgtgtgtgatgtgtgtgggtgtgatggtgtgtatgtgtgtggtgtgtgtggtgtgtggtggtgtgtgttgtgtgtgtggtgtgtgtggtggtgtgtgtggtgtgtggtggtgtgtgtggtgtgtgtggtgtgtgtggtgtgtgtggtggtgtgtgtggtgtgtgtgtggtgtgtgtggtgtgtgtggtggtgtgtgtgatggtgtgtatgtgtgtggtgcatgtgtgtggtggtttgtacacacaggcacacagggaccagcagaatccccctttgctaacttcagctgccgtggtcctgcggtagggagaggggttttcataggaatctccagctgtcctcatttccccatctcgctctaattagcaacatgctggctgggaggggacctgagctcacattctgttctctgccctcatatttttaactctgttttgcgaagagaatgctgggtcactccagtcctgcgggtgggggtggggaacgggtgtggggtccaccttcccttttattttctggcttccaaggttcttgagcccaggaagaataagtgtgtgtgtgtggaggggtgtgagctacttgacctttgtctccctgaccttgtggtgtctgaggaggctgagccgtttgcaggcagacagcactttcctgattggcatatgtgttgtgtgtaagaacagtcagtaggggtagggctgggatgggcggggagaggcctgtctaggaatgttcccattttattttggtctcctccccacccctcactatccagccttgtcaatcctctgcagctcccctcgcaccccttcaaaggggatttctgcccacccttaaacaaggtgggacactgtctctaggacttggcttgtggtcaggggagtgcacagaggattctcttctgcacctctctgagtccctgatgctgaggcctgctggagggatggggaagagaggttggcctgagaccagcttgctcacctgggctgctgtccacctcctggggttccacttgcccttccctcatgcccgttgccctctcccgcctgcaggctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagtt

SEQ ID NO: 38703 - DNA, 98165 bp, Homo sapiens; identical to SEQ ID NO: 38702

SEQ ID NO: 38704 - DNA, 70382 bp, Homo sapiens
ccgggcccggcccgggcggcggtggcggtggcggctctagctcgagacgtctgtggcgccctcgcaccgcgccgcagccatggccctggtgaccctgcagcgctcgcccacgcccagcgccgcctcctcctcggccagcaacagcgaggtgagccccgggctcgccgcgcccggcctgggccgccggacgccgcgccgaggccgccggagctggggccgcgcgtgcggggcaggggggcggctgcgcgggctcctcggggccccgccgtaggaacagagccgggcagccggaccggggtgaccgtgcgaggactgtgtgcgatgtgaccctgtcttggggagctgtgcggggactttgtgtgcggtgtgacccctatcggggggcgactttgcagggactgtgtatgcagtgcgacccctctgggagtgtctgcaggatactgtgtgtgcgctgtgacccacatcagggggttacccccatcttggggtgacccctgttaggcggagactgtgtgcgttgtgacccctaagggtgactgtgcagagactgtgtgtgcagatgtgacctcgtgattgtgtggggactgtgatttcaggtgtgacccccatcttgggttgacctctgtctggggaggactgtgcgtctgtcgggactcccatttgtgagtgactctgcagtgtgaccagggtccaggggtgactggatgtgcaactgggacccttgattgggtgactgcgtgagccgctggttctgagacctgtggccggggtagttctaggccctttgcctgtatgcctggctgtgcgatgtgagatgtgactgttgctgacctgccgtccggggactgtgccagcgtgagacaggcatctgggagtgcccctacaaacgtgtgagattgtttccccgcctgccgcctctggagttctgtctgtaggcgtgcccgtgtcactgtgtgacggtgaccgagcgtgctgtgggctctgtgtggctgtgtttcacgtctgtgcgtgcagccttagtctggcttttcctttctgtaacatcactcaggcctgtgtgtttatgtgcatctatctttctgtgtggctgtgacccattctgggtgattgcataggtgcattcctgggttgcgtgtcctggcactgtgcgcgtttttgtgggtctgtgtgtggcccaggtccgtttgcctggccactttttcctctggggttgattgagggcactgttgccctcttagcctgcagggttggcctggcttgtcctaggctggggccttgggcctctgagcaggtcagccctctgtagctgcagggatgaccctctggtcgcgcaatcttgcccaccatctcttgaagaacccgtcaaggcctctggtctaaactcttacctataacaaggctgagtgtccgcctgcagacccttagctgtgtttagagaagactggaggagcggccctgcggtcccaggcccaggaagttccgcagccagcatctgggctcttcagcccctttctttgtgggagggagtgggggaagttgactgataacacgggggaggtttgtgtgtctgagagagacaagagaataatgtttgcatttggcttgacagccctgtctcctggtagggtagttcttcagccttgttttgctgggattggcagggacattttcagagtggctgggaagttgaaccttcacagccccctccttggagaggagaggccattcatgagttatctatacacagaaggttctagtaatccccctctacacgctgattagaggcaaaagaacactggcgatcaatagcctgctactgagaagttaggttgcaggagcgcctttccttcccacagcgaggaggggctgttttctgttccggtcactgctgtctggcaatttatgcacttaatctcaggttctcatcacaaaagtttatgtgaggtaaggggagaggttggcttcaggctgaacctgtcagcccagatttctgattcaaaaccccatgttcctagagttacttgcaacctaatctgttcttgtcttacgcattttaaggtcttattattttttagttacataccataaatttgccattttaaagtgtacaattcagtggtttttagtatatacatgagattgtgcaaccaccaccatctaattccagaacattttcatcctccccaaaataggaaccctgtacccgttagccctcacctgcagcctccccctgccccattctccctaaccttaggcaaccactaatctactttctgtatctatggatttgcttattctggacattttatataaatggaatcacaccctgtgtggccttttgtgtctggcttctttgactcagcatcacgttttcaaagttcatgcatattgtagcatgtggcagtacttcattccttttcatggctgtataatactccattgtatggatgtaccacattttgttggacatttgtgttgtgtctactagatacattttcaattattatataaagcattatttttaccaagtgccaatgaccctgataaacataaagtaaaactcaggcagcttttatttgatcatagcaaagctgcagcattcattgcttggctttgaatgcgctgggatgtttcccgaaggcaaggccctcgttcagatgtgttgaggtgagaagcaaggtgggatggagacagcaagtgtgtatggggtcaggagacctaggccaggccggttctgccctggtccgccctcgcttgagttgcttcctgtgtgtgggccctggctcatctaaaaggactgaattacctctttcatgtgttccttggcagatgtagtttccctggaataactgacctgagatggcctttcatctgagaacctcagagagtgaccgagagttaaatgattgtgaagtccgtacccccaagtcacgtcatcactcttcaaattgcaacttcataatgagtcagacacttagggcagtgctttcctgacacagccaggcctgctgccggcgtgggaaacgggggatcacagccctcagtcctaaggctctcttttctcttttaattttctttttttcccagtctttgattatgtcacttatgtcattttcctgtgaatcttatctcagttcctttgtgtgaacaggcagagcacaagaatagataaatcaataattttcaggaatggatcataacattgttatttctgagaaacattcaaagtgactaattttcatgggcagatctccaggcacttttttggattggaccagagtttctcaacccactgttgatacttgggaccagaacattctctcttgtggggggaccatcctgtgtgttgtgggatcctgtcctctacccactaggtgccagtagtgacctccagaaaaatgcctccagacatcttccaatgtctcctgttgagagaacttgctccgcattgagaaccactgggttagaccccaacatactctttgtcaatttgttgctcttgtgacttgttttgtggtcattgaagccttccctgctctttccacttctccttcagtgtggggtaggtgcctctgcagaatcttgtatgtacttcatcttaatatgatgtagggactcccaggccctctggtgtacgctttttttttttttttgaaacgaagtattgctctttcaccaggctggagtgcagtggtgcaatctcggctcactgcaacctccgcctcctgggttcaagtgattctcctgcctcagcctcccaggtagctgggattacaggtacatgtcaccgtgcctggctaatttttgtatttttagtagagacagcgtgtcaccttgttggctaggctggtctcgaactcctgacctcaggtgatccgcccacctcggcctcctgcagtgctgggattccaggtgtgagccactgcgccgggctggtgtactcattcttggttgaagttgccacctcctggtgggtgtcccttgctgcccaggcccctccctacattatctctggaccctttttccttcgcccttggctcctgcctcatttctgtcctcgatcagccctgcatctctcccagccatcacagctttccaggtttctctttcccattcaatgggcgcctctgtgcaacataaaaaacatgccaagtcccagcggtgcggagttgtttggggggtgtgtatgtgtttccttcttattttcagtttgctctctgaaagaaaaaaaataaaaataagtcataggtacttctggagcccaaactcgtggccttttagatttcagaaaatattaaatatctctttcttgcatttatataaataaaccgatagcctaggatgtttcgtatcaaatgtttaagtcttttcgagaaccatcaagagctttcaagacccacaaacagacggcctgattcctggccaccttccactgtgcaagtcttgcctgggttggttttttgaaaatggtgttcatcactcagctgttattgcctggctctgcggaggaagtggattctctttaaacatgaccccctccccttaaaagagaaaaacaggataaggtccagaacaacctcggaaagttgagggctgagggctaaaagaccgtgctgggtaacaacaccagataggaaatgttgagctaacaggactccatcccctggactgcggcaggaatgtgggtcaacatttggaaacctgaaaattcccccacggaaatgactccaagggacagaccgggattggtgaggaaagggcacggctgtttagaagtagctaggtttcctggatatctttatctttttccagtaccggggtagaaaatgtgagactgccgcccgaggcgtgttgacagtggtgcctgtggtgtgatattctctttctttctctgtagttggaggctggcagcgaagaagatcgaaaattaaacctcaggtaagcagactttcaattcttgttcctaagtctttctcccaagcaggtaaggaatgctcttgttcctctcccaaagggaaaacgttcaaaaagaatatgccaattttgggctgggtgcggtgggtcacgcctgtaattccagcactttgggaggctgaggcgggtggatcacaaggtcaggagatcgagaccatcctggccaacatggtgaaaccctgtctctactaaaaaaacagaaaaaattaaccgggcgtggtagtgtgtgcttgtagtcccagctacttggggggctgaggcgggggaatcgcttgaacccgggaggcagagtgagccaagattgcgccactgcactccagcctggcgacagagcaaaactccgtcttaaaaaaaaaaaaaaaagaatatgccaattttttagtgctttagaaattatacctaaaacacataaaactgaagtgctttaaaatccatacatatgtctagccactttaataatattatataacgcttggaaaagaaggaaaataattgccattattctaccacccttacattaccattttgagcattttttggtaacttattattttctaatagagacaaggtcttgctgtgttgcccaggctggtcttggactcctggcctcaagacatcttcctgcttggcctcctgaagtactgggattacagtcatgagctactgtgcccggcctaacttgagcatttttatgtattttcttgcagactattcttctgcttaaaaaaaaaagtaataatcatgacactctgccctcactttttcatcttgcttttggtaaggtgttccttttgcggtaagcactttgctgatttgaaacagatactcaaccccctaaaggtatcaattcagggtgctttaattgtgcttatgagaaatctttagctctgctcatttaaaagattccaagatggcagtcctcagctgatgtattcactaatggacaccaaaaacatttttgttttttctttgccaaaaattaagttctgcctttgtttgggtgttttgttgatttatggaagattcagccctttgttatattaatatcatgtattccttcataccaaggagccagtcttaaactctgacctcatagttttaaaaaaagtaaataaattttcaggaatattgttctttaaaaaaaaatagtctgttttatctcatgaggggaaggaaaattaattggaaaaggaaatatgtgttcagaaattggggtcaaccattcattaccgacagcagggtgttctggtcaaactcatatgcagaactggtagaaatatgctcagcttttctccgatgtttctgtgtgcttgagtgaagggaggggaaatactcacttttattacggcacacatgatttctaaagattatgtgggtagggaaacactagcctgcaagaatcaaagagattccttatttctgggtcctcgctgggggacttctgctgggtcctcacttttaatgttatgctcaagatacaggacacatttgctccatcaccctggggtttttgattggtcaggtcagggcccacgtcagggttcccaggctagaagcagctggattcccaatgggggcagtcatgggccgagttgcagatcagactgtctgggtggaagcagggaggggtggagtggaagtctggagactgactgtcgaggaggaactgaaagaggggcttgcccacctcacagcggctcctgtgggcgcccagctcccttccccccaaatctcccccagatgcctgcccccaactgccctccccaccagctcctctctccacctgttctcctccccaaaatccccttccccagatccctccctccaggttcccctcccccgactccccatctctcttccccactcccctcccccagatcccctccccaagcttccctcccccaaatcccctccctagatcccatccctaaccatccctccccaatcccctctcccatctcccctccctgaagtcccctctctgagctccccttcccccagctcccctccctaaatcccctccccaagttcccctccctcagctcccttgccccagatttcctccctagatccccctccccaagctcctctcccatttctcctccccatctccccacccccagctcccctccctagatcctctccccaagcttccctctcccagatccccttccccagctttcctcccccatctcccctcccccatctcccctccccaagctcccctctcccagatctcctccttagctccccatccccacgtcccgtcattgagctaccctccccaagcccttttcccccagctccctcctggagctcccctccccatctcccctcccccagctccctcctggagctcccctccccatctgccctcccccagctccctcctggagctcccctccccatcttccctcccccagctccctcctggagctcccctccccatctcccctcccccagctccctcctggagctcccctccccatctcccctcccccagctcactcttggagctcccctcccccatctcccctccccaatgctcccctcccccagctccttcctggagctcccctccccatctcccctcccccagctccctcctagagctcccctccccatctcccctcccccatgctcccccttggagctcccctcccccatgctcccctcccccatgttcccctcccccagctcccttctgggctctcctccccatctgccctcccctagctccctcttggaggtcccctcccccatgcctcctcccctggctcccctccagccctttcttggggttggaatctcttccatctcttgtctctctcagggctgttgttgatgagtgagtactgagctctgtcacttagactgtctttggggcaaagagctatttttattttttagttacctttaatagcttatagcatagtgttttcagttaataagaacttataaatagcagtgacatgaaaatttgtatgtggacctttctcattagtatttaaccttttttaaaattaaaactttttatttttattttttagagacagggtctttgttgtccaggccggagtgcaatggtgtgatcatagctcactgcagccttgaactcctggggccaagctatcttcccacctcagcctcccaagtagctgggactacaggcgtgcgccaccacacctggctaatttttttaaatgtgttttgaagagatgagatcacactgtgttgttgaggctggtctcaaactcttgggcttaagtgatcctcccacctcagcctcccaaagtgctgggattacaggcgtgatgacagtcactgcacctggcccttttcttgctaataaaaggtccctttctcttctagttgggagctgcaggggaccttacaaagggatgggaaataaagctttggcagctttccatattctcaaaacagcccttggaggggggttttcccggttggtggctgaggcccaagattggaattgggaaatcctgtatttgaagcgagacctctaatgccaagttgatcctactctgccgcctttctggggaccaggttagtagtactgttgaattagctgtcttggacatacaggtgagggagcatgcctaagtccactggggtggattagcagcagcgccagggccagcaccaaggactcatgccaactggtggcaggtgcctcctgggatgttgggtcattctgaccaccaccgagagtccttccgtgccactgtcagcaggtccccaacaccattgtgaccacagggagaccctgggctggagttggagacctgtgttctcatttagggtgggatgctgggctctgggcttgtccccctaggtgcccttttaaacccctcttcagccaccttgacgtcacactcacctttttaggcacaggacaccatcctgcctcctagccttcctcgctacacaagaaaagttgtgtcctggtttaagctttgactgaaactcattcacatccgtgtgttaatttgcattttcaggcctcttctctctgaatctctcctagagaagaaaattatggaatagttggttgctttctgtttggggtcaggagaattagggagagatttctctttgtttccaatggatcctgaaggtgagctgccatcacctcatctctaggaggtgctgtagggagaaaaactggaggtagcagggtatttctctctcttttctcccctccgtctagccttaattaatagtttcatcttttgggtcatcgaaaaagtcagctctgattcatccatatccaataaattgcagggtcacatggatcgggtcttccgagccacctgccttctttttctcaagttccctggtggcgcctcttcaggtcctcacatctcttctgtcccgtcacagaggaacacctcagacccatcctctctaccttggcatatcaccccctggtcccttgatgcttcttccttctggtcctcggagtcttttctgagctccagcgtcaccggcgttggtggcctttccaccctcccctctcgcatgtgccttttccagtccattgggactactccctgctcccccgtcacacacgttccctaggccagttccttttcacctggctgtagtcctcatgaccagctaaaagtgcgcctgccccagatatttgtgatttccctctcttcagagaaagcagggagcccctggcatccctatctgtgacaggtgccacacccgccttacaatgcaggtctgtgtgcccttgttgtatccctaactgctctcaaatcccttagtgacggcctcatttctctgcctttgtgtagcatttaaacagtttaaatggctgggcacggtggctcacatctctaatcccagcactttggaaggccaaggcgggacggatcactggagctccggagttcgagaccagcctggccaacatggtgaaaccccctttctactaaaaatacaaaaatcagccggcctggtggtgcgctcctgtaatcccagctactcgggaggctgaggcaggagaattgtttgaacccgggaggttgcagtgagccgagtttgcgtcactgcactccagcctgggcaacagagcgagactctgtctcaaaataagtaagttgataaaagtgaacagtttaaatggatgaacctttgaccctgcagtaaattccagacatgtaggagaaacagccaggtgtagagggaaggcagtggggttctgagtcaggcagacctaagtttggcatctggctcctgtgctggtggctgagttcctttacctttgtgtgttcttacagctctgtgggtctcaattgttccacctataaaacagggatgacactgtgacctttcagggttgtggagtagttgtgtgatgttccttgtctaggccaggcccagtggctcacgcctgtaatcccaatactttgggaagccaaggtgagtggattgcttgagccccgtagtttgagaccagcctacacaacatggcaagaccccatctccgcaaaaaaaatagaaaaattagctgggcatggtggcgcacgcctgtagtcccagctactcaagaggttgaggtaggagaatcacttgaacccaggaggtcgagactgcagtgagctgagattgtgccgctgcactccatcctgggtgacagcaagaccctgtctcaaaaaaaaaaaaagttccttgcctagaatcaggtccacagtgggcttggttgctgtgctcggtcttcacaaagtattgctgatgtgcagtgttagttcacggcagaggagaattaaaggggccgactcctgcaggtgctgggtccaggcctgagagggcgcccaccatggatgccctttgacttgaagcagccttcctcctttacccggctacattcctataagatgcaaataagaatacagacttggaggaagcagtgttgtaactcagacagtatttctgaaggccttctgggaagtgtctcaagaactgatcatctcacacccagcatgcagatgattgcagcagagcagtatagatccatttccctcgctctcccctgccttctgcatgtgcaggctgctgctggccgctcgtagtccctctttggaagctgtgccgttcagactgtgggaattggtgagcagatggccctgctggcagcagctcctggctcccttgccatcccgggagctggctcagtctggcatgagacataagtagttgtgggctaggtaggacactggggagataatattgtccccagggtgtggatcaggagtgaagttttttttttttaatccagcatttccaagtcaattgcgggaacgtggtcattagaattattataatttgctcatttgtgattgcctgccctagcaaaggtttgggccagagcgagctgcaggattttgtctcttctgttttatttggtttcagtggtaaactgtgaactccctgactcctctgcctttctctccgcactcccttccccttttggtctccacttggaagtcccccagggaccccattctccctacagccttttgaagtgtggttttgccttcaccccctcccctacagtgtcagagtggatgggggttggcatgtcattgccctgcagaccatgcttcccctcttcattgaacacccctacttttgcacctgtccacactctggggttcctccctgcccttggcagtccatcttagcctgggctttattgtctttgttgcttgtctgtccagttaagtcctgccaagaggtgtcatgcaccccgtgcatccaagttctgtgtccgtactggagatggatgtgtgcataggttactgtatcagtcattgcctgctgcatgacaagttaccactaacttaacagttaaacaatatatgtttattttgtttaaatttgaaatggagtttcgctcacgttgctcaggctagagtgcaatggcgcaatctcagctcgctgcaacctccgcctcccgggttcaagcgattctcctgcctcagcctcccaagtatctgggattacaggcgcataccaccacacctggccaattttgtatttttagtagagacagggtttcatcatgtcgggcaggttggtctcgagcacctgaactcaggtgatctgcccgccttggcctcccaaagtgctgggattacaggcatgagccatcatgcctggccagccaccgcacccaggccatgtttattatctcacagcttccatgggtcaggaatctggacacggtatagctgggttctctgttcgggaactcacaaggcttgctggccggggctgaggtcttgtctgaaccccagggtcctcttttaagctcacgtggttcttggctgaattcattttctttttttttttacttttttttttttttttctgctctgttgcccaggctggagtgcagtggtgcgatctcggctcactgcagcctctgcctcctgggttcaagtaattctcctgtctcagcctcccgagtagctgggactgtaggtgtaccctgcaaatttttgtcctgtctcagcctcccgagtagctgggactgtaggtgtaccctgcaaatttttgtcctgtctcagcctcccgagtagctgggactgtaggtgtaccctgcaaatttttgtatttttagtagagatggggtttcaccgtattggtcaggctggtctcaaactcctgacttcaggtgatccacccgcctcagcctcccaaagtgctgggattacaggcgtgagccaccacgcctggcctgaattcattttcttgcagctgtggagaattcgtggtgcttgcttcttcaaggccaacaggagagtctgcttctgtagggtcttatgacagattgttatcactggaatgactgtcttaccgcctttaatgtgcagcacagcctaattaagggaacagctctcccatcttgttctctggtccctcccacattcaaagagaaaggctcactcgggtgcatgcacctagcagaattctgcccaccagtcaatctgtgtgtgttctagggatgcccccagtctaacatagaacacatgtaaacaagtaggcttccattcagcgttacagatgtgcctagtttggggatggtaaggggtgcctggtgctcatgggaagagaccagaaacacggggagcgagccttgcagagtctgacatcaccctggtaaacactggtcccctccactcagcacccacatgcttgttcatgctctgaggcttagtgtctcttggatttgcccccaccttgaacatgctggccttaaaaataaccgcccatgttgattcttatttttttttttctatgattttggacttagggagggatgggcatgggtttggctcctgtgtctgtcctttgtcacctcctaggctattatatgatctcgggcaggccttagtttcaaatggccagtatagtacacagcttgtagggtggttgtcagaattaaatgtgctcatgatgcgaaccccttctcccatagtagacattcaacaaatgcccctgcccgtacttccttcatggtaacagcttctgttgggaatgattcgtgtcttcctttttcttctcacaggcgtttttctctccttagtgtttccttggtgtttggtacttgctttgtagtatatgtacttaggtacagaaatatttcctgtaatgcaggactggctgcgtaatttgtgaagcccagtgcaaaatgaacatgggagagccccttttaaaaacattattaagaggctgggctcagtggctcacgcctgtaatcctagcactttgggaggccgaggcgggcggatcacttgaggtcaggagtttgagaccatcctgggcaacatggtgaaaccctgtctctgctaaaaatacaaaaattagccgagtatggtggcgcgtgcctgtaatcccagctacttgggaggctgaggcaggagaatcactggaacccgggaggtggaggttacagtgagctgagatcacaccactgcattccaccctgggcgacagagtgagactctgtctcaaaccaacaaacaaacaacaacaacaaacattattaagaatttcaagatggcaccaacagagtattaaaccaagcacggggcccctctgagcacatatgaagaagctggccctgcccactagaccgtgagccaccctagggacagggctgcctgacctcctgcctcacagtgcccagtttgccctggataggccctagaggtcttgtaagttgagtattgtttcctgttgagcaactaaaagtggtcttggactttcaggaaacaaaggacagagaaattcttcccaccgttgcctccgttgcagtttagtaatatcggtgctgttagatcagtctcaagacccctctgtcctcatctgtctgcttgtgagctattcattcaacaaatattttttgagctcctactgtgtgccaagccctgttttaggggctgggaatatagcaacaaacaaaataaaaattcctgctctggaagctgacattctgttgaggagacaagacagtaaataaaataaacaagcgcaataatcgtgtgttggtaagtgcccaggcgaaaaaataaagcagggatggaggagagaaaagggagcacccatactccactctgtgattgccttgtgtgcattatttcagttaatctttgtgaaaaccctgtaaggacatttgaattcccattccctggaggagaagactaaaccccagagaggtcagtggcctgtttttatttagtagtaaacggtagagctgagaccctcatactccatgtctcattgactccaaaacctgtgctcttcaccccaaaatccaagcactgtcttttcctcctccctatgcatcagaacccacactgggagacagaatggagtttatcagaagaaccaggctttgcagtccattcttcctggtgagccattagcggcatcactatgtgcttgggcaggtcccgtcaactccctgagctgtacttaaagcagggattgtcacgtatccccttcatgtgctgcagcccggagaacatccgggtggtaatgaggccagcttctgcaggctgcaggctctgggcttggaacttttgcacttgctgtcatcttgttgtcacaagcctgcaaagtagggactctcctcattttaggaaaccagttccacgaggctggtgggaggcctgagccagggtttgaatgcaggctgctgtgattcagggacctgagtcctgccctaacccctgtggccttgtaggtagtggcctcccattgactcccacttttaaacattggggcatatttaaacattggggtcattgtgctgtttggctgttccttttggtttaactcgggttttatttctgcagtttgttggaacgtttgatttgaaaatcagaatttgccttcaattttttttccctctctctctcttttcttctttttgagacagagtcttgctctgttgcccagactggagtacagtggcatgattacagctcactgcagccccgacctcctgggctcaattggtcctcccacctcagcctcccaagtagctgggaccacaggtgcacaccaccttgtatttttggtagagacagggtctcactgtgttgcccaggctgatcttgaactcctggactcaagtgatctgcccacatcggcctcccaaagtgctgggattccaggcatgagccactgtgcctagctatatatatatatatatatacacacacacacatatatactttttttttgtggggggggatggagacttgctctgtcaccaggctggagtgcagtggcacgatcttggctcactgcaacctctgcctccagggttccagtgattctcctgcctcagcctcccgagtagctgggattacaggcatgcgccaccacccctagctaatttttcgtatttttagtagagacggggtttcaccatgttggccaggttggtctcgaactcctgacctcaggtgatccactcgcctcggcctcccaaagtgctgggattacaggcgtgagccactgcacccggccctatatattttttttaattagaaaactcattctagaatggggacaaatgaggacagagacgtgaagagttaattctgtcagaacttaattaaacttttcattaaggttaacgtaaaacgaattttgctcagagtctagtaggtttcattaaactttcgaaacaccagtacttagacttcaaaagaacgcctcagggctctggtctccttcctgtgcacttagcacattgcgtgagcgtgcacgcatgcatgtacacaccaggaatgtgcgtgcaagctcagctcgtaggtagcagtgttaccagcgttcatcttcatgataaatggggcaaagctgtgagacggagtcagacaacctagggtccatcttgagaggcgtcatctgctgtgcaacctaaggcaacgcctcttcacttctctgggtccctgtctcctgctatgtaaagtgaaaagacaagattaggtgatggcctccaaatttaagaatgagtcctcagacccaccaatctagatctgtgtttatattgtgctgctcatcatttgctgtgtatttgtaactgactatcacgagttttattcccacggtgagagcaaggtcatgcgcttatgggggtctagctgggtcagggctatggtctgaccctgcagtggagaaaaccagccgggctactgagaggaagtgaccctctgctgggactcacctcctcctccgcagggcttagcctgccgcgtctgcccccaggagcagagccatacacaaagcagcgtccgtttagaaagaaagtactcgcatctttagaactcatctttggcattcattgttctgtggtcggatctctggatttagacagcttattagaaaattcctgagatgaggaggacatccagatgggtcatgctgcttcaaggaaggctgaaaatgagaaaccaggattaatcaaaataggattaatcaaaatccagaggagccattttctttttttttttcttttttttgagacagtcttgctccgtcacccaggctagagtgcagtggcacgatctcggctaactgcaacctctgcctcctgggttcaagtgattctcctgcctcagcctcttgggtagctaggactataggcttgtaccaccatgcctggcgaattttttgtatttttagtagagatggggtttcaccatgttggccaggctggtcttgaattcctgaccacaagcaatccaaccacctcggcctcccaaagtgctgggattacaggcatgagccactgcgcccagcccccgagaggagccattttcaaagcgaactgagcgattgggctggagggtgcgggggctcctgctttgtgggtgtagtcagtgtcgggatgcagggtgatgtgcttatgaggaagccacgctggccagcctgcagtgtgggggcagaattgcagtgagatacaagagactgccgcataaatgaggacatgccgggagagcctgcgtgtggtcagagcggggcttctggatggggcatcggccttgccacttagctcacttgcatgtctgaccctgggcccaccacctgccttcctcctctcagggccctcctgaggcctccagagagtcttgttctgtgtacagtgtctggccctggcctatacccagtggccatcattttcagtgccagcccttcctgccgcacttgttcccctccaaagaccaatgttaaccaagtgacacctaagaggaaaaacccagccttgacctgttttcctgcaagttcctctgaaacctgtgccaggcttttatctgggaaatatcattcttgagtgcctttacttttacagttttttttttctttcttttcttgaatggttacttttgaagctatttttagaaagactttgtttcagagaaggctgttcaaggtcctgtgttaggaaatgcctggtctctccctgtgcccacagaagtcattcctggtccaggcctggcacgcacttgccaagagtcctcgaggcgtgtttccccaaatctgggccccatcagaattcccacaggaaggggccttcagtgtggtctggaaagagccaggctggctgcagcatctggaaatcacttgtcacttccccagtggccaggcccacccgtgccacgctgtgtctgttgcagctgggagtctaggagtggctctttaggtctggagtcaaggccactgacctgttggctgcccctacagcaagaaggctccctaaggaacctaattcccaggccctggggactcctgaccaggccccacctcatgagatggaagggaaaagaacctcttgtgaaacaatatggtaatggaggtggtttttacttagctattggctttttccattcagcccatgtgtatttagtgcctaaatatgggttctttgccaaatgccagggattctgtgtggagtcaaaaagagtccttatccctcaggggtaatgtgtgttgtatctacagtagtgccctccaaaaaggatttgaaacaccttacaacattcatagagaacaatagaatgtaacattagtgagaaaatcgggacacgaagaaagcagaagaaaataagatgaagtaaggggaaggtttgtacatgtaatacatgacatagcattggtatggttaccagaatttggccacagatctgactttgagtttcctggtagtcaaagcaaagagagaaacaagaccaatctcttgattcttggtgtcctgaaaataccagcagatcagttcctcggaagaactcttcctgatagatacctgtggtgttcacaaggaagcccagcataatggatggacaagcaagttgtcttaacagggagagctgatgctgcatgcctatcccaccaattaccctgggtatttgtggtcttaagaggtgaggtcagcagcagcacttggtgccagagctgctggccgccccagcactgagacaggatgctgagtcacatcctgcagggctgcggtatcctggcttcgcgtgcccttcacaataggaggcctgcacgggcaggtcagcccctgctgttccaaacatgtggtctccgagcaggaaaatgctaaaattagatcttacgtggtccagagccgtgtatgtgagaggccctcaaaacctggacacacacagaccaggaagacctgggagagcagagctcttcatcgttctcttctgctctgggcacgaaacagggccacttctgttctggaaaacacgaagagggcaaacagtgctgaggcagggaaggtcttgcttggtgagggtaaaactatgcaagagatgaaagggcaaagtcatgaaatatgcccataccagtgatcagtaaaatcatctgaagcttttattacctaccgataaagaaaaattacaggtcgtgttttaccaaaatcgaattaagtggagatttaaaaaataactttaaaaaatttggctgggtatggtggctcatgcctatgatcccagcactttgggagaccgaggtgggaggatctcttgagcctaggagttcagtaccagccctggcagcatagtgagaccctgtctctacaaaaaaattaaaaaattagctgggggtggcagcacacacctgtagtcccagctacttgggtggttgaggtggaaggatcgcttgagcctgggaggtggaggctgtgctgcgtgagccgtggtcgtcccactgcactccagcctgggcgacagagtaagaccctgtctcaaaggaaaaaaaaaaaaattggtaactcgaaaacttgtaatgctcccaacacatacaaatgattaatactcaaggtcatggataccccagatactctgacttggtcattacacagtttatgcatgtaacaaatacttacatgttttccataaatatgtaaaatactacgtcgataaaaaattctcgttaattttgagataatttccagcttacataagaattgcaagtacagtgaaaagaactttcttttttgaaccatttgaaagtaatttgtcaacctgctactccattacccttggaatacagaccagggcattctcccacagaaccgcaacacagccatccacgcgggacactgactctgatgcattcccaccgtctagtcctctaaccccattcaagagtcaccatatgtcccagcgttgtccttcataacaaaagatccaattcaggactgcccattgcatctagttatcctgtctcttggctctcctgcagtctggaaccttcctcagtctttctttgactcttgtggcctggattttattttatttttttattttttgagttggaaactcactctgtcgcccaagctggagtgcagcggtgatatctcagctcgctgcaacctccacctcccgggttcaagcgattcttgtgccttagcgccccaagtagctgggattacgggcatgctccaccacgctcggctaatttttgtatttttagtagagaatagggtgttgccatgttggccaggctggtctcgaacccctgacctcaagtgatccgcccacctcagcctcccaaaatgctgggattacaggcatgagccactgcggtcgaccatgacctggacatgtttgtgcccagtactgtcagtttgcagagtgtccctcagtgtgagtgtgtctgatgttcttgtgtgattccaccgggcacgtgtatttggctggaacatcacccaagggatgctgcgtcctcgttgaatcccataaggtggcacttgatttccttttgtcccactatggtgacattcactttggtcactaaggtgggttttaccaggcttttccactgtacagttattcttttccccttcatcattcagaagcattccttggagagatactttaaaattatgttaatatcctgtctgccatcaatgtccgtttcaattctttgtatttttctgttttattcagtggtttataatctgctcttaaattgttgacatccttgctcaaattgtccttgtggacagttagggccagtgggatctcatccaggctggcttctgtgtccctttgacatgtccacatcattctttaagtgctttcttgctttctggcaacagatgctccctacccacctgtggaatcagtcctttatccaaggggctctggttccttttagtggaaaatgaaatttaggagccaagctaggtctgcttattgctgttggggtgttgctaaccacaggcctctcaatgggcagaattagggaacatttgtatgtacgtgcatacacacacacgtgcatctatatttatttcaataggttgaaaactatgagttcagactggtaccttcaattctgatgcagcaccttggggttcattctagttttgtctctccatattcatgactcccattgtccctgaaatattaataaatattaacattatgcatattatataaacttaggtattatttatattatatagtatatatttgttaatattgattatattaatattaatataatcgattatattaatatagttataatcgattatattaatatagttataatcgattatattaatatagttataatcgattatattaatatagttataattgattatattaatatagttataattaattatattaatatagttataattaattaatataatatgtatatatgctatatatcataaatatattaattataaatattaatattaacattaatgtttaatatttcattccttgcctgtgagcagtctctgtctcccttgcagccccctccctgcacagatgccctttgcaccctgcttgccaacagacacctcagcttgggatcccacaccccctccccaactcagaagcttgccctgcccttccccgccaaatggtttttaggtctgaattgttgggaggagaagtggacttttttgagactgttttccagaggtatcagttcagctgaaagccagtgcctaagagcagaggtttcagagttacactcctgccttccccttcctgcttcccggctccttggtctcatgaacttgggcaggtgacttaacctccctgagcctcagtgtttgtttgttttgttttctgtttttttgtttttttaagacggagtcttactctgttgcagtgctgtggcacaatctcggctcactgcaacctccatctcctgggttcgagtgattcttgtgcctcccaatagctgggattacaggagcacgacaccacgctcggctaattgagcctcagttcccgtatgtataaaacactgagagatggacactggggaataaatgagttaacatacctgatgtgcttagcatagcgctcaacgaagatgttattggtgttacatttattgatgtccactgttttctgggcactgagagggatcctgagacagagaagtcataggcctagctctccagacactcaaggtgatgtggggaacttagctgctgttgtgttatttgaagcactcagttgtcaggaagacctgacctgacctccaggtggctttaactcgcacgtggcatgatgctgtgagtcttatttgccaggttcaacctgtgtgtggggagtgcccagtgtgcccagggcacagagatgaccagggtgagttactcctggaatactgacttcagagaagagcacagcttggccagtgtatctaccagcacttactttcaatctactgtatgtcaagcacagagggagatttaaaaagcatgtgcatcctggccctcacatcccattgtgaagttaaaatatactggcaggaagatggcttcaccactagttagtaaataagtgggtcagggaacacgatttggaaatgagggaacttgggttcctaggttcctatcactaagggtggtctttccttcagtatccaaggggattggtttcaggacccccgcctttgccgaggataacaaaatccatggatgcttaagcacccgcagaacccactaattcaaagagttcagcatccctcaaatactgtattttctgtctgtagttggttgaatccactgatgaggaacccgcggatacagaggaccgactgtatgtgaccttgagcaagtgacttaacccttaagcctcagtgtcctcacctgcacagtaagaggaggtgctagaagatgttgaaagggaggagctatagctcacagcgagggccacaagagaaagcttcctggagaaggcataaacactggaagacaggcatgacgtcgggaggcagatgggaggaaggacaccatgagccgagaaccacagtaggctttatggggacagtgctatagctggggatagaacagagaatgcgaagcatggagaacagggggaatagtgcgagaggtaatacaagaatggttttttattctgaaatactgttttctaactatattctaagcccctaaggtcaggacatagcagatgaatgaaatttaggttaacgacatacaatggctaattgtggcaacccatagagagttagcacaagaagtttggactctaatcaatagatgatgtcacatggctaaaagttctggggctgggaaagaatgtcatgagagcaatggttagcggctgtgcagagtgggcgagaggccagggaggcgcttgtcctgattcttctcaccaggccaaaagcttccggagctctgctgtcctataccacagctgatagcctcatgtagctaattaaacttaaatttaaattaactaaaatgaaataaaatgacaaacccagtttcttggtcacacttactgcatcttaagtgttcagtcaacacatctggccagtggctcccatactagacagagagtgggtagagaatacaacagccctggccttcagggacattcagagaatgcagcacagagccgggtgcaccgtggggctgcttggatgtcgcctggctcacgggggtgaggagggccagaactgggtggtgcctgagagacctgaaaggaggggcctctgacaaagttaggactcggtgacaaatgactgtggtatggggctgcataccatagacagggctgagaacctgggacagtcgggataatctcttctcggaatttttgagctgtctcagaaacatttccttcatgtgcctgttatttctggcgtgtttggctgtctttgctgccatagcatttcccgcacagtgcagcctttataccttctgccctcgtgaaggggcttagatcctggtagagcagatgatgcttggaggaagatgcattagctccagcttccatggggcctgagggctcttggggtcatcagggaactatcttaaaatttgctaaaccaagccaagacacatcacttgctgtcttatttagggagaaaaaaaaaaaaaagcttgcttttgcgagctcgctggtcagttcagctgcttgccgctacccgttggtttgaaggagagctgtgtagctggctcagagaatgtctcttactgtctgaaatacttttggacattccttctctctgagagaagcctacgccttctagccaaacaatacatgttccagcagcaaagatatttgtaatgagccctgccagcattccttgtctgtgacccctttccctaagtataacgctctgcagagctggaatttttctatgctcagcattatgtgtttaggggggtacaatttgggagctccggttgacaggtgtgtccctaaagttacttgttttcttaggctctgaagagtgacatttggaacgaggccctgccatgttgcactgcaaggcccacagtgaagaagaacgagaccttggcccaactcagggtctttgtgacttttaaacacgagttccaaatgagggaagaacctgtgggagaaccatggaaagaattttccatccgacctgcagtctttagctaatctctctccaaatggtgaattttcgatctcctttacatctttatcaacttcactttgctaggcctggggttctgaatccatccagagcctcactgagagtggttttgaggtcagttgattagctttccacgttgctgctattgctgcaggtcagatggtgctgctttctgacctatggattcttcaggaagagcaccgaactttttcagccccattctacctcttattagccagatgaccacagacaagtcatttatcttctcccagtcttggtggtttcattttcttttctttcttttcttttcttttgggaggcgggggtgggtgggacagagtctccctctgtctcccaggctggagtgcagcggtacaatcttggctcactgcaacctctgcctcccgggctcaagtgattctcccacttcagcctcccaaatacccgggactgcaggtgcacgccaccacacccagctaatttttgtattttttgtagaggcaggattttgccatgttgcccaggctggggttgtttcatcaggggaatgggattgtaaaaattaagtggaaaaatgtagggacaaactctctataactagaaagctattatttacatatttaaaacaatatatgttgatagtataccaggcattcaggtgctgagaatttgtgatgttgacagtgcgatgtctcaaccacaagcatgaggtttgtttcttaggtttgcacattctgaaacttgaatttgtgagttcactcagggatgatcaagttctaagaaaccaatttacgctaaccaaacttataaggaactgatatataaagcacaatttgtaaattgaggtttatgaacccacaggggggccttttatgacagaggccaaatcctcctgggttcacaataaggtacatgtagcataatcatcttactctcctgccccttatgcctctctgtttactgatccttcagggcctcgcaggcttcatttcttccagggaggcctccctgaacccctgtgtgtacgtgcatctgcaccttccacctccttccaccgtggaacttgctgccttatatcgaagttactgtcctgtgcctgcctggccctccagtgtcactccagaccaggtgtggagtggtctgtggcatgggtggaaaccgggtctgtttcacttctaaattctcaggccttagcactgaccggacacaatagacactcagcaaatacttgttgatcgaaaccgaattaacagagcctcctttttggaatgctcgttggcacccatctttctatgctgacagcattacattagttcctttttctcctagaattaccatcaagttcgctggacaattgacagtcccctcagtaatcaccatgcagagtggggtaccattgagggttagttctatccagggaaaagtgattccgtttgtctcagcctgtcccatcaatctgggaccctttacagggcctcttcttcaggctcatattctctacttttttttcgagatacagcatcagaaatcctaaatttgtactatttaactccctgtttccttaggcataaattagtgtaataatgcctgtctggtcttccacacggttttgtgaagatcagatgagttgacattcaccagaatgctttgtccacagcagagtttgtcaaaggtctgatctgaggttggtctcggtggctcacagctgtcaccccagcactttgggaggccaaggcggaacaatcgcttgagctcaggagttggagaccagcctgggcaacatagcgagaccccatgtctgtttcacacagcacaggtctgatctgtttttgctttcactgtcatcatttcgtattgtcatgatgcagcgtctcccttagagggccagaagaacattcaggtctctgaaagtgtgtagtagaagactagcatctgttttactgcttccaaagagagtattattttgtttttgaccctagcatgacctccctttattgcacctaatcacatcacccaccttctgagagcaccatgcctttttgttggtgttaccttttaccagcagaaaacatcgacgtgtacctatgtgagaggtatctttatgaagcccatggagaagactgttttctctgtgtcttctgatgttgtttgtttgtgtgtttgtttttgagacagtctcactctcatccaggctggagtgcagtggggactccaggatcacaatctccactcagtgcagcctcgacctccagggtacaagtgattctcgtgcctcagcttcccaagaagctgggactacaagtgtgcgtcaccacgctcagctaatttttgtatttttagtaaagactgggtttcaccatgttttccaggctggtcttgaactcctgacctcaagtgatccacccaccttggcctcccaaagtgccaggattacaggcgtgagccaccatgcctggccatgatgttatttgattctgaggtttttaaaacttggctgtgcatcagaagcaccccctggaactttctggagacaagatctgtctcccaggttggagtgcagtggtgtggtcacagctcactgtagccttgacctcaccaggctcaagtgattctcccacctcagcctcctgagcagctgggactacaggcacacaccaccaagcctagctaattttatttttatttttttgtagagatgggatcttgttacgttgcccaggttaatcttgaactccaggggtcaactgattctcccactttgacctcccaaagtgctgtgattacaggcatgagctaccatgcccagctccctggaactttttaaaaaagtagatgcccaggactcatcacagaccttccgaattagactctgctgaggctggacctgggcatgaatgtgttttaggagtttgataggttgtttcaatgtatgaccagagttggaattcaggggtgtttggatattccatactgtgatgtttctatacctactatttttgttcttcaagaaatgctgtttctatgcagcagggcagacacccagatcaccagcacatatacccattccttaaagaggatggctgtctttgcccttatcagagcttgggctggcttggcttaccctgtgctccatgctctgcaaatgtttgcctgtttggatgaatgaacagaaccctgtaaggaattctaggggttaattctaggggttaatcagagtatatatggtagaatgtaaattggaacccagaaatatgaattcccagaccattgtttttacttttgttccccaccgcccctgcccaagacagtgtctcactttgtcgcccaggctggagtacagtggtgcgatcttggctcactgcaacctccgcctcctgggttcaagtgattctctgcctcagcctcctgagtagctgggattacaggcatgcaccaccacacctggctaatttttgtatttttagtagagacagggttttgccatgttgaccatgctagtctcgaactcctgacctcaaatgatccacccatctcagcctcccaaagtgctgggattacaggaatgagtcatcacccccagtttttacttttcttaaaccttaaagcgcggcagtcaccatgggcgttgtccatgctatccctggtgattctattttggaattgttgacgggcttccttcgtttgtcatatggagaaaataccttaccctgcagaactgccagagttcaatgacgtggcgtagctaagtacctcctacagccttggccacatgggagatcctcagtaaataatagtcctgttgatgagaaacttaccttgaaagcgacttcttggtcagcgtggctgtgtggtttacagaactccttagcctctatgcagtgcagaagggccaaaggatgtgtcctgtcccccaactatgacggcagtggtgggtaggataaggctgtgggtcccctgcccttctgatttctacttgggcagatggaagaaccccggcacagtctcgtcttcctggagttctgtttgcttgaatggttccttctctctctttcccacgcatgatgcattcacacactgggaagaaggacggaagatgtgatccacattctgacttctcagtgccttagtggctttgccattaggcacctgggcaggcatgagcggatgtgaccgcagcataatggctctgattttcattctggatgagtagaacagctgcttaacaggggttaagcaggtgggcgtggggcagatagatgtgagtccagccccatcttgtagagatatgtgctcctaggcaagctggggtttcctcacctgcaaaaccagaatcatggtaatgtgtgtttcacttaatccgtagggaggatcgcttggtcacttgtgagccgagggaagagaagcccctactcagtgctgcttccttcaggaattgttccagaagtcaccagttaaatgctccctcctccctcttgtaaaccctagccgagcccctttcttagggtacttattccattctctcctgcgtcatggttattcacatcctgaacttatttctctcactgaaagaaacgctaaaaacacagctcttggctggcttgtgcctggagggtttgggatcacacctccaacctttaggacctttgcagcctgacctgccttgggcaccgtgcgtatcccagagctcctcataggtgtgcatgtggtcccctctacctggcgtgtcccctcagatagctgttagcatgactgaagaattttcaggatgtaaccgtgctttgagtacgcagaataactaactgcggcagctgcccacgtcaccgtcaccgttgggtaaatggatgctgatttgaaagaaagagtcatccttcagaatgttgatttgaatcggaagggggtcttgttgcttggggttggttccttggggccagttgtttgccctcacaatgtcgaatgcacaccccggtgcttgtttctccggcctacagaaaagcccgtaggagtgcagtgattagaggaacctcagctgttttgctgaatggccctctttcatcaggatgtgctgggacaagggcctttttcagccaaaatatcagaggaagacaagagttccacaagagccatttgcttttcgggtaggactctgaggaggagttggctccccagccctcgtggaagcactcggcagcctcctggcttttcctgatctccatagggagcagatggccagagctcggagggcagttgtagggagcgttagagatgtgagcactgcagccacgaacctcttttattttaccgacttctgcatcttccttcagccaacccactgcttctgctgtccagaggtttccagctcaaattagtacgtatgaccaccctgattactggtttcctgccatggcttggtttctggatgacactggctgtttatattttgggggcctggggttttttgaggagcattgattgaggttttttgtctgtcttcaatgctttggagaaactttaatcttatgaagcttcccgaatggcagtaatcagtgtccgagaacagatctgtgtggtggagataaaaacattccagttggcgggtagagagggcagcggctttttttttttttatccctcatcaagatttttcttacagcggtggaggaagacatttccgttttgtctgtctgcgtctgaccttttgtaactttagtcactccttttaggacactcagatcttttgtgagaagagtgacttctgggtggctgggatggatggcttgtgggtttgggcttcctggccccagacacctggtaaagtgagcgtgccatcaccaatgtggatttcttcatggacttccccagtgggacactttgagggtctgatgaatcgggagcctgtgcctctgggcatcagaagctgcagtcgtcagatacagtattcaggtcagccacgcagagggcgcatgaggctctgggcccagagtgagctcagaagagaagccaggaagccgggtcacagagactttctgcatcttgttttcataaatcctgtgactgaccatgctctgcggcctcccaccccaccccccacccggagagtcatgtcgtgcggtttcctctggctgtatctcctgactgtatttgcaggacgcagggtgatctcacagcttcgggataatgcgctgctacttgggcttccctgcagcttccagtcttgctttttacagtaaatgcctgttacttgattgtcgtgggggaacagaggcagagtgttccagggccccaatcaatgccatcctgacttcatgcgtagagcaggagtccctgattcttatcagtgtaggaacatggaggaggaacagctggccttgtaagtgatcacagagtgaaaccagcctagtctgttgcattgttcctttttttttccaaaggaaatataagggaaaccaaggggaatttttgctcatggtttccaaggcaaaggtcatcgttaatggttggctgtttccagcgtgcttgggtttctggtcagtatgaattttttttttttaatctcatgaacaaaagcagttgatgttgtctcgaaaagattttcccagctgcttcgatgaactgatggttgttttaggtttcatgagtttggaacctctcgcatagctgtttcagattttgatgagaataaatagtaaatgatctgtgtctaagaacagttctgaaaacatactcagctgtgagattctaaggaaggagagagtgacaagctttgcaggtggaaagggttaggtgattctgcagcctgtgaaatgagatcggccagatggatgctaaagagctttttacttcctatgagtgagggtgagacagcaaagaaaggctgcttctcgtttctttcgttatttataatcctgagctcctcaacacttgaaccttgcagcacaaatatatgcctgtgagagggtggaaaggatgactcggcagtgcatctgcagtagtggacaaaatgctgttagatgtcaagtattggtgtcacaagatatcgaaaaccaattgcctggaattcagaggactgaacaagaaggcaaaactaagtcttcttacttaatatttgagcagtcactatttttagcatgagcatttaaccagaaaaactaacagattttattgtggactttatatcatagaacataacagtcttcctgatctcaggagctgctgattggaaatgctagttcctgtggcattttcttggcacccagagtcatactttagactttgctgagttttttattccagaattcgaacgtttaactactaacattagatgtctggggcaaaggtgatcttgctttcttgtattacagaaaacatcttcgtctttctgtcaggaattgatttacttaatttcaaggttctctttaattagaagactgctttttcttagggatttttccttcaaatcatgtatatgttcattggttgttcaagagcgaaatttttatagttgcctacaatttgaactgtgacctccttttatgaaattattaagattagaatgttctttttaaattatatagtagtgttttatattattttgagaatcaaacaaaagtagatgttttaaaggttaatatatgtttaatatagaacatttggaaaatactagaagataatctattcctcctcctcccccacctcccgcaaagccgttgttaataattttggtgtattttatgcataattttgagagttgatggtatttttgaacaattgatagtaattcatagctgaagcattcttttcttatgtcttaatttttgcaaaagccagacttgatagccaagtcatgaaagtgaaattaaaaataaaaacttttgatgtacgacggggtctcacaacgttgcccaggctggtctcgaactcctgggctcaaatgatccttccaccccagcctcccaaataaacattttttaattgtaatttttaaagttataggtagttataaatgttattgctagctaaaataacaaaggccaaagattcattctgctgagaaattcattgggccaacttgaggttttcctcaagaatagtggacaggacaaccttgactaagttaaatcacaagtcagtatccacccacttttttctttctttctttctttctttttttttttttgagacacagtcttgctctgtcgcccaggctggagtgcagtggtgcgtggtgcgatcttggctcactccaacctccgtccctggggctcaagtaagcgattcttgtgcctcagccttctgagtagctgggattacaggcatgtgccaccacgcctggctaatttttgcatttttagtagagacagggtttcaccatgttggccagactggtctcgaactcctgacctcaagtgatccactgccttggcctcccaaaatgctgggattacaggcttgagccacccggcccctccccacttttcttaaaatgcaaacaactagtgaaagtgtaatttcatcttgtattccatcaagggaagtcaccaagaaacaatggagttgttaaaagccagagagttagaagcagagatcaacagcaagagcatgagaattcacaaagtagactgccctctcctaatcagggagttgttctcttttcttagaaaatgttatggctgggcgtggtcacgcctgtaatcacagcactccaggaggcctaagcaggcagattgctggaggtcaggagtttgagaccagcctggccaacatggtaaaaccatgtctctactaataatacaataattagctggccatggtggcacatgcctgtaatctcagcttctggggaggctgagacatgagaatcgcttgaacccaggaggcagaggttgcagtgagttgagatcacaccactgtactccagcctggatgacagagtgaaactgcgtctcaaaaaaaaaagaaagaagaaaatgttatatgacagtgagatccctgtccagtattctgcagaaaggggccctggagagcctatgtagaactttgggtgttgtcacagaagcattattttgtcacgaaaattctccagcagcaagcttttagcaaaagcaaggtttgagaaaagtactacgtggaattattataaaagcagtttcatcctatttgcattttacatgccatttgtccacgctaaagctttttcccctgcagtaattctttgtccattttcctgtctgaattccggtctaactgtgctctggtcttatccttcccagcttaagtgagagctttttcatggtgaaaggcgcagccctcttcttacaacagggaagcagccctcaaggccagcggagtcttcagcacccccacaagcatgcaggtgagggctctaagttgatactcttacattggagcttcttttctggacagcagaggaaacttccattgttggtgatgttgctgagtttgaaggccttagacatagtggacgcaggtttgcagtgaccagtgcaggcagaggctcagatgctctctcttgagcagaccacgcacattttccaaccttttatgtcatgtctgtctgcgtcaggagtaaggtcagcagcatcctgctgggatgcaaagatttcctctctgtagtttatcagttaattgcaggctgtaagttacagcctgactttttaacaaatgcaccaaaatgaattatagccagatgtcgtccacttgaaaataaccatctggagtgctgtatacctaatcttgggatggatttctccaagcatttgaaaaacactcatttggagaatttcttgaagggcctttggctccaactctgagatagacactgtagtaggaagtcttgattctgtaatagtttgtttttaggaagtagacagaagtaatagggtgaggatcaaactgagtttaaataagaagtgcctactaagtagtaagactggttttcttaggagacttgactcagagctgaaggcagttagaaagaggaattcaagaaatgcttgcgtggccctgcatggtatctcacacctgtaatcccagtgctttgggaggctgagttgggaggatcgcttgagcccaggagtttgaggctgcagcaagctaggatcacgccactgcactccagcctgggtgacagagagagactctgtttcttaaaaacaataacaacaaaacacacttatggccaggcacggtggctcttgcctgtaattccaggatttgggaggccaaggtgggcagatctcgcttgaacccaggagttccagactaacccgaacaacacagtgaaaccctatctctgcaaaaaatacaaaaattagctgggcgtggtggcgcatgcctgtaatcccagcaaggttgggggctgaggtgggaggattgcttgagcccaggaggtcgaggctgatgtgtcaccacagccagctagttttttgtgggtgtgtatgtaaatgaggtctcactatgttgctcactgtgttgctcagtgagccacgattgcgccactgcactccagcctgggtgacaaaagaaaaggaccctatctcaaaaagaaagaaagaggaaaaagtgcttgcatgtaagtggatctttgtcgtaggtggacagcatctcagggcatttcttggagaggcagtgcataattgaatgtctgtgagctgagaaggcctttacctttcagaacagcagcaggtgaaaccaaccagctattgtggccagttttcttgtgaacattttgtttgtttaacctcaagtcattcagcttcattttagatctgagtgctcaggttagaattctacaccatgcaatttatagcaaacaccaaggctcagtcagtattttcacatactgatgttgatgatatttaggtctgttttaagcaaagaaaataactgtcctgtacaaggaggcagtgtggtttgtggaaatagtatttgttttgaagccaggcagacctgtcttctgatcctagttctccaacttactaagccgtaacaggtcgacttctaagcctcagtttcctagtctttacaatgggcatcaaatactggtgcctcagacaatatggaaatttagagttatgcgtgtaacatacctacctgtagtaggtgctgtatatatatatgggtaactatcattgttattacgatgacttctagtacaatacagctataaacagacccttcattctttttttttttttaattatatgaaaagtttttttagagacggatctcattctcttgcccaggctggcgtgcagtggcctgatcatagctcactgcagcctcgacctcctgggctcaagtgattgtccagccttagcttcctgagtagctgggaccatagatgcgtgtcaccacacccagctagttgtgtgtgtgtgtgtgtgtgtgtgtgtagatgaggtctcactcactatgttgctcaggctggtctccaactcctggcctcaagccatctccccacctcagcctctcaaagcattgggattataggtttgaggtgccatactcagccagattcttcgttcttgaatttgctaattattctgccctcttagaaatgtagctgttgttcatgttttaattgtaacacatatgacaaagcaaatgctcaagctctgctcactaagtgtcagatacctccttcctctaatccaaagactagaagggtaggatgcaagccaccagctggctgactcttgtgccctgaggtctggagtggacgatgaggtcggaaggcagaggggccgccagctgtccacagttggtctgtaaatgaccttgggacagacgcagactagacttacgttagttcctttttttccctagaattaccatcaagtctcctgaatgtaccagaggccccccagtaaccactgtgcagagctgagtacaattgagggttaattctgtccttggaaaagtagttcagtttgtttcagccagtccagtcaatttgagaccctttctagggcttatattctctgatttttttgtgtgtggatgtcagactggggtttggatttctgtctgtcagcagttccatatctcagcaaacaatcccactgaaagaagtttatctgtgtggaaaatgtccctttcatttaggcatttatcagacaggggtttgtttttgctttccccaatgcagttctgtgactcgggtagatggtgggagggcccaggcaggtgaagaaccagctcatggtcgttgtcgttgtgttgcattggtgacatgacgggtggaggaaggggctggggaggtctatggctttctttaatgtgaacccttatctccaaatcgctcatcataggaagcagggtcaacacagggtgttatacactgtggaattgtataactggagaggacagataagaggggcatggttcttttcttttttaaattttacttattgtggaaagaatgcttaattggcctgggtttggtggctcatgcctataatcccagcactttgggaggctgaggtgagaggatcatttgagtccaggagttcgagaccagcctgggcaacatggcaaaaccctgtctctattgaaaaaaaaagaaaaagaaagaacgcttaacatgagatctaccctcctggctagaggcacaaatttctaatgacccaattcctctctgagacaggaagtgcaatttggacatcatctgtccttctcccttaaaatgaaaaagatgcttttgcaaaaggaacaaacacaatgtttccttttggagcatttgagtgtgtaagcattattgatccttttggggttgtaattgtgatgtatagagtaattttttttcctttgtagagacagggtcttatcgtgttgcccagggtgatctcaaactcctgggctccagcgatcctcctgccttggcctcccaagtagctgggactacagatgtgaaccagaaagcccagctaattttttacttttctgtagagatggggtcttgccatgttgcccagactggtcttgaatgcctggcctcaagtgagtctcctgcctcggcctcccaaagcactgggattacaggtgtgagccaccacaccaggctgatattagcatctctacagatgaccctttcttcagaaagaaatccttgcagatataaagaaaaatgtgtaagctagagaaaaaaagcaaccttggagtcacacctgctacttactaattatgcacctcccttacaactttcccctccgtgaaagtgtgcgcttcttctgacagggtctctgcttcgcgcgagactcatggccagtaagagactttcctcactgcactccaggaacacctcctgaaccctggggcagctcagagaagttcagaagccgtccctggttactgcctgttttacatagtgaagaaaaaagagtacataatttttagcaagaaaagagaaaatgacagattggtttctattcaaattatttctctgggcaaccagcatacagctgctatctgtagagtcacttaaacatttccccccgcccccccggttatggaaataatgtctgcctccagtggaaaatgcagaagtttgaagtggggcctgggtggggtagcttatgcctgtaatcccagcactttgggaggctgaggcgtgcagatcacttgaggtcaggagttcgagaccagcctggccaacatggtgaaactccatctctactataaatacaaaaattagccgggtctggtgatgggcacctgtaatcccagctacttaggaggctgaagcagaagaatctgttgaatccaggaggcggaggttgcagtgagctgagatcgtaccactgcactccagcctgggtgacagtgcgagactctgtatagaagaagaagttgtttgaagaggaaacgtgatgctctgtcctttttctctaatgattaactcttagcaaatgccttacttccagccacagctgtcgtttctaggcaccccaacctgccgagtaacattggcttgaatgaaataacatttttctctaggcttgcctgtatttttcacattttgtatttggaaacctatactgtatgtatttcaggaaataagagcaacttttaacaacatgacagtaagctccatgtcacccatccacgtcgcacagtattcagagtggtgtaagagaaattcagacttgaagtttttgtggtgattctcctgtggtgtaggtagacaaattttaacttctcaatctttttccaagccctcaaagtcagcctttcagaggttttttttcctagagagtaggtaagagaccttttaaagctttctttattggtccaacaggtgatctgcctcaacatcttcaggtgatgatcaaccttctgcgttgcgaagacagaatcaagctggtaagaagcagtgagaatgtcaagttaaaaaatttttttttaatttttgtgagatgagggtcttgctctgttgcccaggctggagtgcagtggcatgatcttagctcactacagcctcaaactcctgggttcaagcaatcttcccacctcagcctcctggatagctgggactacaagtgtgtaccaccctgccttatttttaaaaaaattttgtggatatggggtcttgctattttgcccaggctggtcttgaactcctggcctcaaatgattctcctgcctctgcctcccaaagtcctggagttataggtgtaagccaccgtgcccagccagcaagttttaatttttaattgtgaaacctggtggggaaccattcgtgaatgataaggggaaaagcttttaggttacaacaaattctcaaattgtgcactaaagccaaagccaggttgactcctcagttccccagaggggcgggaggagggatgaaacaggtctccacggcagttaaataagctaaatacgaactttctttggatttcatgtgttcactgatttcttgcattttgggtgattcctctgagccaggcggcgtccctggtgctacagagagaaacgaggcctggttcctgctgtcaagaacttccgctttgtgttttgttgtgttgttgttgtttgagacagaatctcactctgtcgctctggctggcatgtggtggcatgatctcagctcactgcaacctccgcttcccgggttcaagagattctcgtgcctcagtcccctgagtagctgggattacaggcgcacgccaccatgcccagctaatttttgtatttttagtaagagatggggttttgccatgttggccaggctggtctcgaactcctgacctcaagtgatctgcctaccttggcctcccaaagtgctgggattacaggcctgaaccaccatgcccagccaagaattttctcttcatttttaactcccagagggaaaggtagaacactgaaagtgttgatcttgcattggagatgggagggaggcaccacctccaaaggcaggttagtgagagcatgtctgccctgttccaggcagtgcgcctggagagcgcctgggcggaccgggtccggtacatggtggtggtgtacagcagcgggcgccaggacaccgaggagaatatcttgctgggagtggacttttccagtaaggaaaggtgagtctgatgggctaggtgttcccttctgtgagggaggcaagagttgctgctggacaaagcattccatggtcccatatccatcagaggtgggagagggctgcgtcctgatggagagcctggggagtcgagccactgggaacactagggtgtgccatttcagctctctgtgccaggcaccgtgccagctccaggctgtgctctcagaactcagtcaattgagaggacagaaagttatgctgtttgcttagagaggttttacaccagctgctatagagtggggcaccttagccagaaatgcttcctgaaggaggtgacaacaacgccgaacccagaaggccaaaccagagtctgccaagggaagcagggagaccctctcaggcagaggggcccggggagaagtatggagattggtgggcctcgcctcagacacctcaccccacagtgatactccactgattcccaagtacttcatggcaggtcctagtcagaggcttgaagtgtagcttgtaatttcccactaactggaggccaagtaagttagagcattgaccccaagatgcgtgtgaaatgagggtggagtcactcccctgacatcacaagataaatgaatgcctgtgagatcattgcaaaacctggatttgttaaaactagattagattccctttattcatcattcattcatcgactcattcattaagcatatgatttatttgcattctcctgtgtatgaggcaatgggctaggcccaggtaaacaaagaagcaacagtacacacagttcttggcctcagagagcttctaagtgagcatggaagacagtcacaaccagataggagggagagagtgaccgagaggtgctggggttttgtgagaccacaggagggggtgactgttgagagcacctggcaggacctttctggcaggagtgaagcctaagccgactcttaacgggcaagtgggcagtcaggcgagctctagggtggaggcggagcagcaaggtgcatttgaggagcatttgaggcagaatcaacagcagaaaccagtcagggaggccgtgagtgtcacggtaacagtatggtcttgtcttgttcccatgagagcttctgtaagtcacatgctagcgactgagactttgatgcttgttagaaggagatgaataaaaaagggaggacatttcttttatgacatggcccccacccccgcagtacataataaatagcactatgagaaagtttcctgtgacacatgtagaagatggagttggggctggcctctgtggccttggggtggttgggaacctggggctagaagaacctgtagcataggaggtgttcggatgtgagctctgaagagccacttggagactggagggcatggtccattaggatggggtgccaccaggcaggtgctctcagaaatgcccagagccccatctatttggccattatctgtacggttctgaggcatagcggtgtttagtgtttgaccgtcttgcggttgtaattgttcttccagtgactgtctagcttttctgaatctttctgaggcagggacttccctcgcaagtgtggcctgttccaataatgctttctgatcccgaacggaaatcggcctcccatggcctgtgcccaatgtcttgatcctaaccgtgggagcagtgtggaagcccagtcctcctgactgtagagtacagcacacctacaaaatgcctctgtgaacatctcatttaaccccttcatccccctggggtgggtagtgctacctcagattttacacatgacagtcagaagctcacgaggctgcagtgattaccccagggtcatcccggttagtggccgggctgggacttggaggcagggcttttcctgtcgacctgctgaatgagtagatgccactcattctttcccagcaggctgcagctctcttcctgtacaccaccttgctcattcattcactcctaggtttatcatgtatggacttgctagctctttccctgtgccgggcgccccgccaggtgctggggccacatcagggagcacggcagacacacctacagtctcacagagctcacaggccagcagtcacgggcatgccttagatgcccacatgcgcatcccactccgctgctgcctggctggaggagactggcccgtgcgctcgtccgcaccgcccccatggcgctcttccttcccaccctctcctccctttgcctcccctcggcaccccgacttcagttctcccaggtccctctccctgtggttccctcgcctctcctgcatgctcttccctcaagttcgagtctctgcaccctctgagcaggagccacggcccacctgtgggcaccgaccccaaggccagggcaggtctctgaggttggagagggcggttgagaggccacccaagatgagcaggggcctgatgggaaccggaactaagcagtctttcctgtcgctgggcctgacacagctgccttctgtgcccagggaatcccgggggctgggaactgggccttctcctgcagctcccacattgcccgggcaccaggctgttgtcttccttcctggcttgaaaaaaagtccaggtccccgccagaagcctttggcctgctgagggagcaatgtacttgttttttctaaattccttccttgggattttatttttttattccccctgccaaaaaaaaaaaggaagagacaagcattacccccaaagggcatcttcataagagtccaacgcttctccagaaggcagcattggaatggcggctcctgcagcaggcttgcgcactctcaaagtttttgtttttgtttttaagatggggtctcactctatcacccaggctggagtgtagtggcacgatcttggctcactgcaacctctgcctcccgcgttcaagcgattctcctgcctcagtctcctgagtagctgggattacaggcatgcaccaccatgcctggaaagtttttgtatttttagtagagacagggtttcaccatgttagccaggctggtctcgaactactgacctcaagtgatccaccctcctcggcctcccatagtgctgggattacaggcgtgagccactgtacccggcctcactcagagtcttatatctgcatacgcatcctgggaagaccagagcagccatgccaccttagggttcaatcgtggattctattctcttctcttctttcttttcctgttttccctatccccttccccttcgcttcccttccctttcaccttcccttccccttcccttcccttcccctcccctcccctcccctccccttccctttccttccttttttttttttttttttaatttggagacaggatctcgctctgtcacccaggctggagtggtgaaatcaaggctcattgcagcctcaacctcccagaatcaatcatttctcctacctcagccccctgagtagccgaggccacaggcacatgccaccattcccagctaatttttttttatatataatttttaaaaaaatcactattgcccaggctggtctcaaactcctgggctcaagcagtcctcttgtctccacctcccaaagtgctgggattacaggtatgagccaccacacccgagcaggattatgttttcgattcggattgggaacattttgaatgccatgagtgtacaccaccatccacacatcagtgttttgccattggtgaaggactccacgatggggtcttggaacaggctggtctcctgcctggacctccagacccatctggcttctctgttcccgccatacaggccctaggaacttggagcctgctttcttcttctgcaattgctcccacccactttatcctttggggtcactcttcctctaaaaagattcagcttcccttactatgtatccctttcctgcttcccatgtatgctccccaggtggagacaagaggactgcttgagcccaggagtttaagaccagcctgggcaatatagtggggccttatctgtacaaaaaagttttttttaaaaagctgggcatagtggcatgtgcctgtggtcctagctactcaggaggctgaggtgggaggattgattaggccctggaggtcgaggctgcagtgagctgtgattacaccactgtattccagcctgggcaacggagcaagactctggctcaaaaaaaaaaaaaaaagaaaagaaaaatatgcttcccatgggtcttccttccttgtagaaatcttattgttaatcattgtaggactgctggaaactcacaaaagtaacagctaggggatgataggagatgcgtgcagttgttgcagtcctgtatggtccctgttccatgctcctggctctagttgaaggccgtgagcagaagtcccctgtgggctgagcctcttgcgcatctctgtccaagggaggccggcctaggggcttaggttccacatggttttatgtgccccttatttcccatgggcagtctcatccctgcccccttgacctccgcctgccctggaaggccccgcccctggcctaggcctggccttggccctgcccccgtcctgtgctctctgcagctctctgtgctgtacccacctccttatgagttcctggtgagggttgtcagggctcaggttgggtcttctagactgcacgttctcagggcaccatctgacctggcttctgcctgtcggatttgggctccatagggaccctttccttgcctcctcctggggctgacacagccacgtggtccctagagctctgtgaggcccaaaataaattttatttttcagtgctataagagaaatactagttagtccctccagagtgggtaggatggcacggagggacctgagaatttgcccaacccaaaagcctgagtgtcattggccggaagggcttggaacaaccttccccacagatatagaagcatggggttgagaagagtcctgcatggggcagggcgctacctgggaggggagctgggtctgtgatccccagaggccccattcacacgggcacacataaaacatgaccgtggtgttggcagcagcagagatggaagcatgagattcctgaggtccacagagctggctcttggcacggttacagcggcttctcacaagtcgacttttaaatgcctgaagaattttcatcataatctgaggactctccgataagccctttctttccctctgtttttcagtggcgccagtctctgcagtcattcggtctcatttcactggtaggatgggcaaaacaaaaccagattaagcgagattgtaaaaccgcagccacactaaaggcgcaggtgcacaggtctgaaagtgagctccgggaacggtgtgagcacgctccccctgccgccacccaggacaggccaggccgggcttggctgccggtgcttgcctatgtacccccaagtacacatgtggcctccgccagcagagcaccagccctgggcagctgcctccctgctgtagagtgggcgtgcggtcagcccacactgcacccaaaagcctcagctgagcacttacggagttgtgtccacagggccatcccagacctgtgtcttctagaattcatcagtgaacggttcctatgcagacagcctactcccacacgtacgtccaacagcccgtcctggaccaggtggtgagctggaaaggctgtacacgtaggtgggtagacgctgactccacatgtcttctctcccccatcgcagtaaaagctgcaccattgggatggttctccgactgtggagcgacacgaaaatccaccttgatggagatgggtaaggaggtctctttaaaagattctctcactgtatgtagtaggcattgaaaacacgagctggttcaggcatccttggatgatcattagcactgaatgacacgtgtggcgggagtgtcacagcgggagaaatcatattgccctcgagtgagagggcacgagggagggtatgttttggacgtctgattggggagtttagctcatgaagtatcagtgggagtgattacaggagatatgctgctgtgtgaagttcaagacagcggtaaaccgatacccatccgccacctcgatgggttaagtgaactctcaccgcatgccctccatggggcttgtcctgaaagttcacggactaatgtggtgcagcaggaactcaccagctttgggggtacaaggagagacatacaactgacaggcacaacaaggtttcaagcgccaccctgggggccacaaaggaggaatgaaccagttccacccgggcaggcagtcgggggatgaggggccgtctagcgtccgcacgcgttcactcccaaggaaggtgtgtgggcacggtgaggagtgggaagaaacagaataggaaagtggcctgacacggggattctaagcaggtcagagttatgttgccttgtaggatgggaagagaaaaataaaaatttgatttgttgtttaagtgatggggttatggggatatttttcctttttaattttaatatctttgtattaatttttttttctctttttttcaacggagtctcactctgtcaccctgggtggagtgcagtggtacgatctcggctcactgcaacctccacttcctgggttcaagtgattctcctgcctcagcctcccgaatagctgggattacaggcacctgccaccatgcctggctaatttttgtatttttagtaaagacggggtttcaccatgttggccaggctggtctcaaactcttgacctcaggtgatccaccctcctcggcctcccaaagtgctgggattacaggcgtgagccaccacccctggcttgtattaattttttatattttatattagtattttatattaacatatttatattaatgtattaatagatatttttatatattgattattttccgtgcaatcctatgaatatagtttccatgcaattacaaaaaggaacggccgggcctgtgggacaggaggtggcagggaggcaggaaccacgttggaacatagagagacgctctcggaggccttcacctggcaccctttgctagggtttcagtttttggtggaactcgcagtgctgggttaaaaacaagccctcctcatctgggaatgtgtctctttctgcccttgcccatgtctctgcgaaagcgggttccgtaaaatccctcatcatgtggcctgagatgtgcttgttcccagcgtgcgcagtggtttggctccctcctcccagagtgatttcactcaaggcgctgatttctcaccacagatacctttctctctgtgttttattctcagtgggttcagcgtgagcacagcaggaaggatgcacatatttaagcctgtgtctgtccaggccatgtggtaagtgtggttttagggacttttaactccctagaaatattttcttagccgacagcatgaatagaaaaaccccttctaccaagaagctcgttacgtatgtgcatgttgagggaggcgcaaaatacatgtaacataaagtttatcattttcaccatatttaaaggcacaatttttagcggcattaagtatattcacaatgttggggggtttggggtttctcgtttttttttttttttgagacagggtcttgctccgtcacccaggctggggtgcagtggtgtgatcatggttcactgcagccttgacctcccaggctcaggtgatcctcctgcctcagcctcccaagtagctgggactacaggcatgcgccaccacacccggctaacttttctatttttttttttgtagagatggggtctcactatgttgcccaggctggtctcaaactcctggcctcaagcagtcctcccacctcagcctcctcccaaagtgctgggattccaggcgtgagccaccgtacctggcctcagcctatatttttgtaaaaagaagtaaaatgggctaggcgtggtggctcacaactgtaaccccagcactttgggaggccacggtgggtggatgacctgaggtcaggagtttgagaccagcctggccaacatggcaaaatgctgtctgtactaaaaatacaaaaaatagccaggtgtgacggtacacacctgtagtcccagctactcaggaggctgaggcaagagaattagttgaacccaggacatggaggttgccgtgaaccgagatcacgcccctgcactccagcccgggcgatggagtgagactctctctcaaacaaaaaaaaaaaaaaaaaaaaaaaaaagaagtaaaagagggtgactaaataaaacatagattcttaatattgtttcccagtctgctccccaaacctcttcagttagtttctatattaaaatgactttctagaacttgttttcttaagaaatctaagcatctaagctattagaatgttgatggggggatgggtggaaatgtaattatttagaatgcaggcagatgtctctgttgcatattaaagactttttcttccagctgctaagcttaattgtgggtcttaggttcaatgtgggtcatatgaacatatgttcagggttaccacgcttcaggagcagttcttaattctctggagttaattgatgggttgtaaaataacccgtgaaccacctgattggaagagttatgaagtagtttgttgttgtttgtttctgctgctctttggaaataatgtggggtgttctggccactcttagattcaatcagtgaatatgtcccaaggactagctccgtgtcctggcgggctgaatgtttcaggctatatgcattccccagccgcctgtatgtgtaagtgtgactccaagagtgagccctttacaaactgcacttctcagccgggcatggtggctcacgcctataatcccagtactttgggaggccgaggcgggcagatcacttgaggctaggaattcaagaccagcctgtccaacattgtgaaaccctgtctctcctaaaaatagaaaaattagctgggcgtggtggtgggcgcctgtggtcccagctgctcgggaggctgatgcaggagaattgcttgaacccaggaggcggagattgcattgggccgagaacgtgccactgcactctagcctgggagtgacagagcgagactctgtcccaaaaagaaataatcaaccaatcaatcattgcccttcccttcccgtatttgaacccctttgtcagaggagaaaaccctgcatctcttgtgccttcccaggcctgaccctgtcttctcctcgccccaggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagtaagtgaggtgcctctggtgtgagcgcacccaagcccacaggcacctgcctctcccccacctgccctgtgcccgaccctgaacctgcattgggccacacctcccctggagtcccttgagtgagaaccctagctttctcagaaccagcgtttaaagcaggggtctgtgacacaggcccctgtcccatgcaaaaaaaagaaaaaaaaaaaaaaaattactgatgaatttggtgaatgcatttctggggacggggtccgtaactcccatcagactctcaaaggaatgtgtggccctttgtgtccccaactccttccagagctctgtggtctggccttttctcttcagattaccagagacttaattctcagagcctcccgctctgctctgaggagagttaggaatgtgtcctctgcttccttggatccaaaaacacaactggtgagggcagcctgccttagcagcagccatggtgaaccacatgacctgtgtcgtgtgacctacgacagcgctgacatggagaggccacactcgctgaagtctagttagggagaatgctggtcgcccctcccctcggggtcaggaccctgctcccacagtgtggtgttcctccaggacactgcattttgggaagactatggataaaccacagtgtgttcagagggcagagacctgagggatgggaagccacattaggagagggccttgaaatcacggaggaagggtagttgcctttgaatatttgaagattcctcatggggaagaaggattatcctggtctgtgtgtcccctagagttaaaaccagagcagggaaatacccagattttgattctgaggaaaaaggggataatgggatctgctgcagctgggccgggctgcctcagacagtgaggtcctcatgcccacacgtgttcgagcagagactcaagggcccaggggcctggggatgttgcgctgggcatcccagcatcctgccctaagagcgtctgagcaaggagtttccacactgtcctctccccgcttgacctgctccctgctctgttgactcccgtgggagttctagagctgcagcgggttttctgtgcacctctccctgctgcctgagaacatgcacaccaagaagcgtgctctccttgccaagccgtgttctgtttagacccaggagcatctggcattcctgtaacctccgaccacaagctttctacagctccttgctctcctaaacgtcatttctttccaggcccactgaaggggaaaggaccgagcgcctcatcaaagccaagctccgaagcatcatgatgagccaggatctagaaaatgtgacttccaaagaggtaagacaactcctcccttcattgcaggtcagaggtcatgcagcctccatgtgtcctgctcccgaaagtgcagcaaaagcaggcccaacatctggttgtctttacctgtcctctggtatcagcccccggaggcttttttctgcctcgttctacaattgtatcaggcctcggagtcagactccagtttgagtccagatctgccgcttatcggctatgagacattgagtgaatttcttgacctttgtgagcctcacctatatggcctttggggagaagtccatgagatccacagactgcaccgagaagcattgatctgttttaataacacccccttgttctctcttctgctccctattaccttgggttttatggaagagacagcagacttatttctccacaggatgacagcttgacctgcaagtatcaaattctagaataatttctctctacctttttaccttttcatgttttttcctggatcacttttttttccattgctttttattcaaagcatgcaatgaattacaatgagagattcaactggatggatctaagaagttaaaattgacattttaaaagttcatttataatcttttttttttttttaagagacttggtcttcctgtgttgaccaggctggtcttgaactcctggcctcaagcaatcctcccaccaaggcctcccagagtgccgggattacaggcatgagccactccatccagccctgtcttttaattaatgaatacattttttaaaaatcatattgtgatatctttccaagaaagatagaactgattttagattatttgatgtatttgacatttaattataaaagtaaaagtaagtttaaacttggtagaagagatctcatggaaatcaaattccttatttgaaataataaactttacccagttgggtttacttctaagctgaataacctgcattcctgccacccacgcatgtatgttgcgtgtatctaaatgtattactctgaaagagaaaaaacacccaccttttttggaaataggcacagtttccattgtaactttaattcttttgaggtggacgattgttttctttaacaaatcacttttcctaatattttctactccacagattcgtaatgaattagagaaacagatgaattgtaacttgaaggaactcaaggaatttatagacaatgagatgctacttatcttgggacagatggacaagccctcccttatcttcgatcatctttatctcgtaagaggcatggccctggcagtatctggtttgggggacataaatcagaccctggttgtttaagagtttgtagcaagtccgggagaaaaagcaggcaaaaaacttgagttgccagagcctccatcctggctggcaggagctcccctctttggccccttctctggcctgcagcctgctgatctgctcttgagccagctgtttgagacgtggcttccagctgagctgcggggagttgtttgggagctatttggcgtagtcaactggcatgtgtttcagactcttgcaaaccctttgtcttcttcagccactaacacataggccccatccagttacttccaagtggtttgtgggctaaaaaaccccagttactaaaggaagtgtcctcaccaaaccccagaattatgcctaggcatcctgagacatgagaaacaacagggaggagagatcacacagctgacacggagctcccgctgagcttgtccagacagcttttccatgcacggctccagggccgctggaagccctcacccgggtcctgtagctctgggtgggttgtactgatttctgtgcacctccacggctagctcagattgttttaatgctgtgaatatccatagaaggcaactggcaagttgtcaaagtcagagaggctatagaggaaggcacgttactaaaattagagaggcctagtggtgtaatgaaaatcagggcccaccagggccgggattcccactcctcagcctcagcggctatgtgacttggaagaagtcacttttcctctttttttcttcatcctataccccaagggatgactatgaggattaaatgaaatacaaactgggcacagtggcttatgcctgtagtcccagctactcaggaggctgagggggaggatagctttagcctaggagttggaagccagcctgggcaacatagtgagaccttgtctctaaaaaatattttttttaataaaataaaattaaaaatacatatttaaagcaccgagtacagtttttgcaggtgctaactaatggtaaccattgttagaggagaaagtgcttcctgggaaagctaaggaagtaaatttactactagagacaagaaagactttgttttctgtaggaagtaattaagagttatgtatatgtcatgatatctatgtagataagtagatatgtatattttttaatacatttctgtatacaaatctatatagatttcatagtgattgattaaaatgtatgtacatgtgtggatttgaaagtgtgggcagtcctgggcactgatctccctggaagtctgttgatttccctggtgagaagggaacagaaggcaccttccttctttctccactaggtggcagtcacagcaagaggacagtctcagcttcagcggcactcgcgttatgtttttagtgtggttcagtgctttatgtcactttttccatgagagatactaaaggaatttttatgtttgggcctctccctcaaatatgaaaattcagctagtgtcgcacattgccagcttgctcagggccctgccacccctggtcctgaggggtctgccctcttgggaacttgggaaaggaagtttcaaggaagacaaaggtggattcttttgctctttatgatactatgttgtttgcatttcctaagaggaaagtgatcattttttcttttctttttttttttcccccgttccatgtcctttgaatgcttgggagtggaaggtttttcaatgataccattttttaaaagtactaaattaaaacatgttgcagaaagtctgaaaatagaaataaatctaaagaagaaaaaagcattcccgatctcgcaaatccagaggtagtccctgttaacattttggcatatttattttcccatcttctgtttttttgggtttttaaaatgcatatatagcttctttgaaaacgcacaaagaaagaaaggatcatactgtttatgtttatatagtcctgtatcctcctctcttaaaattttttttccttacatggtatttgcctgtgtcattaaatattctgcaaaatttatttgttttaaagactccatcatgaagatccagcctcatttattttactcattttttccctttggacgtttgggtggtttccactggtttattacaaataattataaatatcctcctacctaaatcactgtgtgagttctgattatttcctcaggatagctttttgtaagtggaattactgggtcagagggtgggaactttttcagtattgccaaaatacttcccagaaggtagaacgattcctgctttaattagtggcttgtgaacgtgcccttccctgggtgggaggtcgcaggtcattgcctctgcttacaggacccccccccactggactcttaggaaaggaagtggggagacggagagcaggttttcctggacttgctgtttccctaaggccaaggggccagtgagggccgggacccttccctccctccgtccctccctcccttcctctcatgctctgagtactcactcaggaatctccttgaatatcagccgctggttctctctgttctctgaggccaatggggccatgaaataagacctcaccgccagagctagggcaaaccatgcatcccctgagcagctctgaggctgacatgtgacactcacaggagcttgtgtgatctgtctcccagggctctgaatggaatgcatccaatctggaggaactgcagggctcagggtgagtctcctccccttgtctttccctgtccttccaggcagcttagaaaccctccactctgccatggagggggagaccttggggctgcctgcctgtaattgcctgcaccctggtctctgaagtggctgccaggggttgatgtgcatagctaaacagatgtgcttccaaacaccacgccctgaataattcatggagtttagattgtgccgaagtctcgcgtgatcgtgtggattgaggaaaacttaaaattacactctaattgctgtaggaccgcctggatattgattaggctctgtgctgcctcacccccaccccgcttccctgccccgcacagttgctgcaaaccctagtgtggacgcagaggtctgctggctgttgcgttagtcagcaaccctgatccctgggccactttgggctctatctgagctaatgctttggggcctggtgggaatcttgcaactttacgctcagtgttggccagaagcatatgcctgtcgtagtctgacaaacactcagcagggatgaaaaatgtttcaatctagaccttcaagaacagatgtctggactttttttttttttttttttaaaacaacacagccacaaaatcaccgttctgtgggcctgacatgatgacattctagaattaccacgtttaaaaatcaagactaaacaaatcttaaaatacatctttagaactaccggttaagatgcattctttcaacagaaagtattcttaaaacgtaaggccatactcttctgtgctttcgtcttgctgggaataaattaatgattttcttaggtatttttttaagcatgtctaaatattatgaaacctatttgagatgttttctaactcctgacattattttcttccagaagtaaaagtattgattaagttgagagaactacagaacctgggttagcagaccctgtcaaatacttatttgtctatcttgcctttttccaaaaaaagatttaaggcagttcccaaggatatagataatggatggatatagtctgctttttagctctttaagagtgaagacactgggatttttttaagcctctgtatattcataatagtcatgaatagttataaatttaagtaatacgtatatttaattttccagaatgctttaaactgagctttctttttataaggtctttacaataatttggtttcttagtataaatataacacattttcaccattgagagggcatttagaaaataccaaaaaacatagctattaaggaaaaaccaaagtcccgccacgaacatatgacccttggttaatgtgtgtttccttttcttttctctgccagtttttattaccttgcttttctttctcattcagattgtccaaatttgtttcttatttttttctcattgcagggttgattacattttaaatgttaccagagaaatcgataatttttttcctggcttatttgcatatcataacatccgagtctacgatgaagagaccacagacctcctcgcccactggaatgaagcgtatcattttataaacaaagcgaagtaagtggacagagaggcggggctgaggatgaaaccaacctgctgaggctgggagagtgggaatgaacgagactgcagatgcagaagtcggctggtgggaggggggatcctaacgggactccagacgcaggagttggctggtgggagtggacttgatgtgggatggacctttgcttttagtcgcaggactccaagcaccaaaggagaaaagtggttggtcctctccaggtagagtccctattgagcttagtctctcccacctatctttgattgtgacacttgaccccagttgtcatcatcagctctgattccaggcaagccccagataccaagtggacactcaggggccccacccctaggaagtcactgagccaaagagggctaggggatgacatgcacggacacgggcttagagcttctttgggactgtctccctaagaatacggcccttcttccctccctgagttactgtcgcatgaaacaggacagcacgttggaggtcatggccagccccactgcccctgagcccgtcagcggtttcacctgtctctggtgctcattttattcccctgcgaaacagctctgccttattaagaacagaaagaaccctttgagatgctgtcaagacaatcaccctcttctgctttatctccctctgggtcaaagccacatgatgtgtccttaaccaaatcttagttcccttatattcccaggagacaaactcaagactcccttgacggaaacttcagaccagcagttagggggaaaaaaccccactgagatttgcaggagaatttcaaggttggggtataggaaaccagagccggctcccacctggtgggtctgccttctgtacaaataaagtttcgcaggtgctgcccttactggcttggcgctccttcacattcttgagcaagtgatacttaaagaaacactgtctcctgggccatatctggtaaatcagccaggcctgggccagcactgcctccttacaaataaacggccagccccatcttccactcctggcttttttttgcggccgcccttactcctgctccctggccctcctgtctgaagagcatctcgctctccccagggccttgcagctttcagtttgctgaccccatttttctgcagtaactcattcactgtctccatctgctgtagcagctgagtagctcttgcagaaatcccgttagctgcccactctcgtctcaggaaagggcttttggtcccctagcccatcccagccatgtgagaagattctcacttggtccctgaaggcagccaaatattgaagctctccctgcaaacaaaacatggccaggccagaacagatttcttttgatatcccattgtgtgctaattgattctacagtggtggtatttcctttagagagtgcgtggacatctgctccgtaaacattaagacgtaggaggatttcggcagtaagatatctacagggtttaaaaaaatgattcgggtaaaacctgagagaatgaagttgttggagctttttaactccttccccactgcttctcccccatctctcctccccaactgctcccacccctgcaggaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaaggtgggtgcctgcctggagagaagggttggcaggcggagctggagcagccatgtggccaagccagccaggcctctgtcggcagcagagcatgctcccattcggcccagcagccgcttccacagccaaaatcctgcctctcagggggagccagtttgagaaaaacaactattgtttgggctttgatgagtggtttccaggagggatctgttttgattttcttggcacacacataaagctggttttgctgctggagggaacggtgcctaggttctaagccaaggcctggcctcgtgtgtgtggcgtaagcacgtgcgcatctcgcttcctgggcatctggtttgtgccaagccctgtgcaccagctttgctgcaggaaaagccaaggactcggagaggcacagcaaccaggttccgccactgatgagcagggcaagtcagggcaagcccatcagtcttcccgagcctcagttccctcttctaagaattaatgcccaccttagctgggcctgggacatgcacttgtagtccgagctgcttaggaaactgagatgggagtattgcttgagcccaagagttcgagtctgcagtgaactgtgattgtgctactggactccagcctgcatgacagagcaagaccccatctcttaaacaaaaatgctttttaaaacactgaggtcaggtgtggtggcccacacctgtaatcccaacaatttgggaggccaaggtgggtggtcgcttgagctcaggagttcgagaccagccttgctgatgtagtatattttcttgacccctttttgggacacgtgacagaggtgcctcatttacccagtccaccccactcaacccctcatgggagggagcgtacaagcgaactagtgcaggaactggggtgagcgagtggaggaaccggcctctttgctctggcaggagtgaaccctgtgcaggccccatggcagcatccaggtgtgggtgcctgtgaccctaaggcctcagagggtgtgttataatactcctttagctctgccatccacagatagcagtgtgttaccagctcagtgggccctttgcttcatcgtgtgaggcagctgccttctaccagtgagggcaaagggccaatgtgacagcatttttgggtactcacacctggtgtgtcctgaattcttgtctggtgctcaagaggaatgaggtcacatgggcgaattgaagaatggtgaatgtggagaattttactgagtgatgaaagcagccctcagcagagaggggagctggaaaggggataggaagggaaggtcgctctcccctgaggtcaagccacctctctgcctcgtccagcctccatcttctaaagtcaagctgccactctctccgacatccaggcacttcttcctgacgtccaactgctgcttctctctgccagctgagtctggggtctttataggcacaggatgggggtggagtgggctataggtagttttggaaaaggcaacattcaattggtaaaaagacattattcagaaagagccagttgggagagagcaggcacacagggttgggtgttcttactctgggacacaggtttcaggcttttcggcttgaaggtggggttttgccagggacccgcacctgtctgcctagaatttctctgcctcctattgctgtcattggcaacatgctgagaccctgtctctactagaagtacaaaaaaaaaaagcccagcgtggtggcgtgcaccagtggtcctagctgcttgggatgctgagatcagagggttgcttgagcccagggggcagaggttgcagtgagccgagattgtgccactgcactccagtctgggtgacagaaccagacgctgtctgaaaaagaaaacaaacaaacaaaacaatgaatgctcaccttaatgtggatgttaatggtacaggtgctgtggaaaacagtatggtggttcttcagaaaattaggggccaggcattgtggctcatgcctgtaatcccagtactttgggagacccaggcaggtggatcacctgaggtcaggagttcaaggccagcctaaccaacatggagaaaccccatctctactaaaaatacaaaattagctgggtgtggtggcatgcacctgtaatcccagctactcaggaggctgaggcaggagaattgcttgaacccgggaggtggaggttacagtgagccgagatcacaccattgcactccagcctgggcaacaacagcaaaacttcgtctaaaaaaaaaaaaaggaataaaattatatcatctagcaattccacttgtggaaatatatccaaaacaattgaaagcagagtctcggagagatatttgtacattagtgcttatagcaacattatccacgatagccaaaaagtggaagcaacccatgtgttcattgatggatgaataaacaaacaaaacgtgacatattcatacaatgggatactacacagccttaaaaaggaaggaaagactgacacaggctacgacagtcatgaaccttcatgacattgcgctaagtgaaataagcaaatcacgaaaagaactactgtatgtttccatgcatatgaaatacttagagaagtcaaagtcacagagagtagaatggtggttgccagggactggaagaagggaatggggagttactgttcaatgggtaccgaatttcagctttgccagagacagagcattctggagactctagaggctctctggttggtggtgatggttgcataacattatgaatgtatttaatgtacacttagaagtggtcaagatgaggccgggtgtggtggctcatgcccgtaatcccagcactttaagaggccgaggcaggtggatcacttgaggtcaggagttcgagaccagtctggccaacaaggttaaaccccgtctctactaaaaatacaagaattagctgggtgtggtggcgtgcacctgtaatcccagctacttggaaggctgaggcgggagaatggcttgaacctgggagaccaggagttcaagaccgcagtgagccatgatcgcatcactgcactccagcctgagcaacagagcgagaccttttctcagaaagaaatacataaataaaaattgtttaaatatataaataaaaagaggtcagggtggcaaattttatttttttgagacagggtctcactctgtcacccaggccggattgcagggtatgatcatgacacctcaacctcccaggctcaaatgattctcccacctcagccccccaaacagctgggactacaggtgcgcaccacaatacccggttaattttttatatttttttctgtagagaaaaggttttggtatgttgcccaggctggtctcaaactcctgggctcaatcgatccttccacctcagccttccaaagtgctgggccaccacacctggcccaaattttatattatatgtattttagctgtaaaaaaaaaaattgagggtcaggcgctgtaatcccagcactttgggaggccgatgcaggcggatcacctgaggtcaggagtttgagaccagcctggccaacatagtgaaaccccatctcttctaaaaatatacaaaaaaaattagccaggtgtggtggcgtgtgcctgtaatctcagctactcaggaggctgaggcacgaggattgcttgaacccaagaggcagaggttccgagatcataccactgcaccccagcctgggtgacagagtgagacttcacctccaaaaaaaaaaaagtttttaaagaatacccacccaatagagctgctgtgaggtttgcatgagtgctatctgtcaatcaagccaaatgaccgaggcaagtctcaatcattttaggaggtttatttgccattgttaaggatgcacacctgggagacacgtctgtgcctttctctgaagataattttgagggcttcaaattttaaggggaaaggatgggatatcgagaaatgcacaattttcatgtgaagcggggtagggggaagagagtcatgtatgccttcatctggctcagtgaatctgcgtttttgcataacatagacaatagagcagaggaaacaatcagatatgcatttgtgtcagatgggtagagggatgactttgagttctgtcctgtgtcttccttcccacccaccccccacaatctatgaagatagtgggcaatttacattgccatggtgaattttaaccgaaaagctttagggtaaagatcttggggaccgcaaggaatttccttgtgggcaagatatgagggaggtgtgtagcttttcatcttcgtagccatcttatttaggaatcaaaatgggaggcagatttgcgtgacccacttcccggcttgacttttccctttggcttaatgagtttggggtcccaagatttgttttccttttgcagtgctaaacaagtttacctttacagatacttccacatctggcttgtagtaaataataaatgtagcttaaagtctctgaactcccatcctaaaaatttctgtacaggttatcccccttttacgaggatcagggcagggataaggagctgacgctgagaggttgacctatcccccatacacagccagtgggcggcaggagggagaggtacaccgcggcccctcactcagcctctgagtcagggtgctgtgtgcaaaaagccctgcggttctgtcacccacacggggtggtgggggaggtcctcaccgtagttccagtaccccaggctctcaagttggaagcccagagcctgggcggcactttctcccggttccctttccagtcagtctgtacaagaagcaggcctccctgggagatatcagtctggtgttggaaggaagccacaggcaaagtctaccagcctcttggccaagtttgggaatgcaggagtgccctagcagagttaaacagggtccagagaacagggccggccaactgtggactccttcactgtcggaagggctggacaggtccccaggcaaggcccagaggaggaggaggaagagcgagcatctcactgacctctccctgagcctgccacgcactcagtgccctctgcagcctaagccaggcgctccaggccaggttcatagcagcgtggcagtgaccttgagtagctgctggctgggatgtgcacaccgagcagagaggatgaatggctctgtcacactgtgctcttacatttacctctctctttttaaccctcgcaagcctgtgatactggtattactttaaggtccttgagggtgacttagttaccttatttcaccgtaaactttttttttatgccttacattttaaaaatgtattacagggcttggtgcagtggctcatgccagtaatcccaacactttgggaggctgaggtaggaggatcgcttgagaccaggagtacaagaccagcttgggcaacatagcaagaccctgtcactacaaaaaaaataatttaaaaattagccagggatggtgtcacatgcctgtagccccacttgggagggtgaagtgggaggactgcttgagcccaggagtttgaggctgctgtgaaccgtgatcacaccactgcactgcctggaccacagagtgagaccctcatctcaaaaaaaaaaaaaaaagggattataaaaacaatgtcatcatagtagaagaaattgtttaaaaactgacctaaacctaaacaaatactttctagttttccaggatcttcccaaatgcattgcagtgcgttatgtgtgtgtatagttgtattatcgtgtatagatctgtacatactccactttgattcccttcatttccctacaatataggtaggagagcgttgttattcttatttgacagagaaatgagagatggagtgtaactgacgtgacaatgaggcatcactaaacacagatacacagattgaagtctagacgcccccgcgttccttccccgttgtcatcagaggcagaaagtcacatcaggcttcctgtgcgagcctggacaacttaggagccagtgctgtttctcatccttgtgtttcttgggaacaaatgaacagagagaggctttacctgaatgagccatggatcgtccctggcgccctgaccttgggcagcccctcactggctcaccgcatactcttcccagcacccccaggcaccatcctcctcccctcaccttcctctaccctctctccccgcagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggtaggcagagcccggcctgcagggtggcacaccccatcccttccatcccactctaattggcctacctcagcctctgtagtagggactacaggcacccgccaccacacccagctgatttttttctattgtctcctctgggcccccagctcccatctccagggacctgagggttctttcacagggtgattctgctggtgggtacgtagtgcataccttatatagcaaattgagaatctgttgggaataacacatatctctgcacaccatcttcaccccatgtaccttattcataccctgggcagggcttccaactcaatttctttttgtgtatgtaaaattaaaacatataatttatcagccaacttcagcctttatcgatatatgactattctttttcatctcacccctaccacccacttccccacacccctgatgatcctggaaccaatcccagatttagatatagatacctgtatctaaaaaatatatattataggtatatactgtagatatagatagatacatactatagacaagttctcactgtttcccatgctggagtacagtggcatgatcacggttcactgcagccttgacctcccaggctcaagtgatcctcctacctcagcctcctgagtagctgggaccacaggcgcatgctaccacacccggttaatcttttctatttttttgtagagatgaggtcttactgttgcccagcctggtctcaagccatctgcccaccttggcttcccaaagtgctggaattacaggtttgagtcaccacgcttggcctcagatatatcattttattcataaatgctccagtatgttaacatagccacaataccattgtcaccttttaaaaaaactgatagggccagacgcggtagctcacatctgtaatcccagcattttgggaagccgaggcaggcagatcaggaggtcaggagatggaaactatcctgaccaacatggtgaaaccctgtctctactaaaaatataaaaattagctgggtgtgatggtgcatgcctgtaatcccagctactcaggaggctgaggcacgagaattgcttgaacccaggaggcagaggttgcagtgagtcaagttcgtgccactgcactccagcctgggtgacagagcgagactccgtctaaaaacaaaaacaaaactgatagtaatttcccaacgttgtcaagtatccagccttccaacttagactctaatacttaactccattagtctcttggagttgccatttttagtggattatctgccacaaggtttgagcttcaacctggtgcttactgagaaattggttaattccagccaaccttttccctcctccatgggggaagtgatgcaggagcagaggctggttcagtggaagggtggccgtgcagcctggtctccacttccacccttgccctgctgctgactttgttgcctctggcttcacctgcccatctcacaggacagccgtggttctcaagtgggggcacttggggtcctgacagatgcattcaagtatacagccagtttattattattaacagcatgttataatgcaaacaaaactgggcagttgcatctgtcgacctccataaagcattccaaatcaaatactaattatggatttcccccacttccctgcctaccacaaagcaaatacccataaagacagatgagataaaaccctgggccaggtgcagtggctcacgcttataatcccagcacttttggaggccaaggcaggcagatcatctgaggtcaggagtttgagaccagcatgaccaacatggtgaaaccctgtctctactaaaaatacaaaattagctgggcatggtgccgcacgcctgtaatcccagcactttgagaggctgaggcgggcagatcatctgaggtcaggagtttgagaccagtctgaccaacatggtgaaaccacatctctactaaaaatattaaattagctggctgtggtggtgcatgcctgtaatcccagctactcaggaggctgaggcaggagaattgcttgaacctgggaggcagaggttgcagtgagacaagatcacgcaattgcactccaccctgggcaacaagagcgaaacttcatttaaaaaaaaaaaaaaactggaagccatggcggggcctttaagcaggtgggtgatgagccccctctggctgtggtctacaggcaggctgctggggtaagaggggaagttgggatgctgggatcacagtggctcagaggatggggcaaggacataaggaggtgttgagagacagagctggcggggtgtagtcgctcacacctgtaatcctagcactttgggaggccgaggcaggaggaacacttgagcccaggagttcgagaccagcctgggcaacatagtaggaccttgtctcttatctgtttgaaagagagagagacagagccctgttgccctcctgccttgtcctgccctccagcctacagtcctgtgcaggcggggtggggtaggggggtgccctcctccttcctgctttgcttctggacctgcatgctgctctctctggctggtcaacacctgcttgtcccagaagcctcagctgaagtgtcagttcctctgggaagccttccctccgcggagacttagaacttgtccctctctcccctgggactcttcacacagctttctagtccattcccaggaccactgggtacctgtcagttggcctgtaaggaagtgaagggtggggacacagaggcatgtgtcacgttcacttagatcctcactgaccaaaaggcaggagggtttccttaggaaacaatgtaaacttgttttctattggggtataaaatccacctcaggccagtggttattctcgatcaagtgggctccaggaggtctgtctgtcagtattaagtgaaatgagagcctcccctccaggcctggcccccagtccggcctcgcacccctttccctgcccaccctcatgtttttggtctttggctcatgactgcaccgtctcaccatgctcttgtccccttccttgcaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggccca

SEQ ID NO: 38705 - DNA, 895651 bp, Homo sapiens; identical to SEQ ID NO: 36080

SEQ ID NO: 38706 - DNA, 171660 bp, Homo sapiens
agtgctcgcggggccgcggcggagtgtaccgtgctgctctactcgctgccattcgcccgcaggtcggcgcgctcgcccacctgagccgcgccggggctgcgggaccgtgggacagcgcgctcagcccagcctaggaaagaggcagcagtctcagcgcggagatggggagcgggcgaagttgacgagtctcccgcccacgctgcgcccctcctgcccagaggtgcgctgcccctccccgaggtgctcgcgcgctgccctgaccccttcctgcgcgggacacccctcccctacccacgggacctgataacttcaccccaagtccagagagtgggctgcgagggcggtgcccggactggacaggactctgcttaaggggagcggtcctggaggctcgccaggagtcggagggcggagacccgctggaaactttatcatcgccgtaattactacgttttactgtttctctccccgcaggggctgcagccagcggtctgtcgcgcgtgcctgtgtgcccgaggagccgccccggggagaagacccggcgcggagttgttcccccagggaggatccgcagcccagccgagggggtcgggcggcctggctacgcaggacccagccccgcagccgcggactcccagcggcggcgaagtttggctgctgagcggcgcggcgccggaccactggacagcgggagcgatgcccgtggggggcctgttgccgctcttcagcagccccgcgggcggcgtcctgggcggggggctcggcggcggcggtggcaggaaggggtcgggccccgccgccctccgcctgacggagaagttcgtgctgctgctggtattcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagaggtgagtgggccgcgccagaaatccctcccgaccggccgtgtttttcagggagaaacggcaagcctttgaaactctgaagactgcaacaatgcaatgtatggggagatggaggtttgccccttccaccaggtgctgtgtcaaaagctctttcttttcctgtttccaatatagtagtagatgtgtccagtaagatctaaggtcaaatctcgttgcttttaatttgcatgctcttgctctggtgaccacaagccacacgaggtgggtataaatacatgggcaggtaatacgcaaacctcattctctggccgctacacggttaatcgccccaccagtaacagcgacggcactgatcagccccctggtaaggattggggacgtggctttaaagtgagtcttcacgcgtggtaaagctagccagcataccccgggttcagctgtgtggcccttgtctgccaggtggcattctgtgtgtactttcagactataaaggtgaaacctgagaacttcccatcatcgagggatactattgtttacttttttaaaaaatgaaaatataaaaagccagtcggctgcctcttgtatttctaatgcacagccagaaatagggtattccatgtgatgcaacaggtttgcctccacagcagcacaatggtgacaaagttaatccaggataaacatggactttgatacatctttcctaatttccttctcgtaattttcagttagaacttgaaacatgtgattaggtcaggaccagcttaaagctgaagggggccgtaaaaagtcctttcaggctgtcattttcaagatgaagatcgaagggcccagagctctagaacccgttagtgatgagtcaggacttgaagcccgaggtccgaacttcccccagtcacctgtcaccacgcggtctgtggacatgcctcctctctgagctacttccctgtgtgaaacggtgccagcctgcgttttacatagaaaagctgtaggaaccacattaaaagcatgtcattccaaatcttggttcaattttctaaaatatgaatggaagtaatatttttgccatttaaaaaataatacgatctgtgaaaataaatattgtattttcatattgggtaggtaatcaggagaggaagtccctgatcccattttcagagagtaaacagatttttgaggtggttgagaggtgtttagcttaagtggctgcagaatgaaggcagcaggattgtcatgggatttgtgactttgtattataagatcagctgaatttggttaagctgtaattgagcaagttaaagtggacttggatccctttcggtttaggaagaatgtcttcatccttcctatgcagatagcttccttccacagtccatcagcatatctgcttttctgagacccctcctcagggacagaaccctcccatacttgggggaatggattctactttccagaacaactgtctagcagtttcctttctccatgaaatcctgcctgtgctaccaaatcaggaaggtggaacaaagctctacctcttaccaaatcctcccagactccttaataatatccaaccaaaaccataggaaattaacccaaatgatctgtatctgcctgtgtttctgttaaatttgaacggtgtaattcatacatttcatgcctccaaagtcatacgagctgccagttagctagtacaaaaatcacagttgtccgaggaaaagattttaatacgaaagatacatagatgttaagctgttggtactgaccaagagtgattacaagtgcattcagagcagaaccagtggggcagtagcagtctcagactcaggacaacatattaacagtgtgcatatccatccagtagatccatgttgtctgtatgcctaaatcacaaggtcttaattaaccgtgtaaacgagatttacgtagtctctgtctaacatcttagcacctagatgttttgaaaccgctcagtcttgcataaagcagtggaactaaatgtgttctttaaaattccttgttgctgtgagaacccaaaagagccagcataattagctttagtgtttagtcaaaggctaatgggaagaaatggattatgattttccatcagattagttcaggcagatatattcctttgtaaaccaaaagaaaaaaaaaagaaattatgatgctgttctaaaaactgtgctgtaaatatttggctttagagaggcaagagtggttgcccattgtaaatagggcactggactttaactttacgtatttggattcagtttcaggcaccactgtggacattttgttatcaaccagtagatctttgccttagtttttttctttaccattgtgttttcttttctttctttttggagacagagtctggctctgttgcccaggctggagtgcagtggggtgatctcagctcactccaacctctgcctcctgggttcaagcaattctcctgcctcagcctcccaagtagctgggattacaggcacgtgccaccacacccagctaatttttgtatttttagtagagacggggtttcaccatgttggccaggctggtcacgaacttgacctcaagtgatcgacctgcctggcctctcaaagtgctgggattacaggtatgagccaccatgcctgacctgttcctgtattttctaattctctttatacttaggttctctatcacacctgaatgcaccaacacttatagttaaaatttagaaagtgcactcaagtctaacatgttggaagactggattgtaatttgagtcaacctgttattttgtacttggttcaaagtcagtcaatactattttttatatctatggcacatttatgttactagtactgcagtagatttttaacaacttcgtgtcttaggggagatactctgttaatttcaaataggtcattgtacagaatgcttcacaaaaaatgttaaatgctttccactactgatttgatggatgatgaatctttgatgtaaaacttcaaaatagaattaagatcttcctcccttcacctctgttaaaattttgtaaattaaccctgggatttctctgagatttatgatacatacatagtgtatatttattttcatgagtttgatcttaaaattgtactcaggttgtccttagctttaaaaagcagtgttagaataatgaagcacaaaagttaaaatagcagcatggaagttttagaaaaatagtccatttacttttttttttaatcagaaatcatttttagcttcccttctcccccgctccgcccccccctcaacctctcccattttctcaattagcctgtgctgtcctttaggattagaaccttaatccaatttggaggatgactttttttttcgtttttctgaaattaaggggagacctgagtaataggggctggggctaaagacagtcaggttgtcagaggggactcctttcttctcaggctggaatcctcaccaacctaagtgggggttaggggtatgtgcagactggcagccttagatttgtcatgtaaggctttaggaccctgcacctgtggggtcacagttttcttctctcagttctaaaacaagactttagtattttattccagacctatttgtgtaatcatgaatttaaagaacattttcatattgatggctagtagttaaaattcacatttattatactttatgctagccttaggcatatagcctataatttatattaactattgacagtttatacccttttggtaaagatcagatgtgagaataatctgccttggcaggttaaaacaaaacacttttattttgacacttaactttccagtttatttttatgggtagttctggggtggaaaataatatttacaaaataataaaagccatgatttggagacctgacccaagaagcttcaacatccttaggttgcttgcctgtgccactgtgccgtgacacattccctactgaacataggctagtgtgggattgctccacccagaggcccttccccagagcagggaggacatggagtgtttgtgaaggtttttctctccttaacaagtaggttagttttcaacagtttaagtactggagtaggtgctgactgttaatatacaaaagcaaaaaaatacatatatacagtaatgggtagttaattatgttcagcttcattttctgtaagctgttgatagtttctcctagaatattctgtcttcctcttatcaaggcaactgggattcatataaaggagcttcttatgtatatgggacttagaaactagttaaaagtgtgaaaagaggttttaaaaaatattttcaaacaaatgcatctatctgtacttcttaggtgagctaatgaactaaaccatcttgaaaaatttatcttagtattacacaaaatgcatttgtatgagatctgaattggttggaattcattgaagaacttacatatttgaatcagattatttcataagctgtggtggtacaaatttttcattgaagagaattttaagcatgtgtccgaaggtcagaggggaggaatgcctgcagatccgtgtgagggatgagggctgaatacacagggtagatcagaattgcactggaacctggttatacctcctaacccagtcaagcacctgtggtcttttaaatttctttctttataatcttgtgtatgttggtcaaagaagggtttgattagtcaaaataggaacagccactgtgggctccagagatactgtgaaacgagtggcaaaacaacctccccgccaagtagacgaaaataataaacaagatacctgtttggtagtttagggaagagattccctctttgaggaaataagtcttgacttttccctcagtattcttagcctagttccttgcttggtgttcagtgattgaactatatcttatccccacccccaacctctcaatctgttaaaaggccctttacacaaactctgcaaattatgccatgataactttaaatctcagattttaaaactaagtgtatgctccgagtcgtaaggtattgcatctgaatgagatctgagaggtagctcattcattttacagtagaggcaaccaagacacaaagatcattctggaaatcacatcaccagctagtggcagagttgagttgcagagggaagccccagtcttctgtgagtgttgcgcattgtctcccacatggtttgtctcctaaataaaaccccaaagaattgtataaattatccgtgcttactatttgcagaccctaatagagagtacagaaaacatacaattctgcattattataaatttgaccttatactaagttggtggtttttctttttttttttttcagccaacgatggatcaaagtagtttttaagtcaattatagtaatttttaaaaatcttaccagtggcatggtttagaaatcttcttctttgtaaagacacccggggaaagcttgataggacatcttgttttctttataaagatctctccaagaagcacaggcatttgtaatcattcagttaaacattctttatgaggaaaagtggggaagaagaaggaagggagagaagaagagagtgagttactgtatatacaaagggtgaaaggggatcacccagagaagggacatgtgatgactagaagggctgctttaaaattataaatgtgtgtgctcttctgatattgcaccatggataatagaagaatgacagctaacctaaaggatgattgttttaaaagtagacatgtaaaaatcacaccaatctatgggcaattctctccacccaagtaggttctggcgattctcttttgggatgcacttacctgtctctgatccatccatttgaagcaatgtagtggttagaagggtggatctggactcagataacgtgggtctgaatctggcctctaccattctcttgctttgtgaccgtctgcaaattacttaatctctcagaactttagtttcctcatttgtaaaatgaggttaatagtacccactttgttggatcctgaggcttaaatgtgatagtaaagcacttagaatggtatcagacatgaagtgggcacacaacaaatgctgcttgtgattattgctgttactggtcaccacctaaagccatcaagccaagattgcattgatccatatgctgtttaataactcaggaaagtggataatgaagtttcaaaagggtatcaaaaatagttaaaattgagttttagtgcttaaagggatacatttccagttcatcaaaaagatcttccatacctataattttattttgctacggtcaactctgattttctttgatttttaccaaattccaaaaaaacttaagtatctttagaatgatatacttactgcatatacatcttcagcttcttcagaatatatgttaaagaattaatttgtctctttctcatagtcaaatatgcctattcccgcagataccatctttcagagtagtcacagtcgagttatcttaatttctcttttttctaataaataatttttttatttacacaatgcagatcgggtctcactatatttcccgggctggtttcaaagtcctgagctgaagcagtcctcccacctcggcaccccaaagtgttgggattacaggtgtgagccaccatgccttggctgagttatctatcttaagtattgaagttattcttctaaatagagagagagatcgagtaaagtgaatttcaatctgtttcatcttggaggaatgtttttaagaagtgagaattattattttaggcttggcaaaaattatataattatgataaattctataatcagagctcagtccatcacttagtagtcaaagttagcataaatcagttttattttgtagctcagagagtttggtctttttgagaccttcacattgaatttagatttattaggattccagacccactactcattttacacatgagaaataaggcctgtgagctgtgacttcctgagattcccccagtgtacaaacaatagctgagaattgcttcttaggtgttgagaagtactgagaaccaggccccactccacctgggataatcttgactctaatgagaacgtgtgctttggtgactggctgaccaggccctccctcctcctcagccctaaatggcaggccaactgccagaagccccactgagaccatcctagagggaggtgggacgtctttgctgggtaggggattgcctaagaaagcaatactggctaattcctttgctccggagaatgtggcagcagtgccccgcccccactgagttttgataaagacttctgtgatcattaggtacttgaaaaaaaaccaaatgagattaaggcttaagagcatttaaaagtcacagccctcatttctgtcatgaatactctggtagttgctttaggtactttagagctgagcagtcctgcagataatccagaacagagataataaaattgaaaagtacacgtatccttcctgtttacttgacttttgtgactagaatgactccttctcgctcgtgtttctcagtctgctcatctccctggctcttaagtttatcaaaagcccagttcctgatttgctctgctgctttctcatcactcttgctctacatcgttcattcaagtgacactcagaacatattatattaacttttcatttgcattgttcatgtttttatgtgggtcactaattagatcgtcctgtcttgtgtgggagtgtttagtattagcaacttagtatgagagagggcatggagatgaggggataaaaacctgatgaaggacaccaagttctgaaagggtggtttaataacacagcattgctaccctctgaaacaacctttgttgctggtgcctgtttgtctgtgctaggagtttatgagaaagggggtggcagtaattggtgtccgaaggcctgtgaatgactatggccaagacgtgaactcaagccatccatagactacaagctattgctagtgtctccatttctgccaaatccttcctcattaaatggtcttctcaaggtcccttcagaacactcaattcttctaagtgacaggatgatctcagaaataggacaggaggccagggatcctagcctacactgggggtggcatgtccagcttcctgagctgatgtttaggtcatgattgtctgtccctagttcctctttcacgggaatacatgctggagctatgtactaaaaggggagtgtgtttcctcactgtatctctctctgtcggggcataagacaagagaacagacctgtggaatgattagggaagctcaggggtatctacccagtctcaaaatctcattcccagctgccagaaattcaccaccagtgtttcctttttactgtttttgttttgtttttgtttttgagatggagtcttgctctgttgccaaggctggagtgcagtggtgcaatcttgtcttgctgcaacctccgcctcctaggttcaggcgattctcctgcctcagcctcctgagtagctgggattacagacacctgccaccatgcttggctaatttttgtatttttggtagaggcaaggtttccccacattggccaggctagtctcaaattcctgatctcaagtgatccacccaccttggcctcccaaagtgctgggattataggcatgagccaccatgcgtgtccatttattgattcttaaaggcttgctttagaaatagatggataaagttgctcagcagaattattaatattatactttgagatttgtcttatcaaaggatagaataggtttgttgaagcaagtatcttccattgtcttatttcgctttataaactcatgtctgcttgggaaagaaaaatttgaaagcacactagagtagaaaaaaaaaaacaaatccttcatagttttatcagtcactaagtagtgtcaatgatgctcctccctaaccccaatatgtaagttcgttcccaccccccgacgccgggttataaccacactatatatactttttgtttttcattttctttgcaagtgtcattttatgttggcacagtatatccatgtcaaaacatgatactttatttaaccagtcccttggacctgaacatttagattatttccacttttttgtttttattaaaaatgctgagacagacagctttgtccagtaaatttgtgtctcactttttattgcacacaccctggtaagtgggattttctcttaaattcttaagaggggaaataaattggccaacagatagtacattttgagggataactttccagaaaccatttatactcccatgtgtcatataatgaatggagtctgttgattctttgtgaatttcataagtgatgaagcagtatatggcattttcagtttgcttttctttgatcaacactttctcctgtgttgatcatttgcatttcttccttgtgagttgtatagatagaacaaggaaattttgaaaggaggaagatagagaagatggcagagcttggaggcctaaggagtgaaatccaccaggggagatggatctggcaagccggctcaatgaacgtggactcctgtgggaggcaaagtcctgaaggcgagagttaggattttataaagcaaagttgcaagaaaaaaaatttttcccctagattgcacacttagaataaaatatcctttattgataggagctcttaccaggcacttgggacagcccacatccttcagctgagacctagccagctttaccagcgcatcttcatttttaagtgacagttgggattttgcctcagatacttgaggaaggtattgacctctctggagatctgcggaaggatctttctccttttggaatgaatcaggatgcttttctaatagttgaagatcaaaagtagtccaaatagaatttcagaagtgattttaatgatgccagaaaatggcaagtcttacacagctgaattcttaaagaagaaaaattaaccaaaaggaaatcatgagatttcctagaaatatttgttcttatgtgtgaagaggcaggctaatcttttgtatgtgagaggccttcagtgttgtaaataggataaatatgcattttgtcaaagatattttatttttaaagaaaagcatgatattttgtgtgtgaagtttgggcttttttttttccaccctaaatccttcaaatgtttttagtcatgttttttaagatagtgaagagctgcatatttcaaaatgtatttatattctgaccttggttcataaaagtctgccaagcgccagaactatttaaatttggctataacactgtgttaacgtgatgaataacgattgacataaatgtactatattatttttataaattgtggttagacatgatagtaattttagaatatttacagtgctatttttggagactttttttttttttttagtcaactagcagtgttgaatgttttatctagccaactacaggttttcagctcataattagaaatgcctgagaagtccatattgtgatttaaggagttattagcccaagtcagcaattttataaggcattcttattaggaagtataaaatgaactttatgtagtaaaaaacgtattttataattggcatatatctaatgcattgtatacattcactcatattaagcattttggttagtcttcattatttaatcctcctgtggttacttaacatagaatgtgtaatgaagaactcagtagctttaaaggtggggtggttgaggagaatagaaaatgaaggtgatttattaactactgttgaaagctgctttagcagttagggtgaataaaaatgatgatttattaagtattccatcagtaataagataaagccacagtgtagggttggaagtacttctgttttccctaactcccaagaatacagaatttctatgacattggctctttgcagtcgtccgtcccttccagaactatcatattgagggcaggagaaagagcttcccctattcatccatgtgtccaacagatcagttagctctgggccctgcccataatagggcccagtatgtatttgttgaatgaatatgctctttgaaataaacatgcctacaggagttactcaggttaagtgtgatttcgcgctaagtaatctggtattccagaagtggtgtccgctcatctttgaagtcctttctaatgtatatactcatgggctacaagtctttgtctttttgattttttttttttacaacagtcagaagtcatttagaatcagacctagtgaataaagagactaatgaatataggaaatgccttttccagttttcaagttgttttccagaatgatttataaaatgaaaactgcattcattttcttatatgactgtaaactggtgaaagtggtgccaaaaacaaaaaaaagtcttttgaccaaatacaacactgctgaaataaatgtagatgattgtgagattcctttaaaggtcaacactcgaatataaagattctgttattttattgaaaagtgtttatatctacagccagtattttttttttagatatgttatttttaaagtaggtagagtcttcatttattttctttattacctagaatactggacagtatttaataagggttgccatttttcttgtatttcaattttatacaggatatacctagagttggttttgttttgtttccattttggcaaaattttttgagagataaaggtgtcttaatgagtaatgcttacagtaccacactaaaatgaaaagtcataggttagctattattttccactagagaaatcagaattacataaacatgttcctccctaagaaggtgtgatattttgagaaagagaaagaagcttggttttctatttcccaatttcatattgtttctcctgaaaagtgctgtgtcatataaataattgcatggtagaggctcaatgaattttatgcatttgtcagtggtcccttttgcagtttattctacagatgactattaatattcctaaaacatcacttctctcgtattgcccaactcaggttttaatggtcctccatttcctataaagtaatgattcagacttcaacatgcatcagaatcacctggagggcatgttaaaacagattgctggtgccgggcgcagtggctcacacctgtaatcccagcactttgggaggccgaagggaggatcacttgaggccaggaattcaagaccagcctggccaacgtggtaaaaccctgtctctacgaaaaatacaaaaactagccaggtgtggtggcgtgagcctgtagtcccagctactcgggaggctgaggcagaagaatcacttgaacccaggaggcggaggttgcagtgaaccgagattgtgccactgcactccagcctgggtgacagagtgagactctgtctcaaaaaaaataataataaaaaaattttgaaagcctggagtttctgattcagtaggcctgggtgggccccagaatttgcatttttagcatgttgctaggtgatactgatgcttctggtccagtgacttcagctagaaaaacattttgctctagaatgaagtcacagtgaagtcacaaatgtttagcttggcatccgtagtcttctgtaaatctgcatcagtttatttgttgagttgtatctctgttacttcccaggaaggactgtgcttccacaaaacttacatagttactatctccagaacacatgtcgtttaggatttcaccttgtttactttatggttctcaaaaggagagtcttctcacttgctcaaaatccatgtcctcatgaagccctctctacactctcaaccttcactgatttctcccttctccaaattcccatgttattgattatttctatctttggcctgtgtgtcactgattttgtgtgcatatatgttatctttcaagtagatttcagacaccctagaagtggggacaccttttttatctcataggtccgtggcccagaatttgacaataaaaggcaattcatcctaaatgtaacccagattaagtatatcaacaaaatgttttataaatgtgaggcagtatggcagagtagaaacacttctgtcctccctttccacgcctttgaaatggagttaataattcctctttttcagagttgttgtaagaattaaaatagaaaatgtatgtgaatctctcagcgcaatgcctggcatgtatcattcattattcaatacatagtatgtacttactagcagctaggaattggtaggagtgataaggaaaggggttggtaggtaaattggattcagaaagtcatttccaggaaagaaaagtatgttttggctgcagtattgctgtattgaccaatagcttctattttctattgttgcctccccttttagttgttgttgccaaatttctcacttcctatggcaggaaagtaagcattattttgccttgttagaattgttattacacagaagggatgctcatcctcaggaaaaccatagagagggtgttgaatggagtggttcctcattcattcatcagtgtccagttacttctgacttctgggcctgctgtcacacaacactcagatatgtggggaggaaagaaagccagggataaagaaatctggagaaataccttcagggcatagaaagaaataatttttgtgagctgaaaagctgaaaatgtttcattcagagataactacatgtgtaaatttagctcaataattaggcatatggtgctttcattttaggatgtatccaccctttgtgataatatccgttgattattagagctgctgcagctttaactacattggcagcagagattcctagtgcatttaagacaagaattcaagagtgaaatggaaaactgaattaataatttgttcttgggtggttttaatctgctccttaaatgtagtttatgcctggaggattagatttggaaacagaacaccaactaatgttctaaaagtttacttccttttattggaacattatactcttaaagattttcagaagaacattttggctgttttagtcttaacatacgaggtacacttaagttcttatgattcaacctaaaacaatagaaagcttttaatctatgatataatttttaacttttaaagtatttcatgttagacttcaaggcaggaattgtttaataaaaaccaactaataaaaggaaagatattctttgttgggcacgaggatatttgggtctcttttcccaagctttttaaaatccccctaggtctatatttttcaatcttagaatttaaaatctgcttgctgttgatggtaaagaaaataggaaaattaaaatcaaaggttatttctgtttacttcccataccttgtcaaatgtttctaaaattgatcgaaaataaaccattgtaattttataaattgaaaaaagagttatattccaagatatagcatagtaggatgagctgaaataggaagtttaaaacaggtgtctttgggagagttggggatggtgatgctttccatctgcttcttgcttaaagctttaactacggtcctattagaatatacctgagagtctgggaagtcagtgtatttgcttctgtggttgtagttctccacccacctgtgatctgaagaattacaccctaggtttttataaggtaaaggcactagaatttagacatttagaagggacttctttgaaaactaggaagaagatgggcaaagtataataccaggtattggtctgagttaaccaggagtagattatttattagaaaactagtctgaatttatgtattcttgataaatacaggttttgacagaaattctccacttttgactgatctggtaatagaggttgaggattttatagccagatatgctgcaggtaatcaggtgttagttctagcttaataattagcttaatttagtattagctgtctttttctgtggtactttacccatgctcttaatcatcttccatccttcagtgtgttctgctggagagaggcggtactaatggtgcaaaggcagacatcaggagagttgcagaagtggtattatatatgttacacacgtcagaagactagtcaccttaatactcagtaattgactatgattggcagcagggaatgagcagccctctcgcttcctggaaccttgagaggtgaattccatacattaccactggtgttcagaaggatcacctttttctgacctgtgggcactcactcctaccttttagaattcctgagggaggaagctgtctagttatatgattagttagcatatttgtggacctttaattatcaatagaattgctcgaaagctgtcttaggaagtaatgcctttgattgatttgaaatctcatgcatcacccgtgttgctagtgttttccaaaacactgagggatttttgcagacagcattttcaggggctgatttgaaggtaataaaccaaactggcagggagggagggttcttcctccacctcagggtgagatctctgctcctttactttactctggagtgccctgtcttcacaaaccccgggggcacacaacacattagtagccataagtgtctgttgtgtgttatgcagcccggagtcttccactggtatataccaagtccccaagttagatatttctcttttaaaaagaattttgccttcatatttaaaataaaaattatattcctcaattggcttttttttttttttcttgagatggagttttgctcttgtcgcccaggctggagtgcagtggcatgatctcagctcactgcagcctcagcctctggagtagctgggattacaggtgcccgccaccacgcccagctaatttttgtatttttggtagagaccaggtttcaccatgttggccaggctggtctccaactcctgacctcaggtgatcctcccaccttggcctcccaaagcgctgggattacaggcgtgagccaccgtgcccggccagttggctcttaaacctcagctattaatttccaagtatttttggtttatgaataacaacagcaataatagcaatgtctgataattttctctttttctctaggtttaaaacagaggcaacagttaaaactatacttttaataaaaagtgcagcttctcagttatactccatcatgtattccctttttctcctaatagaatgtgtttgttattcttcctgttctgagagtggctccttaattgattttataccatcagttagtgttattatatataattaaggaaatcaataatgagatttttaaaatatcatcttggcatagattttgtctcctttatctgcagttttaattctggaatggtgaaaagtatgccagtaactacaggataccatttgttgagtgttcacttcctattagatactatgctcaccactttatgtacatattctcattaaattctcagaacaacaagtatttggtttttctcagaatatgggtatttgacattattctcctcattttatacataggaaattgaagccaggaaggggcaagcaaattgcccagggtcgagcagctcctgcgaggttgaaatccaggtctgtctggtccctgcccccaccctcttcttgtgcactcatctctgctgggttccccatatcccctggggccttggcaggctcagatcttacccaccttgaataaagaatcaggactcctgttgcagtcactcctctgcctgagaaggaagtaaagggaagtgaggtgaggactggcacaatttccaccccagcttgtggcagacaacatgctttaattctgaaagcaacaccaatgctcagtttgtttggaaaagcctctcaagagtaatattgtgctcaacttaacaactatatttactagtatgtgttcatgtatgtttatatccccttgattatatatatatatatatatatatatatatgcataatatgtacatggttatgtgcgtgtatataattatctaaaataataccttaagcattaatgaaagttattgggggttctggaaagttgtttaaatcaagagaaaaacaattgtcactggaagaaacaaatctaaatttgcttcctttattctccctcatcttggggcaactatgactcctaaagtttaggatacataatgttacaattatttaatttttaagcaagagattctataaagtgtgaccacattaacaaaaatgcagtatgaattttaaattcacagtgaggtatatcaccaaaaagaattctatgagtcaaaataatatattgttactgacttgacagtcaagttgtatatagaagtgacaacaaaggctctgtttaattgatcttaagagatccggacagtataactctttctgcaaatggggcgatacagttatcattcaaacccaaataatttttttttaattttaatattttcctttaataaatcagattaagaatcacttccaacaaccctcctacaaatatttagaagtaccaccctgtgcaaggcactggagagatgacagtaaacaagaccattatcaccactgcccacatggagcccaaaggggtagagagtaaggaggccctgtgacaagtaccctgggaggggcctagagttactatgggaacctggagtagaacataactctggcagattagggggttcaggaacactttctaaatgaagtaaagtattagacctgaggatgagtgggaattagccggttgcaggcaagatgaagagggccgcaggataggaatggaatgtatgaaggtccccagggcagccagaggactgagccagagtagtagtgctgagaagaggaagtgggccacagaaatgaagcagagaaggcgtctgaccaggtgtttagactttatcctgagatcatcaggaaccatgggagggtttcaagttgcagaaataatatcaaatctgcatttttggataagactggagtccaggacatgtgttagaaggctcggcagtaatccaggtgagagatgaggatggcctaaatgcataaaggggtagtgaagatagagaaagtgaacagatccttgagatacttaaaaccggaatttatagaactttgtgggcacttaaaaatggagagtgagagaggaaatggagataaagaggttcttgggttcctgattgggtcacgggttttctgatggttggaatcgtcaggagagagagaggagtggagaggggtaatggatgtggtttaggatatgtggcattagaggagaaagatgtccaattggaggtctcttgtgagcagttggatgtatacaacaagcactgcaaagagaagtctaggctagagatgccaatcttgaggccatcaaactatggaaataaataagatctattagggataatgtgtcctgtacaaagagtcaagggcttagaagcccaaggaacatcaacatttacaggatgtgcagagtaagtggtgacagagaaggagcaatcagagagatgcaggaagaaaactggcagagtgtggcactctggagcatttttagatattcagtatttgaaggagtgagtctcagcagtgtcaaatgctgctgagagtcaagataaggactaagaagtgttctgtggatttggtaagaagcaggtagaagatgacccttactggggctgattcagtgcagtattcagggtagcagctgtattgcagtggagctaaggaagggcacagactattctttcaagaaggtaactgtgaacgaggccagagaggtggggtggtagctgcaggatgacaaggggcaatgagaaggctgagtaaagaaacagaatacttgctgggcactgctgagcacacagttggagccggcagctggccccctctgctcactcgtttgatttttccttagcgggattcaaccactctgccatatttggacaaggcaaacaagtagattgacctatcaaggaagacacatgttcccaagtgcttttttgagaatctgatacaagagatcatttgttagtaagaatgtaaatccacttaatttggagtcagtgggtgggggggggatatttattataaaaaggaatctctcatggatttaggtgaagacctcacagaacctggaattacaaatgtgaaggtacagggaaccaagactgctattcctcatttcttactctgggctacttagtcttttgtcttcagtcatacatgctttattctttcctctgcagacaggctgtcttatgaatcagtactcaagtttacatagccaataagtttaaacactaatagactttgtaataagcatctcagaggctcaattccaaattcccagaatggagaatctgacccagctttagttaagtgtctaatcatctatggccaggggggtggagtattgatttttagtgcaaatgtaggcatggcacagagcctcctaagtgacagaaagaagaggattgcctggctgcacagaggttttctggcatctctgctgcatccagacatctgctttgctgtatttatcttattgaaaatttctctgttgtgggcctacttgtcagaggcaagttgtccagagttctgctatatattcattatggaaggttttaccttattgaaatgacagttccccacctttagcattttatattgttccattaactgtcatacaaacattcctgcaaaatatcagttcaggaaccaaacttactttccctgagatggtaaccgtttcacagcctctcatattgctgcttcattatgtgatgaagtctaaacacgtaaatggtgaccagttaaaacacacacctgcacacatcaaatcaagaatttgattccaaatttacaaaataatcaggtcttatcttttgaaatcctacctgtctatcaagacccaatttaaatcttattcattccataaattcttgcctgttcttatcccctgaacagcagaaaattatttttctctgtttttatgactcactttgttttaacctacttactactttcttagtgttaaaggcagcacacacaaaggcactgagatgagagagcttgtggctttgccacttattaacagtccaaccctgtgaagatatacagtgcatttgagctttatctcttacctgtgagagtgatgataatgcctacctttcctggatgtgaggagccagcaagtgagcggatgcacaactgtttgcatgctaggaaacctttgcagatattgattacttaaggaaatagttttggggtttgaagaccgggtttctaaatccctgtctgccacttggtaattcatggtgtggcagtgggtgacttactgttcttcttgggcatgttgtgtggtgtgttttctttcattgctctaacaaattatcacagagtgacttaaaacaatacaaattaatatcttacagttctaggtcagagtcagagtggccttgtttggtttctctgcactgagtctcataaggccaaaaatgagctgtcagctggcccaggctcttctctggctctgggggagaatctgttttacaagctcattcaggttgttggcaaaattcagttccttgccaactgtagaactaaggtccccatttccttgctgtcagtcgactctcagtttctgaaggccacctgcattcttcgtcagtttgctcccttcattttcttttcattcattcattcatttagacaaaaattgtatatatttatggtgtacacatttcaaaatatgtaaccattgtggaatggccaaattcagctaatcaccatatctgttacctcacatacttaccatttcttttggtgggagcacttaaaatttactttcttagcagttttcaagtatacagtacagtgttcttagctatagtcaccatgttttactaccatcttaaaaatatggaatgtagcctggccaacatggtgaaaccccatctctattaaaaatacaaaaattagccagacatggtggtgcatgcctgtaatcccagctccttgggaggatgaggcaggagaatcgcctgaacccacgaggtggagattgcagtgagccaagattgagccactgcactccagcctgggcgacagagcgagaccctgtctcaaaaaaaaaaaaaaaacaaaaaaaaaaaacggaatgcttcataaatttgcacatgatccttgcggaggggccgtgctaatcttctctgtgttgttccagtgttcatacatgttgacaaagcaagaactgaacactcctttttcaaaccagcaacatcacatggagtcctgttcagctgaatctctgactttccattctgctgcatctcttctgcccccagctgaagaatgttctttgcatttaagggcccacttattagattgggcccacctggataatccaggttgctctttaagggcaacttaattgttcttaagtaactttcatcatacctgccaactccctttgccatgtgaaataacatgtgcacaggtctggggattacagcatggaaatatttggggtagggtggtcattcactctgcttaccacttttggtactatgtatgtgtacagtgtgtgaagtcaagcacagtcacttgcatacgtagagctactcaacagtcagtggtaaatcatgtggtcttgatatggttaggctttgtgtcctcacccatatctcatttgaattgtaatccccataatccccacaatccccacgtgtcaagggagaggccaggtggaggtaattgaatcacggaggcagtttcccccatgctgtgctcttgatagtgagttctcacaagatctgatggttttataaggggctcttccttccctgccttgcttcaccttccaccatgattgtaagtttcctgtggcctccccagccatgctgaactgtgagtccatgagccctctttcctttgtaaattacctagtctccagaagttgtttataacagtgtgaaaacagactaatagaggtataatgtacatggatgcactttggtcaagagtaggccaaggcaggcatccgagcctgcatgactcagtgagtttagggcacaggtgcatactccatttgttataaccggtttgtgtaagtttgtacttggttctggaccactattgtctgtaaaaggtataactgtcctgctgacgctatacaggtgctcgtgcccagagaaagagagagctagagctgtccgtcttttccgtctttgcagacggacagtgaggagccaggacacagctcggcctgcttatgtccagagagagaaagagttaagctgctgaccctgaaggcagggagagccacccacacaggtatacgtgggagcagccggctcaagcagccgagacagagcagaaagtgtaagagagatgctgaataaagctgtatttcacctatctacggcccctgagtgttctttcagctatctgccattcatccacccactcccctcggacctcagcatgggctggaacctgaccctggacctaacaacaggtctgttgctgtgatttatgttcaacaaacataaactgttacccaagagatattttgtgcctcaggttgctggtaggagtaatgcaaatcaaaagaagctaggttgatagtcatacagtagttcctttgtatagtaacttctagtatatgcaaatagagaaggcaagcaaacatgctgtatccacatgtagggaatattgatcaataggaagaatattccatttttttcttaggacttttgttgaagcctttgacaaactatcttatttcaattccattattgttcgtattctgggctcaataggggtatttaaagtacccagtgttgtaagactactgaaaatccacatccccctgcccccggcgacggagtattgttctgtcacgttggggtgcagtggtgcaatctcaactcactgtaacctctgcctcctgggttcaagcgattctcctgcctcagcctcctgagtagctgggattacaggtgcatgccaccacacctggctaatttttgtatttttattagagacggggcttcacatgttagccaggctggtctcaaacttctgacctcaagtgatccacccacctcggcctcccaaagtgctgggattataggtgtgagccaccatgtcttgccagactactgaaaatcttgaatgaaaaataattctaatttttgtttattcaccctgcatcttagcaggtatagtgtaaaagttaggagcaaaaactctagagccagactccctaattctgatttcccgctctttgatgtgtccagtgaacttgggcaagttacttaacctccctatacctcagttttgtcatctgttaaggtaaatataggcccaactttgtggagttattattgaggattaaattaaatgtgttgatatatgtaaagtgtctggaattgtaactactatatagtgctgtgtgagtcttaggattattattttaattgaataatatgctttaaccattggctctaaactaaggctgttttgcttcccagggtacatttgccagtgtctggagataagggttgtcacatctgttggggtgagatacagacatctagtgtatacaggccagggacaccactctgcgtccaaaaatgcacaaggctgccctccccaaccccccaaacacaggcttatccagcccgaatttcagtagtgtcaagattaaaagccccagtttaaaccagtggccttttatttttttagtaacaacttcattgtcaaataaaatattcatgtatcatgagtgacttttaacaatgaggaaattcatgactgagagccatagggctctgagttctacaataaagtgaaaagtagaaaataattgttctggtgattataaaaagagatatcacaggaaaagagtgtgcttaacttctagaatatataattaagggtaagaaatactctgatcctgtgaatcattgaatgggagttctcattttctaattttccagtgaggttcttctggagattataaggatgaaattacaggtgacccttgaacaatgcagggattggggcaccaacccctcatgcagttgaaaacctgcgtataactttcgattcccccccaaacttaactaccaatagcctactgctgaccggaagccttactgactaaacataagcagtcagttaacacgtattttgtatgttatatgtatgatatactgtattattatggcaaagtaagctatagaaaagaaaatgttatttaaaaaattgttagaaaatatatttattcaggtggaagtgagtcatcataaatgtcttcattccttgtcttcgtgttgagtaggctgaggaggaggaagaggagaggtgttcatgctgtctcaggcagaggtggaagaaaatccaagtataaacagactcccacagttcaaacccatgttgttcaagggtcagctgtacttggatttggaaacttgctgttactgtgtatgttgaaacacagtgagagttaagataactatgcattacagttgcttatgtggaatttacctatattgtagtagtggtaaattttgcaagtccccaaatgtttttgccactgttatttttatttctgaatattatataaggcttatgtgtttgctctcttcactccgtctcatcccgtaggtatattgaataatttagaatttagggtattcttcaactacttttttctccaccacctctcctatcaattttagctatttgatttgtccatacaagattctgtaggactatctgagactctgttcattcttgtggttacagaatttgtccttttgatgataggtcacttaatcatcaacacttgcatgaccacagggtgcagaagctgttgagactgacatcctggatcatgtaggaaagaacctgggcacattcccataccttccactctgttaacctacttggagaaactgaaaatcacaagacacaaacaaaaataacctgcagttgttcatcattaagattaagcagaacactgatatgttgggcatcaactaagtgctaaaaatacttgataattgattacatgatacaattgctaagtattggttaaaaaaaatatgagattgtgatcatattagaaatacatttgtctcatggtatttaacaaatttgtggcttacatcaatatggcaaaaggaaggtgttaattgcagcgaggatgataaccactgcatcatttttgggtcattgtattacaactttgaatctataggcataaagggaaacacactgactccttatttaaaaggaagaaacaaaacctttttgattcagatcatgtctgccatatttttaaattagggctagaacctgggaaaagcagcttacagcagaactacattttataatgcgatcttttgttcaatttgactagtttgtttttctgacactctctaaagtggtgtaacagtgataagtacttcttcacagactttgtaattaagagagatcagccttaaatataattggcacctttcaagggtttgggcaaagtccagccagtgtcctgtgatgtcagggtattagaacagagaacgtcttctgtcagccaccaccttgctgtgggctcagttatgtgctgagcaccacatcaaagacccagctacgtagcggttgaaaactagttaaggccttccttctactttgaaatgattgttacccacagcttggtttgctacttcctaattcagagccttatgctgaagacatttttggaaaaaactcaacagttttatcagtgaaatatggggaaatacttaagtgtcttcatcaataattagttgatctggggaaaagagacggattaaacactggggaagagagacttggattatagtgaatcagtgtctatgtatattatataatttctataaataggactggccgagtagtagcaaatagcacacacaggaccatgtttcttgcctcgtttcggtgtacatagtggcattttattgtggtactctggaccagtgactagagggtcccaaagactagagctcatactaggaagacaattcctttacaataggtggttaccattagttctgcgaatagaacggagatctgagtctggattccaaagaatactggcaaggcatatcatagtagtaattggtctaagctgagcagggcccagtactgagagggtcaagcctaggagaagaaaaaaagcagaaatggaaccagaatgacaacacttagtaatgtggataagatcatcacagacatacagctgtacaccagtgagctccttgtggacaggaattgaatgcagtataggccatgtagctgtgggtgctcaagatgattgtggaaggaatgaatggttctgcctggcacaaaggaacatgggaatggcatttggtctggagagtccagtactaggacaggttccaccctgctgcccaactgaatctcttagggaatttgctttctgcctggctcaggaagctgtgatctccttccttctctgtgagttctataggagtgggccactgttatggagggctgcggcccctggaacatttttaccattgctcaaagtaaacatttgcagggccggggcggtggctcatgcctgtaatcccagcactttgggaggctgaggtgggtggatcccttgaggttaggagttcaagaccagtctggccaacatgtcaaaatcctgtccctactaaaaatactaaaaattagcgaggcatggtggtacatgcctgtagtcccacctacttgggaggctgaggcaggagaattgcttgagcccaggaggttgaggctgcggtgagctgagattgtgccactgtactccagcctgggagacagagcaagaccctgtctcaaaaaaaaaaaaaaaaaattgcaggccatgtagtcaatccactagatttcaggaccttggttctttgtcagtaaaattcaaaggtgagtagttagttgttgggaaggtgaccttctgagacaggaccaaggaagcaggcgagagggacagatccttcataaatcctgacagaggatcctgtagaaggtaaaatatccttctggtttggaggagcattttacacaaggatattttaaatcaagttagagagtcctaagccaaggacagcattttatattcagtactgggaaggtattttctgtcaatggtagaaggtcatacttctctgtttggaacaacagtcttgtttccagaaatgaaggatatggaattctaatattgttcaaacattgaaaagaaaacagtgtgagagagtcagtttatatggaaatcgatagtagaagatcacaagtatactgacctattttaaataagatttcatgtagttacagtaaaactttggggagaaagttgtattctttcacgtatacatatttgagagtccaaaattttacatttgagaaagagaaattgtaattcagctatgataccctgtaaaattaggtaaaaattaaacatttcaaatagtattatcagttttgctgactagaaacgtagtatttaatgcaagtactattataaaatattttttaacaagacccccttttcacaaagctgaagctgtttaatgttattaacagagtggtatgtaattattggggtaattcagtttttactagcactacagataaattgtattatagaagatgccttaatatttgaggtttataccaagaaatatagccttctttgataacaatatttacttgaataatttatttgattttggtcaaatattttacttttttcaaagaaagtggagaaaaactcctcaaattattccatgatgttgctgttttctgagtgaatcctggaaccccgaccacatacctctttttttttttgtttttaaccgtttgtgccttcccccaagcccacatcagtctttaaaacttaatcagaggacttggctactgtaatttttttggtaaatcatactatttattattacacagttgtcactgtcaaacctttagagtagtttcagctgccaaataatatgaaaaatactgcagagaaaaacttctgttttctcaaattggggcaatagtacatagcccagttttgagctgatcactctagttttaaaaaaacaaccagagtataactacttaaatgctaaatgccttagtgattggtggtggttcaaactttagtttgaactttaaacacaactggctgacccatccttaagagaagatactggccgggcacagtggctcatgcctgtaatcccagcactttgggaggcggaggcaggcagatcacgaggtaaagagtctgagaccagcctggccaacatagtgaaacctcgtctgtactaaaaatacaaaaattagccaggcgtggtggtgagcgcctgtagtcccagccacttgggaggctgaagcagaagaatcacttgaacccaggaggcagaggttgcactgagccaagattgtgccactgcactccaccctggggacacagcaagactccgtctcttaaaaaaaaaaagaagataccactgcagttctcctggcttttaattcatttatgacagcagaacaaccactgcgacagcatatctgcatgtgccacaccttttttcaaggcagaaggaagagggaaagcaaagatacccattgaccttgacaaaagtcccattggctggaactttgaccaatagccacttctagctgtgaagaggccaggaaagaacattaggcttttacagttgtcagtttcagcaagaagcaaaggaaaaagaggtttggttgtggggtaaatatatctatattatctgcagtaggtctaatatatattcatatttttattattgttttgcagctttgtgtagtcttttggaataataaaacaatttcacctctgctgacaaacttgacatttcttttacttcctaaatttatggcggtctttgcccaatttttaagccataaaatagctgaagaaaattggaagtcattgcattcaaagctcatattaagtaatgcagtctattttaacaggttgctgaatctggcatatatttattgctggccacttgccatccatcaacaatagaatgaatgatgatgatgatgattattattattattattattattattattatttttaccattttgaagaaaaaaaatcaggctctatcagattttaaaaccctaccagaagggttagagtaatgcatttgcaggcccaggaaatatttgccatcacttacaaaatacctcagatgatcttcagtccatagaaaatatgattttagggtggtaatgatacaggcatattagatgttagtgcttgccttaaagatggtactgtatcacatatagtctaaaataatcatttgccatttttagtgataatcttagtaatgtagaagtctagatgaaaccatagaagagagctttgaaaaataatccatatctcagtactttttttctgcatgtgtttaatgagaaatctgatattgccatttagtggcaatgtttagagtattattgacattcaagctagtaatattgagcaatatgtctcttttcagtaacacaaaatgaaattattagggtgttcttttggtgatgaaatacaatcctcaatgaaaccaagactcatggtgatgaaagaacccgtgtaggatgcccaagtagaggtgaacagatacctttcaaaggaaagaacttttagctattaaaatgtatgtaaagcaaagttctgtttcagtatatgtcaggtaactttttccctacagggtacagaagtaagagatactcatattttcacttttttaatatagcagtacatttaatgctttccctgtatctgcaaggttttcaaaaaaagaaagattggaagttggttttgcatgtcatgtttctgaaagcctcactcttaaacataatgtaaatttttccagaataatgagataagtaacagaaacatacaaagatatatatcaacagcacatgagtaacactttatttggaagccaagtttcccccagattgcatgggtcacacatttggctcaggacagtgtacaaggtaatatatgttaggcttcagactcaatctgagttcatagccaacctccaccaccaagatctgatgttgggaaaattactttacctcttgatttcttcatctgtgcaatgggactctctctggggagactaccttccttgcagagttgttgtaagggatgagcggagaaatgctttacatacttcctgatgtgtaagtgttcagtaaatgctatttctgtgacaaggatgatgataagaaaatacatttttgggacacaccaattatggattttaagtcttgtggaatcactagttgctactccaagattatccttaggaaccagcatttctggtagtattacatttcataagtaaagtccttttatacatttttattattgttatgcccagataataatttgtaaaactgttatcagcagtatgaaaggattactttcagaatcttacaagatcatggattctagatgacaacggatattccacttattaataatggacaattttaaggacagttacttcagaaggttttttttgttttttttttaggaaaaacaaattttcctataatatgtgacattttatggccaatctatttttatgaattctaccttcaaataataataacttacagaattacaattcataatcctttaattaagaaaatagtgatttctggccttaattcaaaaaggaaatgcttatactgtgcaagtctcttctttaacagctttattcataattgccaaaacttggaagcaacaaagatgttcctcaataggtaaatggataattaaactgcagtatatccagacaatggaatattattcagcactaaaaagaaatattattcaacactaaaaagaaatgagccatcaagcaataaaagggcatggaggtaccttaaatgcatgttgctaagtgaaagaagtaacatggctacaatataaaaggctacgtattttgtgattccaattatattttggatgaaacaaaactatgcagacagtaaattactggggattggagagagggatgaataagcacaacatagaggattttcatggcagtgaaaatactctatgatactatggtagtaaatacatgccattatacattgtcaaaaccattgaaatatacaacactaagagtgagccttaatgtaaatcatggactttgggtggtaatgatgtgtcagtgtaggtccatcagttgtaataagcgtacgattctcgtgcgtaatgttgatagtgaggaggttgtgcctttggggtacagaggatatataggaactttgtactttccactcagttttgctgtgcatctaaaacttctgtttaaaaaaaagtctgttttagaaaacatacacacacaaaagaaaggataaaagggaaatacttgtgccctacaattctcctcttgctaactgaagaatggggcttgactctagggatagcttgtttcaaaaaaaaaaaaaaagaataataataataaaaaaatgtaatttaaaaaggtaactatatctgactttgctcattttaatgaaattcaagctaattcattttcatcgatcactaaataattagtaactttattaactactagtaatactagtgataacctcatagtatttgtaaagtttaaaaaaggaatctaaaagaaaaagcttagtctttataaggttgacaaatctataaacaaatcttttaaagatagcacatttcaattttaaaaatcattttgtcactgctgcaaaaattaaaatgtgaaaatttgaagttgtggaatgatatatgtatgagttagaatgtttgggcttacctttttattacaagtattaaaaaaaaacttttgagattagacattacatgaaaatagtatttgttttctatggcacacttttttagctctccttaggatattaagggagcatctgtgatatcccagcaaggaatacctttttttggctgggcatggtggctcactcctgtaatcccagcattttgggaggccaaggtgggcagatcacctgagctcaggagttcgagaccagcctggctaacatggcgaaaccccgtctctactaaaaatacaaaaattagccaggcacctgtaattccagctgctcaggaggctgaggcaggacaatcgcttgaacgcgggaggtggagattgcagtgagccaagatcgcgccactgcattccagcctgggcaacaagagcaaaactccatctcaaaaaaaaaaaaaaaaaaacccacaaaaatgaatatctttttctcttgatcactaaagatctgtagttgctgatgcttcccatgttgggaaagccctgtaagatcttggcctggggaccaagtgagggagatcacctgtcaccacaggcctgcaaggggtcacttgctggcctcacattgaccacagaggtcttagcacagctaatctaatgaattcaaagtttccgtgttaattaaaaatctgccgaataaacagaccaaaaaccctgaggttaaacctttaaacacaaagtgacaacttctgaactcagtgacagcttctgcctggagaccatagtcatcaaccacaagacagatatttttgataaggaaataactacaaatggtagaccctaagctgatgccaaactgttctatgtaaggaaagtgttctcagcaatagtgcttccttccaaaaaggaatggactagatattcacctatgaataagcccttttctgacctctaacttttgagttgctaaattataatcccttagaatgttttagagaaatggacttatattttggtcaagtatttctttattctttttcttttcccctgtaccctctgccatttggtaacagcacaagagtttttataaaataatgtcaaaatttggccataaaaaaagagaaccattaaatgcatatgatccaatttttttagctagaactggaaacactgggttttccttaggagaacgagatacttcttagaaacagaacaatctgtccattacaagtagtgattactagaattctcattttttaaaactggctttatcagtcattctgactctttttctaaagaaattgctattgctaaccacgctttcatttcactggggaattaatgctcagtggcacattagaattcatgcaatagcattaaataattactgtttctttatatatctcctgccaacttagaagtacattaaaattggctgtaggagaattcaggacacctcaatctgaagaaaatccccatccatatatatatattctccactcagtagataagaggcaacctcgagtacctggcaacaaacgaattgcacacatagcaacaagaagtcgagtaatacagaaagaggaaagagaagctggtccacattagctcccgtggtggtagtaaacttcagaaaatatcagagctgtagacagcagcttggcatgaggagaggaattcatggttttccataaatctagtgacaggccaggtcgaataggacaacaccatcttgtctgccccagtagcatacagggcaggaggagaaaagttaggtacagagctggagctgagagccgaagtggaggaggaggaaggctgtgagaattgaaggatgtagggcaggcaaggaaaggtggtgctgtgagggtcttcagttgagccagctcccagtcctgattcggcatgtgtcattttggtgccaggcctggccacagcttctcagaccccagatagagctgccttctgtgcatggaggagcaggagggctcagaggcctcagatgactgtctgaggtttgcaagcagcaaaaaagtgagggctctgttcagtgtatagtggagaaaatcagcgtgagagagtttccagccttgctcttctctacactaccttgggcctcagcttcatatgtaaaacagggataataataccccagagagggtgttgtaaggattggatgtgttaaattatatcaaattcccctcacagtgcagtgtggtagctgtttgacaaagttaattcacttcctcctttacagcctcggcctccataacccatgatgacgacagctcctacagtttgatttgtagaacaaaataatacttctaaaatgtgaaactactgctcatccagtgaaagaattgttgagaagcttacacataatgctttatgcacctcagatctcaaagacttttgctaatttgtggcaaagagatagcacatatgttgctaccagagcagtccgggaagctggccctgaagggcagcctatgctagaagtggaatagaagctcctcacagagctatgggaaccagggctggtgggaagccacatgcccacagacctaaaaacagagtggttagttctagacgcgtgcctgtaaagtagaggttgcagtgcaaactgctgggctgtgggctaactgtggctcacggatttttttttttaacccttagccagcgtagttttgattttttttttttttttaaatagctttagtgaggggcttgactctcgttttgtcacgtttcccattcacttctagttgccctagacctggtggttctgttcctgtctggcccttcaaatgttctgacccctttttcgagcctaccacagaacagggcacaaaccagagagcagacagtggactcagaaccaggaactgaatgtgtcctatcccattgtcctagggttgccagatgaaatatagcactttcagttaaatttgaatttcagataaacaactttttttttttttagtataagtaggttctgtgtaatatttccatttcctaaatctggcagtactgctttattcccatttataattctcatcctcgcaaccgtagctactaagtagtgattgtcattgtaacattggggtaaagaatcttgaaaatagaacaccttgacagcctttgggaaagagagaaggggatacatttatttcagcatttgaaagagcaaagcatgtgaatgagtatttgaatttcatatggggtaaaattggaaactatcatggctagagggctttttttcacatactgggtgatgacagctagaaggtgactggaggtggccctcgctcactgaggaatgatgtgaggacaaggatcattcctaagactgtcttgggtggcatcttgatacctgttgcatgagagggtgctaaatactttcagatgtaattgtggtagactccaggcaggcagtctttgtgaaggcggagtcacatcaggctctgcactgtcacctcttggtgacattagcctcttttctttcctttcccgtaattgctctgcccactctgagttcagctaaaggtcaaagcatcaaaggaaggagaacttccttcctaagttctcccttatctgtttaacctcctgaagcctaggaggactctgaggaggtggcgtgagtggataaaggtcagccaggctcattgagtgtcttctagtcaggtgccctgtcacacctgatctcctcactgtgctgtaagggagataatacttacttttttagtaagctgtattttctgagcagttttaggcttgtagcaaaattgaacagaaagtatagagagttcccatatacaccctgtccccacacaggcacaacctcgcagtctcagcacctcaacccacagtggtgcatttgttaaaatgggttattctttttgaaagatgagagaactaaggggtagaagggcagaccctgaggcagctggcctcaggcttatccactgtgacctgctctgccatgtggctgtgatagaccggccttagtatcaggtctcttgctgcccagttgtccttctggccctccagatcttcattcccataaggaaatgtaggtggtggggatagcattagataagcggtggaaggggtggttagattgccgtcttttcttgatccatggagaaattctcttccaatggataagtgaaggtttggagaaattgtgaattaatttcccccaagttgctttttatctgtgtctctccgttctgttttccagttccaccaaagattgaaagaaataaggttaattcaatgaccctaaaaatattttatctgaaagctctagaagttacttttatatgacagccaagtaattttaagcaaagtttgatggaaattgctgtcaggcttttaaaatcactgtttttcaaagcatcaaccctaagtgtagttttaagagaaatggcacatcactttcaggtttaacaatcagtgagttagattgctcttccacctcagaccttgcctgaatcagacacagccccttgtgtccccaagaacagcagggacatgagtatcactggaccacagaacttcttccctttcatgacaaacagcggactgttatataagtgagccaaacatggcctctgtctgttggtctctaggttatttcctcactgcaggctgagacccgttaattcaagagcccgccaacaccaaactaatttttaatacatctaattattttaaaaatagcccgaacaagcagatttttagcatttagagcctgccttacacgttctgtgaaaccttacctagcatctgttggccattgataagatagagctttgtggttttaagacaccgagctgctactgcccttcaaggtcttctgataatagagttactccatcatgctgcaaagtgacatcacttagtcctaagccctcattccgatgcacctctcccttgggagttcctttgtcctcctccccttctgcatggtgacctcctcaccctaagcctctggatgccctcccatgcaaccctgtacaaagcaccactcattaaagcttgttgtgtgttaactgcctctgtggtcctgtctttttcccagatcaacctcaaatccctcgaacaaacccccactacacagcagtaccttggcacaactaagattttatgaaagctagtgtatgaacctgcatagctaaagattaccccacattgccttacacctggagaggacctttctactcttcctttcttcctccatcttttggataccaaatagttgtgtatatttttaaatgtatatattgataaagagcttgtgtacaatgtaagtttgcctggtttcacatatatttgtccctcctatttatgtgttatactaggaaaaattatgaagctcttttagattgcaaagatcacagacattcttaggtttttaataaaagtaattataatgcctaaaatgcattgagcacttaatgtgtgtcgggcaacatgttaaactctttacatgccttgttttatttaatcatcaccacaaccagtgaggtgtttttattcacattttgtgtgtgcagaaagtgggctcagagagattaattgccttgcttagagtcacactgacgatggcagagctcagatatggacccagtttctcatatgcgttcgcccgtgacccgcttttacgccttactcctcagtaaatgagaagcttttctacaagtacacatagggaagtaaacaaacagtctcagcaggcaaagaggaaaagggaagatgattcaccaacattcaggactccacagcattgttgatagttctatagctgctgtacaggcctaacacagttccactggggaaccatccaagtggcaaaatcatctgtacctcagcctcctcttaacttttttctccttgcctttcttgtcttctttctcatggcttttactgcttcacagccctttctcctgtgtatttgtacttctctgtttctgtgtcactctctggcctctaggttctctctgaatgtttcccagttacacttccctaggtagagtggatggttgggttgactcatcccatccattagtgagaactacacaccagggcgccccacgttggaggctcatggctagctctcagcaatctgcctttgagttgggcaccaggccctggttcattcagctgggccagcatcacatcctacaaactacggaaattttatgtaagaacccatagaaggaggccataagtgggacttgaacttgtaggcttcagtgaaatagggcaatgaaagcccaaagttttcctgagatctgtctggaaaaatcatgtaattttcaaagacttttgatgtgtctaatataaaaatttaaagattatgtgtttaaaacttcagcaaatggaagtatttgctaagagtagttctagcaataaatatgcaagatatgaagtctatgcatactagggaaattccaacgtatttctttcttcagcgtgcttgattagatcaggacattaaacttaatttgttagaaacaacaatagagttgtatacaacatttaattagttttcttactcttctatattcacaaacatttactgagtatgtaaacaggcagtatcttatgtttccatacattatcaatgagatagtaaatgagacagcatcctgtatacttcccttttagtcctttagaatcttttcatagtgtagcagatactcaataaatgacctggcctaattaatgagccctgatgccaattaagaagaaagtacaaatcaaagaatcttttcttataagcatggagtcaaggggaagtaatactatttctttaatgccttatacccaatttaatattttctgggttaaaataatgggttgcaattatgaaattttggtcctttgtttcctttcacacagcgtgtcagctctacctttcaccaggagcaaatatacgtattcaggaagaaaacatctttggcttgctttcagtttatctttttttgtgagggtttcactactgcatttgaaatttgggcccattttacttctacgtggaatgtcaggctttagaaccctaattaagttaatgaaagactacaaaagaaacctaaggagcctgtgaagagaggtgatcaattctgtccttgttagtagttaacttttagaagtgacttccttgtcctgccagctcatgagaactgggtctagagaaattaaatgactttatcctcatcgccactcagctgggtaatggcttaatactacaaaattaaaagctggtagccttttgatgtttcaaatatttgtgtaagtcgtaaatctgagttaacaagttgattttatatgtgacttttaaattgaagcttatagttattctatgcatgtgtacacacacactcacacaatgtcttacagttagctttaatgtggtaaatcatttccagaagtgatcagctggtggaattggttaacaatatgactgttcctctttataattgctggataaacccctcccagtgctttgttcagggcattttgaccacatcattttcgtcttttctaactttaactcatagaaatcccatgggatcaggaacccattttgagaaatatgtcagcaacttttgaaatgtaggaaactaaccaattagtgtcagcttttcccttgagggaagaagataggaaaagttaatatatactacagaggttactttaggagatcctttactagtggtacattgtataagtgatcatttttgacaaagctgaaacaaattatcgtaacttttttttctgttttgatgttcagtatattccaaaagcttttgaatttataaagtatctttggaaatttacaggaatgaagaatttactaaatgtagtacatttaatggaaaaaccaaataaaatcaaatataatctctaggtgttctgtagattttttatatacctagtctttcagaggctcattggtttctatttttctgtgatgtgaatttaattagttttaatatagatttaaaatttaataaacgtgattacctgccatctgtcaagcagtatgcaaggtgcaaaaacatataccacgatcatgtattccttacatgcatcctgtaaggaattatcccaaattttcagataagagtcacaaaaactgtgactcatccttaagtatgtgactcatcagtggcgttgtagggattataaatcaagtcatgtgaccctcaaatctgttttacttctcaacaaaattaatgtataagaaaaaaatcctgaaaacactaccatatacacattcttttgattgttgaaagatcaacaatctgattcagtaaaggaagattttttttgctgactcattaaaggaaggtgatgcaatgtgttggttaatgccatgggctttggagtcaggctagcttggagatgaaccctggcaccttgtctgtggaaaaatgtggtgactgagtaaagttgttttttaacttccaaacctcagtttcttcatctccctaacaatggtaataaaacatatttcatagggttgtagcaagaattggttacaatactaaagttatagcatttagcagagtacttagcagatagtactgattcttggtaactgttggtagtaatagtggtgagttaggaaggtaatttacaagttggttaaagatgctgattgttgtgttcaggaacatatgaaaactttgttattaataaaatgatactgatctcaatgaagattttgagtggtaaatggcccgtaaataatatctataactttgtgtgatgctttaagatactctaaaatatggagcctgattggaacctttttcaattatgtccatattttgattactgagttctagacagttgaagagtcccaatccttttaaaaaatatgcatacaaaaataattatatgtgttctttgagtcattgaaaaaagtttatacaactaatttatggcagagggatttggcttttaaaaccattattggtgtgtagactctgaattaggaatatactggatcaatcttcagttacatacatatacacacatgtatccaattaaagattgattacattaaaataaacaagtttttccaaaatctaggcataatcacagtgttattttttatttcctgtaaatattttaaaatacttctccatatagtcttcgtcaggaaacatcaaagtggtttaaagggataacctgaatatttgtctgtatgctgtgaggccaacaaagtaagaagaactttgtgcagaaatataaattttaaagatagtctttgcagatttaatctgttatgaaaatgaactagataaatgtagacatggttcatgcttttaagataagctaaattcctgttgttgggaactgacttttgaaaatggtatttgcattaaataggattaaatggactcaaaaacgaaaacttcccatttgtaaacataaaagggtagtgtgtatgtgtaccagcatgtttgtatgagcatgtgtgttctggtttatataatcataattcttttacttagtcatccttttaactaatgaattttaatgttttagcctttgctcttcaatatattacctattttgtagcaaaaacatctccattcaaattataatcctgtttttattttttttttcagatgatgaaacatgcttggaataattataaaggttatgcctggggattaaatgaactcaaacctatatcaaaaggaggccattcaagcagtttgtttggtgagtagatgtgctttggtttcttagtgacgataacttctccccaattgcttgagcttatggatggtggagaagtctgtgtaacatggccctccaggccatttggttaggaaacttgcacacctgatggaattagataaggattgtgcatagtgtgtccttcagctagagtagtggctatgtgttcgaataacctgctggaataacctgcgtaactttaaagagtactgacgcctggggcatacttctaaagattctcacttaatggttatagggtgcagtatcataaattttagcctctggggtgattcctagcatagaagcacttggtgggctgcactaactgcttcctgttaggtaaaagctgtgcctttatagataatctgggcaaggcagccagccatggtgatcttcactgtatctcaattttggctataggtttctcctgtttgtaccatggaagagaaagtgaggatggattaggttaattgaacttccatttatccacttttgcaagctttattgcatttggttcccacagcagccctctgtgactggtagtgtgggtattaataacattccattgtggaagtaaggaagctaagtaacacaagggtgtcatggattctttgggtcacagagctgcccagtatcctcctactgcacttgatttctttctaatcctcaaaatttgtctgtaagtaacaggatgaagggaatacagtgttactctggaacttctgaattcaacaatagaacactttctatactttaactgaaaatgttaaataatagcaattcacataataacagtttcagcacacatttattgagcacttactgtgtgccaagtgccattcatgcattatcttatttagcctcattaaaatatacattttataggtgagaaaaatgaggcccagagaatagttttcccagagatagccacctactaactggcagagctgggacttgaaccctggtgtggctaacattagagtccatgctcttaattctgacattttgcttttccatttatttagaaccttccatgtgtttggctttacttgtagcactggtgataatgaaaataatacgagtctttgcacaggtctttacacaagtctttgcctagtacacagcatataatatgtaaatagtgatttatcaatgcgccaggtggttcaatatatacttccatgaaattctgaggaaccagtaggacctcaggttgggagaaaggcattgcagggtttgcaagaacaggtagaaagagctgggaaaagtagaagaaaagagactgttggtctatcagagtgacacagttttgagatgaagagcacctatacctgaagtagaggcagtagaagtaattccagacacttctaaagtagtgtttttaggacccagctaccagttaacatgggtaaggggaggtatgaattgaagagagaaactctgaaacctcatgcagagccagaggcctttattttttcattgtttattacaacattttttgaaaaaattataactccattttgcttttatctctataaaagtctttggtaccattaagaaatcagttaatgtgttaaattgccataatctttatcagagggactatttggttctctgttaaaacatttatgattttaaaatttgttattgaacattaaaaatatactaggtctcttaggcctgacgtttgctttttggttttcattggctttttcggtaaaaaacacttttcataatcaagaacttgctcttagaaaaagagcttcaggtattagcataaggaaatgaaatattaataattcaaatggtatttaatctcattccatcttcaaattaaaataagatacataatgattttcttattatagaaataccaatacaatggaacttgttacaaagacatacaaagttttcatttttatggatgagaaatgatttctttagcccacttctcagccaaatttcttatctgtgtaatatgtagtcccgtatattcgctcagcaaaccagggagaggataggaaaatgtaagttctttaccacctggcttcttaggaaatagtttttagtttgagctaagttattttgagtcttgaccctaaaaacaacctttttggagaaagtattaggcattatgaatcttttcccagttattagccgttggggagctcttcaggtctgcttccttctcatggttgtttctcaccagctatgttgaagcatccatctttttcctagacagagtaagactggttccttcctaaacaactttaatgaatataaaaaaaatcttaagtattcatgatctcccaattccatcttaagcaggaaactagaactatttatttcaagatttcagtggtacaaaagatttcaagttaaactgtacctcaaagagaggtattttgtgcttgaccaattatactcatttaaagctaaaatacaagaaatacaaatattaacttaaggctcttaataacttagaaatgaaatgtcaatgaaaatatgaagctgatatatttcaaaatgcccactttaaaatattccctccagtgtctctctgaatccatagttctagcttcaaaaaatttaaaggaaattggattacagtaaaacatttcacaaaatgcaagggtcttcaggtttctttctcattattattagataagatttacaacttttatcttttttgaaaatcaagtgttttaatattctattatttatagtttcctaatgataacttcttaacttggcatttgaaaggcatgtgccagtgaaataattttcacttatatttatagatttggtcttggatcgtccagagtgctaattacatataggaagtgtagtgcccagtctttcagcagcaattcattgtgctcctgagtgcaggatcggctgcctgccacttgcacagccaataacaaggatgaagttcagtgaaaggaaaatgacttttatttccaaagctaggagtggcaggcttactcctctagaaactgcttcagacttgaggctgggaagagggtcttaaaaatgggacttggactgggaggcatatgggaagggtgcctgagtataagatctgcatgtcttgttctggtggctgtatctagctgtagtctacctggagtgcggctgacatatcaacaatagctgggttgctgactaactgccttgaggtagtctctgaagttttgcagctgggtctccatgcttgatctgtcacaagattagcccctggaacttcttagtaagcacatattagatccaagtatacagttacgtaaatgttcatggggtgaaggagtgcatagtgggaaaggggagtgaagtttcaaagcatgtttcaaggggatattttaagactaaggaaaaaggtttctacagtttgtttcaaggttacatcttgagactggaagaaaggacaaagaaaaacattttaaactgcgttttgaagctaaactactcaattacaattgggcatcattgtcacaattccacaggacaccataaggaatctggagataagacatgacttgtttgttctaagtttataggctaagtgcatgcctcatgactctaattctagtactctggaaggccaaagtgggaggattgcttgaggccaggagtttgagaccagcctgagccacatagcaagactcatctgtacaaaaaaaattttaaaattagccaggcatggtggcacacacgtataatcccagctacacaggaagctgaggcaggagaatcacttgtgcctaggagtttggggctgcagtgagctatgattgcaccactgtactccaccctgggggacagagcaagaccctgtctcaaaagaaaaaaaaagtttatagactaaaagatgcacacgtgtaattttaatacaagatagaaggtgttgaatgccagggcaacaggaagtctccatgtcattggaattcagaggaaataaaccacagaggtcaggacttgtaggggatggagggtagttagcatcagtcagaattcatacgggggtgaaatttcattttagagtaatgtcttcttagaactatcactaaacaattttagatctaattatatttaaagttttgcacaggtgcactttgatgtaattacatcagtcttaaaaagtctgttgctccttggttttaggcctattcttttcttgctagagaatgcaatcacaggccgggtatggtggctcacacctgtaatctcagcactttgggaggcctaggtgggtggattatgaggtcgagagattgagaccattctggccaacatggtgaaaccccgtctctactaaaaacacaaaaattagccaggcgtggtggcatgcgcctatagtcccagctactcaggaggctaaggtaggagaatcacttgaacccgggaggtggaggttgcaatttgctgagatcgcgccactgcactccagcctgggcaacagaatgagactccatctcaaaaaaaaaaaaagagagagaatgcaatcactaatgaaatttctaagagaagtttctgagacatttatttttataactcagaagaaactttaaagattagtatatcagtcgatagcccgtgataatttttagtttggtgctgttttatactttcattgaaagaattttagactatgtttaatattattgcttattaataaatccagcattaccctctccctttcttagttatggtcaatttacatatattttatctaggcaaagtattttatcaaatatttttctgatcttttcaggtaacatcaaaggagcaactatagtagatgccctggatacactttttattatggaaatgaaacatgaatttgaagaagcaaaatcatgggttgaagaaaatttagattttaatgtggtaagttaaataagaatttctaattcagtccttaaatttcagttaacatggataaattctgtagtgggccctattattgtattataatgtaccctaacaaaaatattgcaactttaggtagtacaaatactattatcttatactatattcttaaattgtcctcactacacaaatgtgtgtctttgttttttggcaaatgaagagtaagagaaaagaagttagtatttattgagacctacatgtgcctagtattcttgttcagtcccactgcaactctatgagatgggcattaatttcacacctttgtatattaaacatcttaacctcagaggcttactccagattgcacagctggttgtgtgtcaagagctgtgattctgatgtaggtccatggggctccagtgcttatgcttttacactgtgtcatggtgtatccagcagtagcagcagcattcattttcccgtaaagaaagattcaaattttgtggatcttattcatctctcagtaaaaataaattgattatatatgtgatatattttttaaattctgtatgctatcattcttagcaaatatttcatggcccattgtatactgagggaaagaatcagaattaaggatagtgaatacttctaatacttcttgataattttgactggggaggactacgtcttatcagctctaatttgatagtcattgttttactttataatgatattgacaaagaacttatactaagagaagaaagcatgtaggccatggaagtttttagtcgttcacttcagtgtgtgttatcagtattatttctaatctgagactactttgcagaaattctcgtaaagtctcttgtctttcgggtaagcatttgatagtttctgtaaatcccagtcaccacgcacaagtaacatgctgtgtgttgaaagtggacaaagagaatttccctgctgttgcctctgctttgtggcactcttgttctctcagagaccaaatgaggacaccagtgttaggtagaatattaaggatcagtaaagctaagtctttcccccatctatttcaattaaaaacttatataaattaaaagtttaatattttgtttctactcccctaattaattgctatatataccgcatttgggagacctaaaagacaggcagatgagtctgtgtttaatttgcctaataattgaatctagaatataaaggagagaatattccgatcaatattaagggaccttggggatcaatgtgttaaacccttctattttaaacatgagagagcaggcataaggagctagtgatttgctcaaggttatggagctatttgattagaatgacctgtggtagtgctgatattgatagagctaaatatgaaaaattaaagcactggaaaaaaacggtttcattttggaggcttgctttcttaataatacttctgtggaccgggcgtggtggctcacacctgtaatcccagcactttgggaggtcgaggcagttggatcacgatgtcaggagtttgagaccagcctggccaacatggtgaaaccccgtctctactaaaaatacaaaaaatagccaggcatggtggtgtgtgcctgtaatcccagctactcaggaggctgaggcaggaggatcgcttgaacccaggaggcggatgttgcagtgagccgtgattgcaccactgcactccagcctgggcagtagagcaagacgccgtctcaaaaaaaaaaaacaaaaacaaaacaaaacaaaaaaacttcagttctaccttcttattaaaatcagctcctaccttcaaaaacctgcaggcttttctttagctatgtatgaaaccgactgatatctgtcttttcaagaaagggtaggggaataataactaaattcctctgaaacactaatgatggaaaactggaaagcatactttagtaacacttgacttatgaatagtgtccaagtttcttactgaatcttgggttggtccatctggtaattgtagcattgttgccccaaacctcctcaaatataatagcggtttttttcttttcacgacctgtgcaacctgtggtagtctgaggagctctggacttggggccagaggttggggttggtggaggatgaggagcagttttatttaaaatgactaagtgcaaaggtaacagacaagatgttactgtaacagaaggcagttggctgtcctcagaccaccacaggatgccttgaatgtgttccatgggtcctggagacttgggagaaggaaagatgaatttagtaggggatatcagactatgtagaagagaagaatttactgggcttccttacttgtaaggtgaaaggattagactaacattgagttattgctaagatactgaactttgaagttttctttatttaaatttttattttagtttttaataaaattttactcaattagtatgcagacttttgcatatatattttaggcctgttaatgatagttttgggttatacctttcaagatataattttaaaatatatacaactgttatgtattcataaaaattaaatatacatatttcaaaaaattacagccatatttctcaaatgtctttattatactattttcttaatataagaggtcttgaaaaatatttgttgcaggtctctttgggtattaccatgttttccttttaaaaaatatgttgtcaacaatatccaaacaataatgtttcccatattaaaaatagtaacatacaaattctggagaggtatattgacttacttttctaatcattacattgtgaagttttccagcttactgtattctagttggttttaatatgtcacattagaatttgtcttatattcacccattctatccagaaatccaaatgattatttttaaaattacaggatttttcttcaaaaaacattgagaaatttttctcatttatatgaagaaaggagaaattgaaaaagccttagcaaaaaaaaaagaaaaattatactaaataacatgtagtatcattctagcttataaatattattacttatattttagttaacactttttcctgataaggtattctaattgacagtgtaagggtattatttaaaaagttggccaggcgcagtggctcactcctgtaatcccagcattttgggaggccgaggcgggtggatcatgaggtcaggagattaagaccatcctggctaacatggcgaaaccccgtctctactgaaaatacaaaaaatttcccaggcatggtggcacacgcctgtagtcccagctacttggggggctgaggcaggagaatagcttgaacctgggaggcaggggttgcagtgagctgagattgcaccactgcactccagcttgggcaacagagtgagactcagactcaaaaaaaaaaaaaaagaaaagttaatgcatctaaatttattgcaaagggaaaataaaaatgaaacaaacattattgttgagagtttgtttatcctatggtgctcctaagtataaacaaattttacactcaagaataaatttgttaatgtgaaatatccaatttatatcactgaaaagtataaaataaatgttttgtattggtttatactgtaattaactaaaactcatttccttttcattagggcataggaagtcgattcattttgcatacttggtagcacaaagttcaaatgactttaatatctggcttaaaataagttgggataatatgttctggggagtaaggaacaaggacttcacagaaggagcttgtattcagttcaagtatctgtagaggcacatagatattagcagaaaaccctaagtattgactccatgaatgcattttctaattttaactcaaagtaatcttaggacaaaggatctaaaactgattcttggttagtcactcttcattcactcatgtgttatttactaagtatcttctaaggatcaggcatttacccttatggagcatttagtctagcaggaaaagtagtcagagaaccctagctaagccaggctatctcaggagggaagaaatgaaaagaggtcaactactatttggccaggcgtggtggctcacacctgtaatcccaacactttgggaggcccaggctggtggatttcttgaacccagaagttcaagagcagcctgggcaacagagtaaaaccctccccaccgccgccatctctatttaaaaaacaaaacaaaacaaaaaaactccagcctgggcgacagagcgagactccatctcaaaaaaaaaaaaaaaaaaaaaaggaaactatttagtaatatgtgatacataccaagtattatgataggtgatttttttcatgggtgtatcgtgtttaatctttgtgacaagcatacagagtagtaactggtatttttccctatatttatagatgaataggtggttaattaggctgtcccaaattatgcagcaagatctctggtttgaacacagtctgcctaactcaatgaccttgtgtttttttaattggagaagaaatgcaaagagttgagaaatatatacgcagtcagagaatttgagtcctctgaggttaggcatgtcatcttaatattagattactaattagagtttattgttcaatagtgatttgataaatatttgttaaatgaatgagaagttaagccatcttatcctacttcctgacagtctgtgctatactcagctggaagaaaagctcaggtgcaagggtagctgtattgtgtcatctgtttatatagttacagatgatctggagttcaagtcacttggtctacctgttattacctaacctatttccagaacagatttgtagtggcccctgataacaggaagatcagttgcataagaacaaatgatcaagggtttcctatttgggcatttctaatttcaattgtgttcttttactggcacttaaaacattattggttacctagaacctcacatgagaaatattgaaaactatcttctgtaatgaattttatggaatatgtagaatttttctccagataacaatttcttatattaaccctctgtaaaagctaaagctgtgttaaaattttccttaaagctgtatttctggactgcagtaaagcgatatctcagtatgagaggcagagccttgagaatggcaaaggatagatgatcagcctgctgtggacactaactagcaacaccctgtaattgtgatctttggcaagcatctggatcatgcctttagttgtaatgaacactttgtgttttggagaacagaagttctggtggcaacagtgactttttttttttctttaatgttaagatccagattgtttgcatacccagttggaatgccctcctacttttcaagaaagtaagttgtagggttccctgtcaggaggatatatgttgacttcaagaagcaactttggatcttctcaaatgcatgactgagtactggcttaggtccagagttccatgccatagagtatgaaagaagttacttttgccttagtgttgctcctgagaaaggtctgttttagagccacattacatcctgatgggcgcagataactaagttaattatcctgttaaatgaagttattgagtgtgttccatctgaatgctagggaatacctaccaagagtgatgatttgggttttggttttcagaggatactgtgctgttctctctgatggtaattaggactgctgcttgagagcctctggacctgcatggtaaaaccagtctattaacatagagaagagaggtatttgcatatctttgtggcccacagaacttggactttgttagcagtcttaagagatttgtcacgttgcttaaataggaaaccaaaggctgccaggacacactgtgacagactgacttacactgtgaaatattgcaatttaatcgtttaaaggagttgtatacttttaatcctcaaagtgttaatccagcacacactttgaagtatcatttataaataaaggtgtatgctaagcctaaacataggcaaggcttattggtagttaccagtctttaatcaatggttttgaaaagtctcatgttgcttctaacaaagccattgattaaagtatcgttatcatgtgttagtaatggagcagttgttatttacattggattttggtgaaacagttaatattaaacagaaatattgcattggtatgtagtgggcagttattaaagcttgcttgattctcatgtatgataatagtcccgtaccccaggctcataattcactaagtagaaagctgatacagagtttggaggaatagctagcaaaagagtagtctctgattgtagagatcggagaattgtccttttaaaaacaaaaactattacacttttagttcactctgaaaatcaaacactcagaatagaatttaaatatgtctgataagttcttttccaagaaatatttttccatttaatgcaatcaatcagatctgtcatgctgtatggaatcataagataataaggagaattctaatataagtgtgactctaaataaacatcataaggcttgaagatccaaagaaacaatttattatctgttcctcgagcttgcatctcgatatagctcctcaagcaaaaggaaactggctgaatctgctccaaaactaaaatttgttattttcattgtcaagcctgttatttcacttagtgaaatctattaaaatacgtcatcgtatagctaattttggtgaataagttgcctataaaaatatcaaatttcagagttgtttaaagtgctgtcttgtctagtgtgaagaggttggtctttcaggtactcatttggaaacagattttgacgtgttcattttctctgttgcctagatggggttagatacttcctgtccatgatctcatggtatgttggtttagaaaaagcctttctttgcagagagatggagcatgatgttaggattgaaggagggaagcatacaaaataatttatatattagactctctttttcatgttagcagtctttgtcactttatctcgtaaatttacatacatgtatagtaaatgagtagacaaaaacatatggaaaagggatagatctaaggtggaagttatcaatctcaaacacccaagacaataatagagattagtactgaggcataattttttcatgatttgtaatactcatctcttgattttaggtgtaaatttaggcataccatgtattttattcaatttatatgaattcaatttagatgaatctggttcagtgtgttctttgattaagtggtcattgctataagtaaatcaaaatgaaagaacaatttctccaattctgatttttttattggttggtcttaaccaaaaacttccaatctcctcttgcttatcagttgacattaactaataggtacatggaatttaaataaaagacgggatgtacttcttaaactgccactgatgtaagactgtgtactagaagccactgaatacatggggcatactggaatgcaatcctaaagatttaaaagggaagttacttttattttaaaacaaactcagataggtagactgcaaaattcacattaattgttaggataaatctcacaagatttagtgttacaggctgctttgtctgcctactgtcttccccctgctgcaaataccccctctgtcattagggtaagtcggtagaaaacttttagaacattatgactattaataagaatgtattcatttaaatttattatttaatggaaattagaatcagaagtttataaaaatggcctgagaccctcatttgtagaaattcacttttgaaaatccagatttcatacaaaatatatcaagccccaaaggaagttggtcaacttctatatttcaaaagaggatttttaagcccttgagaaataagacctcatatgggccaaagaagatgagtatttatgattctaaagtttctgattttccagtgaccctgggaaggtaggttttagttcgtttaggctgagctgcacagtggtagtggcaacagctgtctattgagtgtctgatgagtgcgttaccagctattgtgtacattgctttacatcatggaggaattcattgtccctttctacgtatgacaaaaccaagactcagaataaattagttatctgggacctcaaactcagatggcttccaaatcagccttcaatcccaggtctttctgatttctgcaggatagccaaccaatttggtgtggtgggagaatttttatcttcttagtccttttcatctacgaatctataaagagttaactaaagggtctaaatttcaatcttttggcctaaaaacataatacaacctagaatactgaaagagacctcaaattaaggtttctaaattatttaaacttaactttgaaaaggagagagaaagaattatatgttggaaattcgaatgtggttctggttttcaaacagagaagatggtgacttgagaactagtgatggtggtggtgtgatgttccagagcaagatttattaaagacaaggacatagcagtcactggtatccttcatggattaactaacaaaccagatttgcttcttaaacaggctcactggacagactattagatccatgaaatccaaagccatagcaagtgaccttgagtatggcaccttgcagggtcatttctcaatatcgtacagtacaagataaatagaatttaggttttagaatatgtaattggatcaataactggttgaataactgcatccaacagttgattgatgtctagctgaagatatatttctggcagtgtttgacatgactcagaccttcaccttggaataatttttatcggatgtctacataaaggtcttgattatccaaaattttcacggcaggaagagaaaatgcattatgtcaagaacctatagccagaataagaatataagatcatcttaacagtcttcaataggcagaaatgtgggaaactgttaccaggtttaaaaactgaaaaacacaagtactaattgagaggaatatgatttgagggtttaagtttattagattttattattagatattattactcttaaacataggaaacgtagtcacgtgaaccaaactaaatacatgggttagcttcgcttttccttatcagtaattttgtagaatattaaagcctttgccaatatttatgtaaaattcattcagagtgatagacctcaaagttaaattacacctatatatagtacttttaatcagattatatcaggtgcacattacaaattataaaatacagttaaacacaccagtcttattttgtgatgtttttgcctaactttgacttagtaattctgtctcctaacttgttttcataattgtccttttataggaatttttttgaatttttttaacttaagcaattacttgactttaattgttagattcttaaacctttttacagagagcatgtaaggataaaattaatacatacctccttttttttctggaaatattttatcccactaaaatgtagactcaagtgagcttgaggaccttatcagtccttattgccatttccctatcacctaggacagggtctggcacatagtagttgcttaataaatgcttgttaaaggaaataatatcccatgattttgactaagtttatttgccagatattgactccatatattataaattgctgtgagtcccatgattattagtgaatggtttgatgttaggcaaaagtgcagtaggcccaatgaacatgaaaagaagctaactaaagcttgaaatgtgctttataatctaaatagtaggttagctattctaacttacctagtaacagaatgtaagacagatctatttactaatcaagtataaaatattagcagtaattactaattatatgaccatgaataaagagacttggtgcattatcctgtgaggtatatagaagtcagaatagcagagccctgaatcaggagccacagtactcaagttcaaatcctgcttctaccaattattagttgtctgaacttcaaaaagtcacattaaccactataagtctcagcttcaacattttaaaatggatataagaatagtaattaattcataaggtcattgtgaggactaaaagagtctatataaagacattagcacaggacctggcacgttgtaaataataaaagcaagctattattggtgtaaataagggctatttcagcatggtataacatacatgattattatcatgtcctttatgcgaagatgaaatatcttctcagagatgagaagaacaatcccaagccaaaggcaaaaagttggaaaccagcactagaacccaggtcctcagacttcaaatcctatttgcagtccagttgtgcatcatgatgaaaagattcctagactaatgttgaagtaccagcctaagtataggctgaatagcctttcaggaagaaaaagcagacaaatgaataaaataaaggagaatgcagagcagaaaaaaaaaatgccctggccccattatgtttacacaaatagagaatatcaaatattgtatctgctgttgaagagagaggaaagaactttatttgacaaatatttttgtaattttgtttaggagtcaaaattatttttatctcttgcattagtccgttttcacactgctgataaagacatacctgagactgggaagaaaaagaggtttaatggatttaacagtttcacatggctggggaggcctcacaatcatggcggaaggctaggagcaagtcataacttacatggatggcaacaggcaaagagagaaagagcttgtgcagggaaactccctttttaaaaccatcagatcttgtgagacttattcactatcacaagaacagcacaggaaagacccctccccatgattcagttatctcccaccgggtccatcccacaacatgtgtgaattatgtgagctacaagatgagatttgggtggggacacagagacaaaccgtatcatttattttaagtatgttttttcctttatttttaaaaattgtcatataatgattgtacgtattttgggggtccgttagtgatgtttcgatacgtataatgcacagtgatatttaataccttaattttaaaagggagaacatttccccctgtatataaacttctctgggcaagcataagatttgaacaaaatttaagtatttagtataatttatcacaataatggttttctgaattgtgtactatcatcatgtttgaattttttttttccatagaatgctgaaatttctgtctttgaagtaaatatacgctttgttggtggactactctcagcctactatctgtctggagaagaggtaagatgaaaagtggtatataaatgtgaattataaagtgtcttaaactacatttttggtaaaatatgccattcgtgacatatatttagaaggaatctatggaatttttatatttcaatgaagctgtagcttacactgagtttcttacaatatgtactaatgaaatgagcaagctgggaaagtttggcagaacatattgtcagggaatgttaagtaatgcctttagaaactggctctattatgttatgtatggtgtgattatagctacaaattatatgtgcctatggacaaattaaagaagtttagtgtagtggcgggcttgtggatgaatttttttctttgagaattattttaatgttaatacaaataaaaacttttttaaatgaataaagcctggcaagtaagatataaaaattgtagtttttatgtaattaagggggtgagacacttagctaccaagtaaacagtcctaaaggccagcatccctgtatcaagtgctttggagctcttcctgagtcaaggcttcattaattatccactgcttggagcaaagcaggaattttaaatttagctgccttttattgatagattaagaaaggatttttgtatcatcctcataaaggtcactgatgctattttcttgaaaggttttggacaactttatgaatatcgtttgagtgtccactaagggttgttggaatgggcctcatctttaatgttgacagtgttaaatgttgacattatggaaaaactgtcacatatttcagttgcacgtcagtcagatttgagttagcctcagcattccggctggggaaagagtagatcttacccaaaccagtatttcatgtattgctatgctccttcaaacagatttaagcacagcaataaatgtttaatgagaaaagctgcttgactttgttcctgtctctcaagtactttcttaaccaaaacatacaaccttcacaatcttacatttcctctctgtttagattttattctaccttagatcttttcaaagtatatagatgacttctgtattcatctatatctctcctgttttagtgttaaatgttgttcattgtgaactctgttaccttctcagccagggtaatgtgatcccctggtctgttatgcctcttcctcccttttttctgtttttccactaccagataacttcatgtgttcagttcagtttagggtatactaaggattaagccaaaaccaaaaaaccctaaaaccctatatttttaaaaagttatgtttaaaattaactaatgttattttagttaacaggtttctgcttttagaatacttgtctttgagtatccaatgccaggatgttctcattgctttggacatgatatgctaagatgaccttggttttaactttttccataatctatgtggaggtgagacaatttggaggaaataaggattgcatccttttgtgtctgggctcaattaggataataaagcatacaaagaaaaacacatatgtatctattctaaatatacatcatgtttgattaggatacgttttcactcagtgttttaagtttacatacatatatgtgtttctatatatgtgtatacttgatatgtatatatatatatataattataatacccacagatattatagtttgcctatagataaaataatttgcctaagactttgtaaggatattttttaattctgtatagtgaactttagtaaacaaatggctacaaagaacacttccattgcaaataactattctttcagtctgttttgccattatcactacacaaacatgtttttattacatgtaggttttctgtattttaaattttatgataaaaatttaagattttttcttttatttttctatctgtagagtgctttagttatagggacccatattcttagcatgttttttcttatagtttccagaatgttgaacagttagattattttcagtatctttttattttgaataatattgctataatcaatgaatatttattctctgaagtggtgttggcaagtgagaagtgattaatactggattgttttaacatcatcacttgcctatttctcccagttacttagaccctgacaattgattttcatttgatgaatgcattcaggggaattggccattaggaatgtgatccggaaaattttttaccccaggtctgttcttgagctatttgtattcatatcaaaatttttttaaatgagcattcatttaatagaacaccaacatagcaaattatgaataagttggttttaaatagttgataaagttttataccacacactttttacatagatcagacaatttactaaggtgtctaggacaatttgtctttctatgtatctcatagagggacttttaaaccaccataatttaacattctgatttcatcactgaggctcaggagtattttaagaacaaatcaccatcagaagtagatagaccccacattgatatcagctcaagattgttaaatttgtatgcaaaagcaggagaagaagtactactgatttgtgatatgtgtttcaggaaagttacagttagaaacactggacaatagttaagaatcccagcagaagtctaagctaccaaaaaaataatagaaacatgaagtacctgtagtaaactttgattacaggcacatattcaaaaatttgaaacctcgtagctcagttaaaatattttgtagcaccataaaaaagtcaagcatcagtattttcaaatgctatataagaagctcaaccacaagaattacaaacagataggatggggataagatgaatattaaataggaagaatcagtattaaaaataaatttaaaaggtagcactgctctattataagctggaagggagctaaaattctcactggagatagtaaatatagcagcatctagaatatgattacccaaaatatgttctaaagaccactagtttcttttgatatggcaggataaatctgtatctgtatacatactaaaaataagtttgggaagagctacatcctgtattctttcttggaaattcagaatgcacaaaaaaagaagtgaattaacttttatttatccttgcattttccacacttacttaacaatagccttcctctattaaaaaaaaaagtgacatctgttaacagtaaattagaattatttttcagaacaaattttggaaatactactacagaataagagtaaagcaaagatgatattgaaattgacaagtgcaaaacgtgtaaaatatgacattgcaagagaagatgacacatgtagaaaagaatttatgtgactataccatgtaacattatttgttttacaacagaaaccaatagctatattgagcagaaagtgaatgtaataggacatagaaatgttacagaatcagagagagggctgaagagcaacttggaacaaaaagtgtcaagttggcataggggatctctatagctgtactatcaccttgggacaccctgcaattagtaacatggactatttcttccacccttctgttactctactcaagacacaaagtccctgaagaaagaggctaattgtcagagtttcagttacatgcagcctctttggggatcttggagaatgaaaaaggatatgctagaagtcttcctcaaagtttggattcatatcccgtgaagactgagtagtataaggaagtatagataattcctgaacaggaaatcgaggccctgtgagaagagtagggagataggacgtgtaggagccaacaataagatttcgcccactatggtgaatataaatatggcagagaaaatagacaaaccacatggaaactgacagttgaataagatacctgaaaaaatgtaatctgatttgcaaaaatattttgtaagctaagagacgacatttagaatagaccagagtttttaatcctcaaagaaaatattctgccagtacattttaactttgtaaaatagaaaaacagtagccaactcctggaagccaaaatgattaagaactagctttcaaagaaaaaagatgcggaagacatcttatccaagactggtaaaagacacagaatggatttttacagtagatgagtttactatgataacctctcattttgaaggcagcaaaaggatttttcttcagattccccctaaaagttatccactgctgcaaacaccagtatgaaatactgctgaaagagatttactcaataaatataatactgccaaattttaagactaacaaggaggaaacacagaggggagtaggattgtggagtagggaggagagagagaagattaagaatgtcagttaactggtgggaagatgtagttgttttttcataatagggttaagacattcggagtatttgggggttagaaattgattttttagagtttgtttagttatggataatcgtaaaaatgtttagaaattctctagaaaattaggatatatgactggttacctttcaaactcaatgtctgccacaattcattagaaagtgagtcatctcccagactacccatctgtctcctgcctgattctgcaaaaaaatcagagtgccagaaaatgtgtatgattcaaacagagctgtggaaaaacagagaataaagttagggcatattaaagtttcagataaggttagcacatagcagtgtattctgccagtttgtaaatcatctgggctttggatggaaatgtatcttccggtttcctagtgaccagagcaaagaatggaagagcattaacagcaatctggttttgctatttttatgaatacaaaaaatttgataccataaaataacccacatatattgcttatattgaattttccataaaaggtagaaatatgtggtataaacaagaaaaatccaacaatacatttggatccaccagaaatacattagcaccctcccaaatcctgcctaaatactaaattataaaaattgagctcacatttatcctgctttcttatatatggaaagaactttaattatgatctctaattaggtagatttaaatccagaaagtagagatatcaacaaaaggcctaattggaaaaaaaaaaaaagaattgaaaacagtgatcacaataccttaaaataaaaatatatgttaatcccatacagtgaagaaataacagctatgcaatatagttaaaaggaagaattgaaatagtgatacagtgaaattaaaaatcaggtaatcgatatagttcggatgtgtgtcccctccaaatctcatattgaaatgtgatccccaatgttaaagatggggtctcatgagagatgtttgggtcatggggccagatcccttatgaatggcttggtgccttcctccagggtaatgagtgagttctcactctattagttacagcaaggtctggttgttaaaaagaatctggccggacatggtggctcatgcctgtaatcccaacacttggggagactgagggagggggatcacttgagcctcaggaatttgagacaagtccaggcaataaaagccagattctgtctctactttaaaaaaaaaaaaaaaagtctgctacctcctttcccttcccctgtctctcctgctccccctctggccatgtgtgacacctgctccctcttcaccttctgccatgattgtaagtttcctgagggccccaccagaagcagatgctggtattatgctgcttctatcatctgcagaaccatgagccaaaataaacctcttttctttataaattacccagcctcaggtattcctttatagcgacacaaaacagactaatatagtaattaaattctttacaatatttttcatatgctgtagacaatgaaaattttaggaaaatatgtacatcatacctccaatcaaaatataacattagaaatgtacacatatttaaaatggtaaaactacttgaaaatttaaaaatctctcaaataactagatcaaggaatgagtatacaatattagacaacttaacaactacagtataagcatcacattaaatttgttggaaagcagccagagttatacttaaaaaaatacataattccaaaggtctgcattaagaaaaaataaatatgtggttaagtctatatttcagtaatttaggggaaaaaaaacaaaaagacgtaacaaaaataagaatataaatagattgcaaaatgaaagaaaagctgataaagctttctctgccccttctcaacagcgtccttattgagacagtcttctgggaaagaccttgagagcagtaagaaccatgtttttcacttattaagagacagaaagttttgatgaccgtgagtttgagtggccccctcagcaggaagacccttctaggcatgtttttatatagtgtcctcacctgtacagagtggcacatggaaatggtgcttatcagattgggcggtgattgggaaaaaaccgtgagagatgtgctccagatcacaatcactatttggaagaaatcaagtatcccttcagcagatattggatgagtgccaactatatgtcagacactgctcatggcctcgagatatgcctgagataaaatagcccccaatccctggccttgtggagcttacattttagtgattaaatgtagctcataaaccaaaactggaaaacttgatgagacctgtaagaaaaaaagttgatgttctggttggtcggttttgttattggaatgacaggccagtacacagggagaaaaccgacagtaatgttcatccaactgaccttcgtactgccagcgtctcccctcttcagtctcttccccactgtggcactaaggaaagttgtcatcactccacacagtcttcttgcaaaccaccactggtccatgtggccttaaaagttgagtcgttttgatttggcctacaaagcctttgtaattcagcctcagcctaccttttctggtttccttcataacagtcctcatggaccttccactgtataacagaccctttttcttccaaaaaacgcaccaagcccatctgtgtgcttcttaaatctgcattccttctacctagaatgtctttcaccctgctccttccacccaccaagatagatacagcccctccgaggccttccctggctgcacaacactaagacaccccctccccaccttcacttccttttctgcattctctgcatacgatattattatagttcattgtttatggctctgtgagccctctcacctactcactcccttttccccagtaggatttgtacaactcaaaaatgacgtttctgctgttttcatatcctcatgcttaacactgtatgcctggcactagaaaacatttagtaaatgtttagtcatttagtcattgactaaaactcttcaacaggttttctgagacctttactttttaaaactgcaacagaaaattcttccagtgacttttaaagtaaaatctgtacatggataatataaataagcaactagcctggaaggcttggggtaggagatgagaaggagaaaatgtaatgtagtaaggtgatggacaatatgcatgatctctaaccacaaatagcctctgtggctccaccttcaacccccaccccagctagcaaaacatcatcctttttatctgttctgtacatcctgattctctgaaaaagaaagttttgaaaatcagctggagactatttgtagattatatcattactaaatacagtaggtcatttattgtagacctttaaaatagatttaacatagagcattctgaaattataaacctaagaagaaattataagaagtaaatgtgaaagtgattctacaaggtacatatatggtccttaatttgaggaaactaactaaaacttaatgacacatttatgccaatttcctagaaaggaacaattttaattatatttatcaggtgatactgattgttatattaatgtaattatataattatgtaattgttgtatattaatatgtttggccctttgatttcttagaggtttagatttagccttacatatattttaaatgttaatttactatttggcattattgaaatttttataagaaaggaatgtaaaatactgaatagctaatattttcatttaaaagtttaattcagtaaaacagagaattgtaattttgcttattatgtttataattaaatttccatggttaatgagttatagctgttacacattgactattccattatgattggtaaatttaatttgtactttaaaaggaatataggagtgtacagagttgattcaaaaacaacacatactttagtcaaaagaaattactgctttttcttgtcctagagtgaattacagaaatcatacctaccccttaactcagatctgttctgtttgtccctctgcataagccctatcttgtactgataattgtttttgaaagcatagttttataagctgtaaaaattttatctccacaattcatgagcacatttctacatttcactagtaatcccagccctgaaacttatttatacttaatgtgtaaatggtagaagctggcctagcccttgatctcattgccaagtgagtgcttgaaacctaacggaaagggaaagtcagaaaattcagttgttttgttttgttttgttttgtttgttttctgagacggagtcttgctctgccgcccaggctggagtgcagtggtgcgatcttggctcacttcactgcatactcctcctctcaggttcaggcaattctcctgcctcagcctcccgagtagctgggattacagactcccgccaccatgcccggctaatttttttttttgtatttttagtagagatggggtttcaccatgttggccaggctggtctcttatctcttgacctcatgatccacccaccttggcctctcaaagtgctgggattagaggtatgagccaccgcacctggccaaattcagttgttttttaacgaaatatttttatcccttttagtttagcatagttccctacacatagcagcaaactacaaattcacatcagtgagaaatagacctgtgttatcattcagcaacagcctgaaatctcagtggattaagacagcatgttctaccttgactctgcttctcatcatccttccttcagagtccaacctgctggggcagctgccatctaggtcatttctagttgtcatggggaagagggagtggtggcaaaagagattctggcaaatcccacactggcttttaatgcacttgtctgaaagacccatgttacttcagcttacatgtcattggccagagcaagtcatagggccactacaacttaaaggggtgaagaggtggtgatgaacagcattcatgaccaccacagcgaccactgacttgggttagactgtgtagccctcttaactgcccagagtagcagaagataagaattactgagaagataactttgtcaagagtccccaaactggagccagccagtctcactggaaaaacccttcaataaagtggcaccaaagtagggtgacgagtgtgacttgggatatgaatcttcactaacacacatcttcactaaattttcaagtaaaaagcacttgtttacaaagtttcccctctcctgaaaataccttctactctgtaggcttctccccggccttccagatttgaaacagtaaagttgacagacagacatatactgccctctataccaccactgctgttgtctgtggtgggagccagttgctgtttggcagcggcctgccgtgttgcctggatgttaaagacctggtgcttttccttccaccactttttctttgatttcagtgctcactaggtcagtcacttctcatttttcaaaagcctaatgaaagagatgaggtaatatgttctattttgatttatattgaatcactttataattcataatgactgttgaaaccaatacttcaaatcatttttattgcctgagtcatattgacatggatttctaacacagatttttgcctgtgagtgaatgtttttcaacaaaagttatttttttcaggaatgttcttgcaaattatttttctttcaaattgtgatctcctttagaagggtatataagatagctgtagcaagaaatttaaaatttaatagggctagcagaaaatgcctcagaattgtgataatataccatctggtaatttcattcattaagtgaatcagcagatgcttattgaatacctgctttgaggcactgcagttggtgccgcagaaacaacagtgaataagagaaacacagtccccattgacaaatgttaattcaaatattaatttcacaacaaccctataaagtaggagtaggaactgtttttattctcattttatggaggaagaaacagaggcacagagtgttatttgcccaaggacatgcaaagtagcagagctaggcttcaaacttgggcattctggctcccagctactgagtagcagctagacattagagatctcaagcacagaagataagatattgataggcctgaacccatgagtcatcaacaactaaatgataattgaaagaatggacaggagtaagattgtccagggcattatacactgagaaaataggccttaatatttaagtgttgttgagaagaaagagctagaaaaggagactcagaagtcgtggtctgggaagtaggagggaaactagtagaatgtgacatcacagagtccaagagaaaatactattttgaaaacagatgttcagttctgtcaagtgctgctgctagaagttgtatatggactctctttagcatcttacaacatggaggtcatggatgactttatggagggtacttcagtagagtaataggatagaatccaaattgtttttgattgaagaagagaaggtggtaaggaaataaagattagttcaaggtctttaagcagttaggggaaggtggcattcacgaagacagatggcctttggggaggcatcctttgcaatatgagaaagcggaggagaaggtaggaatacaagtaggtaacttattagacttggtggcaaataaatgagatagttattctctggtggatcctgttaaatacaagacaaggatttctgctgagactcaggggaagaggagagatgtttgatgtgaacgtgtacattttaaaattgtcattctaaagggttgagtacagaaacatggtagaggttctggacagtgtctaggctggtagccatgaatttatggtagcctcaatccttataaacgtatgatgctttttccaacagtgttcggcactttaggtacaagcatggagaaggcagttagttggttttagttaaggtttggtagccaggtaacacagagagaaaggcatggattttaaagtattggcagaatttattgaatgtatagaccatgcagtccaagatgaatataaggcagtaggaaaaaggcaggtgagtagtggttagagagaaaatggactgattgaattgcttgaggtttagctgaagtagcgtaggagtagtagccataatttaataggttattggaagcttttaaagttaaggctatatggtgggatgtatgaattaaaagagttttttttaatggagcagttttaagtgatgtcataatctaggataacatgagattgaatggttgaggggggattttgccagagtctatctgcatggctgtgttagtccattttgtattgctataaaagaatactgaggctgggtaatttataaagaagagagatttatttggctcacggttctgcagtctgtataagcaaggctccagcatctgcttggcttctcatgaagcctcaggaagctttccactcatggcagaaggcagtgggggagcaggcatgtgacatggtcagagaagggaccaagagagagaagggaggtgccatactctaaacaaccagatctcatgtgaacttgcagagcaagaactcattcatcaccaagggaacgccaccaagccattcatgagggatccacccccatgatccaaacacctcctactaggccccaccttccaacactggggggggcacatttcaagatgagattttgaggggacagatatctattatcactgacgatgcaacatatttcaattttaaaaataataagatgtaaaaattgctgtttaaaaaaaaactaagtaccggtgaagtgatctttaatactgctaaaatataaacactttctataaaattcataaatccatactaaaatatgtactgagtaaaggttgctgcttaaacaaaaagcagagggaaatattcatgcagaatgaagtttaaatatgtgattgttgaacaaacattatgactctagagccttaagaagtaagtcagataattagagttggcagtagaaatgtaaacaaaatgaatatcagctaattagctggattttaatgcatctatacctgtacagagctgtttcttctaaaatatactggaattttatctgcatagataaatgtagacagtttgattgtggtgctgtgaatttgttttggatttttgtcattggtttttgttttgttttgttttttcagaattgagggtctctctgtcactcaggctggagcacagtggcacgatcatagttcactgcatccttgaactcctgggctcaaggaatcctgcctcagctctctgaatagctgggactatatatgcacaccaccatgcctggctaattactttttttttatttatttatttatttatttatttttacttttttttttttttttttttttgagatggagtcttgctctgtcgcccaggctggagtgcagttgtgcagtctcggctcactgcaagctccgcctcccaggttcatgccattctcccgcctcagcctcccgagtagctgggactacaggcgcccgccaccacgcccggctaatttgttgtattttttagtagagacgggttttccccgtgttaaccaggatggtctccatctcctgacctcgtgattcacccacctcggcctcccaaagtgccgggattacaggctactttttatttttttgtagagataaggcctcaccattttgcccacactggtcttgaactcctgacctaaagttaccctcctgcctctacctcccaaagtgctaggactatagatgtgagccactgcccctggcctggatttattctataaattaagtcttacctaatgtatgaaactatcatttgattcataaaaaaatttgtttttgttaaaaatttttatggtctgggaattaggtgccttctaaaggaagtcctctaaagatttcatttgccagactttcttgtgatatcactttatgatgtagatttatggtttatgtatttttttaagtttttttctttaaaacattttagaaaatagttcactgacagatcatagggttaaccattttaataataataacgaagtcacttctgctacatgatgaaatgttttcccaagagaggtcatatatctgagtatgccacaatttgtttgcatttgaaagcaaacagctccagtcttgtaatttagctgaaaattcatttaaattgataataaaataaacataagccttgagggcaatgtttgtttttaacttaacaattgatatttattttataataatttgaagtatccgattcctctgaagtagtacaaatagagattctaaggtccttcaaaaacaaggaaattccagagctttaataggataggcatagaacagaagaatttttttcgtggctctttattctaaacacttttgtttttcattcttgacattaggtagaaggctagggttagaaaagataagcagaagagattgtcatcttagttttataaataccatttaggttgatgcatttacttgtgtaatcatattttatgttatttttagttattgacaaaacaatacccacagttgctctaatttataaattactgctaacttatgtgtttcagttcttaagtctaacttgatattatgattattaaatagtgacttccttagttttctctgatgtggttactatagtcaggtagaaagaacactgtataatacagtttaggtttagctattaaggcaaataactccagcatttatgagtttctgccgtctaatgctttataactaaacttggaataatactaatttagaattgagccctgaatgactagttatagtagacttctctctatcatctggtcaggcttccaatttttaacatgtctagtcccttatgattcactcctttattcagcaaatgtgttaagcatctgttatgttccatgccatgttctagtctctggaggattcagcagtgaacaaattagacaaagtttctgctttcgtaagatttacatgataagggggtaaaatgttaaacaagttcacaggatcattttagatggcaataagagctctgaagaaaatacaatataaccatgtgataaagtgatggagggtgggaaagggagatgatgaggactactttaggccaaatcggagccacagtctgaataacatagaagggtcaaccatggaagatttggaggaaataacattctaaagagaggaacttaagagttctgtattgatggttcatttctttctttcctttggaatgaagaagaagagaaggagggcagcaatggtgataaaactttttttatggtttattgtgtgccaagtacacagtatcagtactggggtaattacgtcatctccatattgtagatacactgaagctctgagaagctaattccttagccatataggacatgacagaaatgggattacactctgctgtctgtagcaaagcacatgaccgtgtccacatattattcccaaaaccagtgttgccagggttggtaccacaacttttcttccttttctgtttacttgcttatcagttacatacctaaatctcataaaaatgaaatagcagttgccgggcacagtggctcacgcctgtaatcccagcactttgggaggccaaggcgagcgaatcacctgaggtcaagagtttgagacgagcctggccaacatggtgaaaccccgtctctactaaaaataaaaaaattaggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaattagctgggtatggtggtgcatgcctgcaatcccagctactcaggaggctgaggcaggagaattgcttgaacccgggaggcagaggttgcagtgagccaggatcatgccactgcactccagcctgggcaacagggtgagactctgtctcaaaaaaaaaaaatgaactagcagcaaccttctagcccatgaaatcttccacttcttgggcaacaaagaataattaagttatgaaaactaaaccataatcacactcgtaatgcttatgagttaataatagatttttgcacaagttgtgtttgaaaacatttattcattgcacttaagtctttctcaaaacacaaagctgtccttgaatttttaatatagttcattaaattgaaaaaattctcattttctttcccatgtttttattcttcaatctctgactcttttcatcaatagagtaaaatggttttcattatccagtgagtacatataacaaaaactttcaatatatataaagacagccatgtgatttcagctttaatctctctttttattctgaactaaagtcagatacacttcaaaatgttggtaaaatgtatatattttggtgtgacattgtgacagttaaggtatacattcagccttttctcaggcatattgaaaatggtagtagttgaggtagttgagacactgaatgaggtagatgttcacgatttagaaaaaaatattattttcaattttcaaatcatatctgatataaatgaagggaaaaggtaataccttgtcatttcagatgaaactaaaatattttggctttatcaacagacataaattttgaaggcttaccaatacaattggtatgcttttatgtaattagagaactccaaaaagcacttagaaatagctcgtaaatctaccatatgttgacagcactttaatgaatttctctagactgtgaataaaaatttggactccagtgctctttatattttattcacttagaaaaagtaagacaggattgctcagatttattgtcatatatcataaaagtaactacaaaatatctactcattatagttaaagatttacagtgaacattttatagtatgttttctcttaattatgttaattgttcacaaatgagaacactcaaaaccagtgcttctaagattaaactaagattagatccagtggcctggcatctctcaggagtttttcatagggatccaacccatagtgaaatctcaggaggtcctctcaaataatggagtttaattattactcataaatgggcagttttccacactaacagatgttctcaatctcatgcaaccccactacttggtgttgcaattcccactacttttccttatccattcaatactttcccctgtgtccagatagttgctgaatcagcatttacccactttatgaatactcagaataaaataccaacacttagactcctctcccccaacctttttttcctatcaaattaacaaagacagaaaatcatgttaatacctagtttggtaagagtggggcaaaaatttactctcaggcattgctgttgggaatgtaatatgataaaagtgttctggaaaagaaaaaaaacaagtgctgtatatatgagtagatccttttagctccagttactcttatcctgcattggggaatctatccaaaggaaataatccaaaaatgtaattatattatgccagaagcaggtcttggaaatattttatatatttagtaaataagaagaaacatctcaaatattcagcagtaagggagtgcagcagatcatggaatgctcacataacagagtaatatgcagccattaaaatttatgcttgtttattcaagggcatgggcaagtatggatatggtaaataatgcaggatactttcatgtatgatatgatttcagctatggaaaatatagagaaaaatgatgtggagctatttctaaactataaacctaatattcctaaatatttgcttccggttggtatgtgatccttccctctgcctgtttttctgtactcatctgaatttccatactgaacttgtaatattcttttgatcagaaaatattaaaggaaaatcacaacagatttggaaaacaatcattaactaaatttctgccccagtcttactcaggattcagtttttccaacctctaaagatttaaatttttttaacttttcatactagaattcagcttataaagtcttgaaagtcacctttttccctttctgacatctgtttcataaagaaaatgacttagtggtaactggatttccttctttatagtcaatttatagatttccatcttagaaggttgtttatttacaacaacatctattagctgttaatattatcctcagttcacatggaaatggaggtgacataaagcttaaataaagattggtcataaatccttgcacagtctcagatccaactactttgtctttatattatccaaagcagttcaaaaagacaaaggctgctgatagtaacaagatttctccgttgaaaacacacacacattcataaatcaatcgaaagtgtggtacaaaatagtatgtattttgtattctttaaaaaaaattgagcatttctaatctcttcattttccttaaccatttagaagtcaaaagttgaattatttgtgataagtgtatacgctctattaatatattattgctatagataagcatataataaagtttatatttattactaacatacatggaaattttgggctactgagatacctggcacagtcagtgactttgtctattcctacaggatctaattgaaaggtgttaggaaaggcatagcaaagagcctttttcctgttgttacaagcagtaaatggcccttaagaaacttcaaaaagaatgaatgcttgcttgagaaagaagggagtaagagaaaagcttttcagtaatgagcaggagaaaaaagaaaacctggtctgagagataaaagaggtgactattaaaacggaaggacacagtctaccagaaactcgtgaggctttacaaatcaaaatctagactcactttaccatggaaactgaagacaattagaaagtatatgtttacaattttgtaatattttactttatttttaattatccaaagcaaatataagactattcatgataggaattgatagtttggttatgactacaccgatattgaagccatgtgtaaatttgaaatacttaattttttaaagctgtttcatggaatctatagatgtgacaaaaagctaataatgtattctgtcactttacttccttgtcaccctaagactgtgtttctccttccagtaataggatacgaggtacttgtctgagaacatgtaactggagtagacttttatgtagtgatctgaggcccttactagatctctttctttctaagggaaatcaccaaattttgagcctataggtaaatcatttgtaaaccgggggttggctgggcgtggtggctcatgcctgtaatcccagcattttgggaggccgaggcaggcagatcacctgaggtcaggagttggaaaccaggctggcaaacatggtgagaccctgtctctactaaaaatacaaaaaaaaaatagctaggtgtagtggtgcatgcctgtaaccccagctactcgggaggctgaggcaggagaattgcttgaacccaggaggcggaggttgcagtgagctgagatcacgccactgcactccagcctgggcaacagagtgagattctgcctcaaaaaaaaaaaaagatggggctacttgaaataatcattgtattggagacatccagctaatgaacttaagaagtagctcttatagggtggaaagaacattacctttagaatctagaattctggtttctcaggctctgtttggttattaggtattacctagagcaaaccctttatcacattgtttttttttaattgatttaagtaatggaatatgaaataaatgtcttttaagcattcctttaaatccatttttctagaactatgatacactaacattcaagttcacagaatattataaattaggggaggggtatagtgggataaatttccttcctgtaactcaaaacttcttaacccatttttgtatctaaacacaatgactccttccagtgaaatgtagagttgtgtttcttgccatacaatgcttaggtagtccagatatgtatatgtgggaatgaaaaagaagtagaaaagttgggcatctttttcccctggaaaaatattgtgttctatggaagagaaagtagttggtggatagtggaaagaagatgctaagaagtagagaagtcgttcaaggaaaacagtaaactgcaatattcacagaaacagttgggaatatgtactgattctttacttaggggatgaccatagttttaactcatttcttaccccaaattcgcagattgcattctattgtattataaatagatctctcattttaatgaccaactcaagggatattctggcagccgtggtgagaatgagaaacaaagatttttatacccagcaaaactgactttcaggtgtaaatgacacaagcgggctattgtcagcatgcaagaacttgggaatattgtttccaggaccctttcctgatgaatatacctgggaacaaacttcagaccaccaaataaatactgtatgatgtccaaaataggcatattcatagagacagaaagtagatcagtggttgcctaggacaagaggggttggagggaaatggggagtgactgctgatgcacacagcacttcttttttgagatgatgataatgttctaaaattgtgaatcaactcagtgtgagtatactaaagccactaaagtgtatactttaaatgggtgaattgtatgatatgttaaaaagaaaaacactatagttctgagttttaattgaaaatattaatatgagcatatgatatattgtattttaaatatacataaatatgcatatatatgtatgtcccctgaaaagacctagaaacagtatgaaaccagtagctatgagcatctctaacacacagagtgcgggcttgaattaatattttccactaaccagggcttcttggagaagagactgaaattggaaatgtacaagattagtctgaaatatcaaaccaggtaacaaagaagctaacaaagactgctagagtaaggtcaaaggactcaggagccaactggaagaggcttccattggccaaaaatgagaattttgagtttcagtaaaaataagaactataatagattaaaatccactaagtacgtttaaattgataagttcaagccatgggcagtgaagcatgcatgtaatcacagctacttgagaggctgaggcaggaggatagcttgaacccaggagttcaaaaccagcctggacagcatagcaagaccctatctctaattaaaaataaaaatcaataaatggataagttcatcataatgaaaagcaaaaataattggtcaccttcaaagaatgacaggaaagcagttatcttgaaaactggtattttcccaggcagctgccaaagatggaggggcaggtcctggtgctcactggccaaggccaccttctggtctgcctgacagccgtcctggataggcaggtactgctgggccagaaggtggtggtcgtgcactgcaaaggcatcaacatttttggcactttccacagaaacaggttggagtacctggccttccttcacaagtagatgaacaccaacccttcctgaggccccccatctgcatcttttggcagaccgcttgaggcatgctgcttcgcaagaccaagcgaggccaggacgtccctgaccaccccaaggtgtttaatgggatcccactgccctatgacaagaaaaagtggatgatgcttcctgctgctcccaaggttgtgtgtctgaagcctgtgagaaaatttgcctatctggggtgcctggttcacgagtttggctggaagtaccaggcagtgacagccacccaggagaagaggaagaaggccaatatctgctattggaagaaaagcagcttatgaggctatgtaaacaggcccaaaagaatgtggaggagaaaacaattacacagaggtcctcaagacctatggactcctggtttgagcccactaaagactgtttattccttatgattgcctggcctgcccttccaccgttgctgccgtggggtgtagaggacccaagggtggcaatccaggtgccacagacagcctggtacttaggaagctgggggtaaggaaacggcattattcaactgcctttctatattgttactttaaatgactctaagaattgttcaggcgtagtttgtctatggcctactcgttcatgagagagttgttttagaaaaatgagggccgggcacattggcttacacctgtaatccgagcactttgagaagccaagagatcgcttgagtccaggaatttgagaccatcctgggcaacattatgaaaccccatctctaacaaaaatgcagaaattagctaggcatggtggcacatgcctgtactcccagctacttgggaggctgaggtgggaaggtcacctaagcccgggaggtcaaggctgcagtgagccaaaattgcaccactacacttcaacctgggtgacagagtgagaccctgtctcaaaaaaaaaagtaaaacaatagtaagaagagccagttaccttggtttcaagattagcaaaagggagctggaacatgcattggagggagccctaccttctgagtgggccatctgttttaacttcccaccttatcctatactctgcagctgtgataatgtggaaaaaaaaaacacttggggacagtatgagcttgctgttttacaaagagtatgtatagaagcatagactgggaagatgtgtgaccagggcgttacagggtagcccttgctccttccctgtattttgtggtccgaatcaaataaattgcttttaaagaagaagaagtctggtaaataaaggaaaagaatcaggcatttatcttgcccctcctgtatgaactatatcactggtaactaaatagtagataagcaatgtttctcttaaaattatacctgcttacaaatgaaagtgaaatgataaaagtagaaaatcaccatttttacaactcctgatgaattaatggatctggaccatggtcaccaacagctgcttgcttctcaaaaggagagcaaaccacatagtgcctcctgataacatatcacctatagtcttgccaaaggcatcaagtctccacatccagcttccaatttgtcataaatacagaaggaagaatgtgccaaactccaccatacatatgcagtcaggaacccatagaataagtctcccacagttcaaataacccagatttgtccacataaattataaggaaaagaaaagaaaaaatgagatgcctgtggtttaaaataagaggcttcaaagtcatccttttttgaaatgatcatgactgtctatagtgtctaatgatgtagatttggttgctaaaaccatataagatagtaaatgccaggatgtggttactttgggggagagagaaggaagtatgattgggacaaggcccacatagggtttctagggtggctggcaaagtcctgtttcttgatctggatgctgcttactatggcatgtgtcttataatgttacactaggctatacagctgtatgtttgtgttggagagttcatatctgtgtgtgtctttttaattaaaaatattttgaaataactacataatttttaaaaggttatttagaaagtcaagcttagtggaatctgccttacatcttgagatatattttggatctctctctgtaaataatacttaatgtactgagttatcttgatgtatgtaaattacagattatatttcaacataaaacaagcataattcaaacatgtacatgtaaatattctataatacatgtctgaaagtgctgctgtaaacatctgtccagttttttgtatggtcataaattttcagttcgttagtttaaatactaaggagtgctattgctgtatcatatggtaagagtgtgtttagttttgtaactgccaaactgtcttccaaactatctgtactattttgcatttccacctgaaatgaatgaaagttcccgttgtttcacaccctcaccaacatttggtggtgttagtgttctggattttgaccattctaatcagtaggtactaattagtatcttgttgttttcatttgcatttacttgatgatttgcgatgtggaacatctttccatatacttatttaccatctgtttgtcttctttagtgaggtgtctattaagatctttgtcccatttttaaagttggaatctttgctttctcattattttgaagagttctttgtataattttcattaacagttctttattagatacatgttttgcaaattttctcttaggccttggcttgtcttctcattctcttgacagtgtcttttgcagagcagtttttcattttaatgaagctcagcttgtcaaattttttctttcatggatcatgcttttagtgtcatacctaaaaagtcatctccaaacccagggtcatctagattttatcctgtattatcttctaggagttttatagtattgcattttacatttaggtctatgatccattttgagttaatttttgtgaaaggtataaggtctgtgtctacattcatttttttttgtatgtgtatatggatatctagtttttccagcaccatttgttaaaaaggctatcttttcttcatttaattgtctttgttcctttgtcaaagatcaattgactgtatttatgtggatcaatttctaggctctctattctgttccattgatttattctttcaccagtaccacaaatcgagacaagattatcttcatttctgtatctctatagaaagtcttgaagttgggtagtgtcaatcattgtcagaaattggctattttgaaccttttgcttctccacataaacttcataatcagtttgtgtctacaaaataacttgctagaatttttattgggattgcagtaatctattattccaagttgggaagaactgacgtcttggtattcaatcttctatctataaacatggaatatctccatctgttctttgatttttttcatcagaattttgtagttttcttcatatggatcttgtacatattttgttacgtttatatctaagtatttcattttttaggtgtgtgctcacaatggtattgtgtttttaatttcaaattccacttgtccattgctgatatataggaaaacattgattttctatattaaccttttatcctgaaatcttgcaatactcacttattagtttcagatttcttttgttgattcagattttctgcatagaaaatatgtcatctgcagacaaaattttatttttcttctttcctaatcagtataccttttatttccttttttattttttcttataggacatctagtacaatattgaaaagcagtggtaagaggggacatccctgccttgttcttgatgttagtgggaaatcttctatttctcaccgtattatgatttttcaaatgtaaaagctgaaccagcacaaaaccaatatgtttattttcccctgccttctggattctaattaatcattggtagaggaagtttaggctgtgtgaagagtttggaaagaccttaggaaatttttttaaatgtttatttatttaaaatttttattaaactttattaaaatgttcaagtttcctgaagtgtttagacatcaagaaatatttacatacatctctagtttatatttccatcctgttgatttccctattaagaattttaatgaggccaggctcagtggctcatgcctatgatcccagaacttttggaggccaaggcaggaagatcacttgggctcaggagtttgagaccagcctgggtaacaaaacaagaccatgtctcaaaaaaaattaaaaattagctgggtgtattggtgcatgcctgtagtcccagctacttgagaggctgaggtaggaggatcactggagcctaggctttcaaggctacagtgagctatgattgtgtcactgcactttagcctgggtgacagagtgagaccttgtcttaaaaaaaaaaaaaaaatttaaaaaaggcacttaaaagaagtccaaaatgtatctcaggaaagttgtacaaaatgtatctcaggaaagttgtacataaaataagacaggcctcattttacagatgtttctcaattatgttattccaaatctacagtattggcatagctttcactgttgaaaggtgttttcatttcttaaaaatgtttttaacctcctatcaccagtcctatgctaaaacagggtattttacccataaactaccacaaatagataaaaatagctactttacatataaatggccctttaaaactggatactattgtatgccaatttgcaacatagtctgtatgaaaagagaaaacagtaataaatgctgtgttatggaccaataattagattctcaatgtggtgtaaagtactcacacaaggttcattcttggcctcataaatttgaccatatcttttcattctaatgctcttaaatgacttagagacatgacttaacagtaaaataagctcctaaacaacaaccgcaagcacataaaaaacaaaattatgcagtgatggcatgccatttgttcaggaattggctgtcctatttactcttaaatataacagcaaatggagagttgattgttaaactgcacattcaggacctcatggtttaatatctcatgtgctatttgccagactaaagattattaacaatttttgctttgttcactgcaggaacaatacagtacttgtattatacaaatattttgattaaagtattgtttccaatcaatttatttcccattcctttcgaattacctgagttaacctagttcagtggttctcaaatgtagtgtacatcagaatcccaaggagagcttgttaaaatacaaatgtataagccctgctctcagagcttctgattcagtaaatctgggttgggcctgttaattggcatttcttagtttctccataatgctgatgctgcctgtcttgaggaccacattttgggaaccactgacctattaccatgaaaccattctctctacaatgagcagaattcttttttaaaaagttagctaaaaacaaaaaatagacctcatgatttggctgtcaccactctttaggaaagcatgttctaatttactgggtcaagaactgaaggaaacatttcttctataggagatcatagtaaagcttcttcttgaagtcttacaaatgttgtatttatcaaatggagtgttaaactattcgaggtttcatttatatttgggaaaactcttgttaaataaaacaggtagaagagccctcttaaaatccctgaagaatgtatgacacaaatttctatcattaatatataataaagattcttttttttgtattttgtttgttgttgttttttcctgtattatattttgcttaatctccctggctgcataattgagttacctttatttttaacttttactttaggttcagagatacatgtgcaggtttggtatataggtaggtacatggcgtgtcatggaagttaggtaaacagattattttttcacacaagtaataagcatagtacccaataggtaacttttcagtcctcacccttcttacacccaccactctcaagaaggccccggtgtctgtggttcctttctttgtgtccatatgtactcaatgtttagctcccacttacaagtgagaacatgcggtgtttggttttctattcctgtgttagtttgcttaggataatggcctccagctttattcatgttgatgcaaggacattgtattagttagggcgctcttagagggacagaactatatatctgtagatctacatatatcctgtaagtattaaattaatacttaataaaatataattattaagttaatatttaataaactataagtattaacttaatacttaataaactccccttttacatataaaacttacacgatcacaaggtcccacaataggctgtctgcaagataaggagcaaggagaaccagtccaagtccccaaactgaagaacttgaagtctgatgtttgagggcaggaagcatccagcacgggaaaaagatgtaggctgggaggctaagcccatctctccttttcacgtttttctgcctactttatattcactggaagctgattagattgtgcccatcagagtaagggtgaatctgccttccccagcccactgattcaaacgttaatctcttttggcaacacccacacagacacacccaggatttatactttgtatccctcagtccaatcaagttgacactcagtattaaccttcacagacatggtctcattttttatggctgtgtagtattccatggtttatgtaccaccttttctttatctagtctactgctgatgagcatttaggttgattctgtatctttgctattatgaacagtgcacaatagatacatgcatgtgtccttatggtagaacaatttatattcctttgggtatatacccaatactgggattgctgggttgagtggtaattctgttttaaattctttgagaaatcaccaaactactttccacaatggctgaactaaatttacattcccaccagcagtgagtaagtattcctttttctccacaaccccaccagcttctgttatttatttatttttttttttactttttataatagccatataatgaagttttttaaacaggcttttgaaatcttatttccttaaagatccatgttgacctttaccagaattgtttatttgtttttattatcactgcgtaaaataagatagtttctttttcccatggttatcagccatttgccctcaatggtactggtttggagtgactaaaattagggccagagtaacagtacctcacttttactctattttatagcaaatgaaatgttcagtattgacattaagtttttaaacagtgtgttgctgtatttgtttagtgctgaaacagcttgactccatttcttttgcaccttgattctgtgggttttatagacagccggtgtttggtgcctggccccaggacgggactctgcactgccacccatctgccatcacttctgttactcccttttacccttgccttgccatccaccatcacttctgttatttcccttttaacccttgcccgcctatgttttttccacttagagctttggatcttttttaaacacacatgctgctatctcactctttcttttagaactagtccttttcaacaaatctaatagatcagttacttcactacttaggatgattcttgtctgaacaataaccttcaggatgttggccagtctcagaagaaaacatatacatgtaatgtacataaatcatattgggtaaagtcagttttatctaaaactgagtttaagatcttcaaaaacacttccatgaactttctttacagttttgtgctattctctttctaaatttgccaattgtatgtggtaaggttgatggtgaggatttatctgattaccttgtggagtattcatagtatttgtcttcattttctttttgaagaggagtggaagttattacttgatccttttcctatgtatcacatttttccagtgttacacttcaaaaacaagtgttattatgagtcattgaccacagctgtcatgtttacttacgtatcccaagtgtttgtgcaacttggtgcctaagtacataggcactaaataaatatttgttgaataaatggattaacatttttaaaaggtcaattatgcaagcaattcctttttgaaagtttgtaatttagaaagtttcaactatgttgaaatatgtgcgtgtgtgcaatagctttaaaaagcaataggcggggcgcagtggctcacgcctgtaatcccagcactttaggaggtggaggcgggtggatcacgaggtcaggagatcgagaccatcctggccaacacggtgaaaccccgtctctactaaaaatacaaaaaaattagccgggcatggtggcaggcgcctgtagtcccagctgctcaggtggctgaggcagaagaatggcatgaacctgggaggcggagcttgcagtgagccgagatcgcaccactgcactccagcctgggcaacagagcgagactccatctcaaaaaaaaaaaaaaaaaaaacaataaaaaaacaagacatttagatagtgcatgagtagctacaatggacaacataaattatgtttcttgttattatttgtgtttgtattctaaagaggcatttgcctgccaaactatttcagtctgatattttcaaaactcttctaataaaaaagatactgagttatgtgacattttgatgttctgatgatgatcgttattaaggcagggcattgtttcattgagttgtttatagtactgtaagaatataacactgatctattaaaaacagatgcagtgttgtcatgaaatgggatatatgaaaatatgttaaagcctctaaatgaaaaaaagataaagatgctttcaagtaaattagcaaaattcagggattagcaaagtatagccaagcccattcattcacattttgtctatggctactttgaccctacagctatagttagtgagtgagtgaatgaattgaatgaatgctgaccagaaattgcactttcaaacatttaacctgaggaaatagttatatatacaaataagtatgtacagggatgttcattctaagctgtttgtaatatcaaaacaagggaaacctaaatattgactaatagaagactggctaaataagttctggtgtatccttattataccagaactagtgtatgatacagctatttttaaaaagatgttacagaaatgtatccagtgataggaaacaagggtcagcaaactacagccctttggccaaattggctcaagacctgtttttatactaccagagctgtgagtgggttgttaaattttaaaggattattaaaaataaacgtgagacagagtatgtgactagtaaagcttaaaatatttactatctaaccctctatagaaaatgtttgctgacccctgatatagaatgttgtatacaatgtagattaaattggtagggatgggtttaaaacattatgaaatagtatatatagaacaatatctttttttaaaaaaatgcaatcaataccatttagacacttaagatgttaatagttatttctgggtagacaagattaataagattctatattttatgtctaattttgtgatttttcaataatgagaatgtattcattgtttaagaaaataaaaatttaatattggcatggggaaaaagagaacttctctaagtttcaaggtgtacaaatatgtttttccattttgtagatgaggaaactgagactaagagtttaattaacttgcctggagggacacaaacataagacaaaaattgcattgatgccaaattttctgtccagcagtgtcaccatttgataatttaaaatgctcatctgtcagctgaaataaaactatatactctgtacccaaaggcaatttaaaggtatcagtgtataatatatgataaaggaggattatgcagaaataacaaaccacctgcctaatggtattaggtgtgtactggataggtttacatttgcttaaatagaatgaaaaaatgagtagcttacattttacattttttaaaagaaacaaaacctgtatacataggtattcagttgactttgtaaatttgcaaactattactactacataatatggtaattaattgctctttcatacctatagagtttaattgttcaaattcaggcatgtgacacaaaaagggaccatgtcctgaagcttgtgcccttcaccgtaagatagaggaaggacatttgacttatcagatccttgtgcaggtaactgtttacaaaatgagtcagcaactcagaaggagaatgaatacaacagtgagaagtctcattgtaatgaactgatagctagtaactcaaagaagcagtaggactatagaaagcagacatgaaagctcagcagcttttggaccatttagtgtgtggacaaaaggcctagtatccttctattattcctgaggaaaccactatcttatagccaagaataataactattgttgctcttttaaaaaacacttgttcctttaattataaccatcttgtgatttgggaagattattctctattcacttatttagaaactgaggcacagaaaggaggttaagtgagcgttcaagatcgtacagactgttcaagtgataatggaaaactccatcacctagtcccagctctgtatgcatatgatggtgatgctgagtaaaggcaggatcattctacatttcaccgaatcataaaaaaaagataaacatgtctttaaaacttatataaattattaaactataaatattttgatgctcttcagagatgaggttcagttaacaggaaaaaaattcactagtgtagaatgcttcataactaaaatatgtcagggaattatgatatgcagtcatgcctaggtatctgtgggggtaggtttcaggaccccctgaggataccaaaatccacagatgctcaagtaccttatataaaatggtacagtatttgcatataacatgagtacatcctcctgtattctttaaatcatctctagattacttataatacctaatataatgtcattgctatgtaaatagttgttatactgtgtagtttaggaataatgacaagtctatacgtgttcagtacagatgcaaccatacatttttttccaaatatttttgatctgcaactggttgataccacagatgtggaacccacagatacaaaggtccaactgtatatgcacagatgaggctatcattttttcttttgtctttttcttgaacaaagatcaccaatcctggattttgtatattttaatgatttctgatgtctgaaagcagtagtaaatagaacatccccaattttaaccctatgatgtcacatattaacatctatgtagtggagtccataaattcagttagaaatcatagccagatagagtatgtgtgctttcataattcccatctctttagtaggcattatattttttaaaatatgtcttccttttgatgtgaaatgtattttcagaaattatttgtcatatttagtgtaaacattattcactatatactgcatatttttctaaatgtcatgttggcgatttgcccattttttaaacctaaaattgagatagaatgagtagctttaggcactgtataatgacttggattactgtggtgttcttgctgtaatttattattatttatcattcttgggcaggtattttagtaattagaaagcctacaataacacatgtggtacacttaagaatagtttgaagcactagagctgtatagccattgggtttcctctcccttttttaacttccatattgaatgcatattagaaggacatgtaacttttatcatactatttccttgctcccagcccgctacttatttatgtgtacaaaagcatatactttcttcttgaggaaaatttttttaaaggaccctaattatttcttaagatttattttccttctatcaggtagccaatacagtattttttttgatgttgtcgttcatatatgtttgcctcttacactcagaaaagtcccataaccaatgagagctactgcctttcttcctgccctatttctcataaccttgatgacccagaaatctctccacttaccataaatgggaggcactaaagtagtgttaggacttccttaagacatctgatgtgctcttttaaccatcttttaaacttctcttcctggtatttaaggccatgagcttatcttatttaatctgtctctctctcaccattttctagaccctagtaatctagctctccacctgctcgctatcatgaaaagcacttcctcttcccttttgctttatctcttgtcttcctccacattaatccagagcacatacacaaacatgtacataccttctcccaaataagtacatacctgcatctatataagtgtcacgtcttcaaccttacctctccccctagacctaactcactttttaaaaaaaattcccacagttacagcatgtatcacttaatttattctctacctatggtttgtattgttttgtgttgtatatcttatgcttatatggttttatatggctgacttaccttcctggttgtaagcttcttgagatcagggatttaattttttctcatgtatctctcgtatagcccttaccacgttggtaaatatgtagtaaatgcttattaagtcttaaaataagcctgtcctgtggagcagaaacgttcctcaggaagtgtcttatcgagtgttcccattttacaaaagagaaaattggaacagtgaagtgacccattttctttatgacataactggtgagtagcaagccctgaaccagaacctagggctcctgactcttagttcagtgtgcctgttcccaggcagccttgaccacgctgatgctcagggaaacactgccacgagaacatggcatttactgctgctcacgtggacagtggtgatatccatgccctgaacaacagcctgaagttcttcccagcattccccatttttcatcttgcctccttaactttataaaaccctctctattcaggaactagggaatgaatgagagtcctctctcatgaaaaaaaaaaaaataatgagatacaattttattcattcatttatcaacatttactcattttgactaggagatagcataaaagccacttctcttcactacctcttattttttcatgagaataaatatctttaaaaagctagataaatctaaagtgcctattcactagaacattctacatttagatttttaaactatgcttacaattggaagtgttttcctttgtttaaattttatgcttttatatattagtaaactcaagactaaaggacagctaccttgattcttcttggttataattgatggttattggcaggatagcatgtgtagcctttttattttgaaaaaaaacaagttgggaagatctctgtgctttaatatttcaggaaaataagcaacactcttctcatctaattgcctgaaggctaaaaattgaattgtattgaatcacaggggagaaaaacaaagtaattgacaaaagcagtcatctaattaaatatattttttttaaaaaatgaagtttgtaatgaaatttgacaaatacaacacataattttttttaatttaaaacttcggttttaggttttgatcaattacagaaacagaatgagaagaaagaaagagacggtgaaagaaagatgtgtgcccacaggggagagtccctctggatcaaaaggatcacccgtctctgagatgacaggaagctggtattcacttgggtgtagctggcagtaaaccatcccacatcagagcatttaactaggagaataggccctctctgaacttcagtttcctcatctgtgtatcagattatggaactagatgacctttgatgtcccttccagctctaagtttctgctggattagttatttttacatacctttattctgatatttaaatctttcaagggtctactctaaaaagccagaatagcttaataagtacttactggtttagtgattgattttggcccatattatgtgcaagtttatcaactcaactaacagtatatgggtttagttatttgcagccaaagatatttgttgtgtctatggcatcttgtgctgaaagctttatgtagtgaaaatgagtaataggtaaactgtacttgtacaaatggtgaactagtgtttgatcttttaatggtgaagttttcaacatgagcatttgaagaaaagctttgatattgattgtgtatttcaaactgaagcatgtctgaactgaaaatatttccttccaaagccatctgttcttattcatttcttttttccttattctttgctctggcatgtatatattcctacatagttctttagggaactgcaaactaggaaggcaaagaaaaccatatgtcttgtttacagccttgtctgatactatctgtcagggtaaagtaaaaagataaatgtgtttatttgatagattttaaattttgaagtttttaaaacgttgatcaaaaacagcaataagactgatgatgttacttacgtgtaaagaaaagatacagttttcatgtagttattttgaaattcttaactttaggctataaaagtttttatttaaagttatttgttagttacatgctcgaaagaactgttgcatcgtattttaccacccttctttcagcaagttacattgttttgacttttgttatgaatgtaatcagaatccttagaatgcaaaatcttttagaaaattcttgttggatcattagatgtctgcccatcccaaactgattgctagttgtacaaaaaccatattttcttttagtggacatttaaaaatatcttctattagcaaggattacattttatgaactgtaatttttcacctgactctcttaactttataaaatcctccccaccaaatagaggtaccaacaaacaccagaaaccaagattggtgaacaattggttggcaaattaacatttcctatcttcaaaagatgatatttgtcttgcttttttcccagtcacattttagtactagttttgtagcttctgagtacttatttttccagtgataaatcaaaaacagaaatgatcagccttactctccctcttttttctggggaaattgagaaccagaagagttaactgacccgctcaggcctcacatggaaacagtagtacagccagtccaaggacctgggtccggggctctctccatcatgcctatccccatttgaagtagcactaaagtgccatttagtgtactttttgtaaaaatttgcttttcagcacatcatctaatatgtgctacttaaaacttaattgccctttagaatgatttgtgatatgcctccttcattctctcaacaattttaattttacaagctagttttattataagctcaccagtttaggtagaaggatgttctctttcagaatctggattcttcctctagtaacctcatcagagctcaggaggagataacaaatcaaacattgagattgaagttgattcagtctcgtgtatgatttgactcaagtatcaatgagctaattaatatttttatctaaaaatattttgtaattgtgccaaaggttgagactctagaatactggagataattattttcagacagtagcaactagtggaacgggatggagcactttgcaaacaatgtaatatcaatggcttcttattacaatgccccaggtatgttattaggttgatgcaaaagtagttgttgttttggaccatgaattttaaatcattataactaggctcaaacacatctttattaatcaaataggaaccattacaatcaacacatttttgccaacaagaaataagtttgtttattcctgtagtgtacaaatctgtgctttgggattcgacaaactcttggaaagcattttctgcatccttctgattgtggaaatgttttccctgcaaaaagttgtcgcgatgcttgaataagtggtaatgggttggcaagaggtcaagtgaatgtggcagatgagacaaaacttcatagcccaatttgttcaacttttgaagcggttttgcaacgtgcagtcgggcgttgtcatggagaattgggccctttctgttgactaatgccagctacaggcattgcagttttctgtgcatcttatctatttgctgagtgtacttctcagatataatggtttcaccagggttcagaaagctgtagtgtatctcaccggcagcagaccaccaaacagtgaccattacctttttttggtgcagatttggctttgggaagtgctttggaggttcttctcggtccatccactgagctggtcatcactggttgtcatataaaatccactttttgtcgcacatcacaatccgagaaattgttcattattattgtgtagaataagagaagaagacacttcaaaacgacgattttttttttatgttcactcagctcatgaggcacccacttagccagttttttcacctttccaacttgcctcaaatgcaaaatgaccatagaatgatcaacatccagttctgtggcaacttccgatgtagttgtaagaggatcagcttcaatggttggtctcaattggtcattaccaacttcccatggctggccactatgatcctcatgttcaaggctctcgtctcctttgcaaaacttattttttttatttttttttgagacaagagtctcactttgtcaccaggctggagagctgtgacgcagtctcggctcactgcaactgccgcctcccgggttcaagtgattttgctgcctcagcctcccaagtatctgggactgcagccatgtaccaccacgcccagctaatttttgtatttttagtagagacggggtttcaccatgttggccaggataatctcgatctcttgacttcgtgatccacccgcctccacctcccaaagtgctgggattacaggcatgagcccccgtgcccagccacaaaacttcttgaatcaagactgcactgtatgtttgttagcagttcctgggccaaatgtgttgttgatgttgtaggttgtctccgctgccttaccacccattttgaactcaaataagaaaatcactcaaatttgctttttgtctaacatcctttccatagtctaaaatcaacataaaataaacaataattcattaggaaaaaattaataaagcgagaaatgcccattaaaattatatgtaacataaccacatttaagaatgtattccagtatcaaacggccaattccaacaatgcaaaaaccacaattacttttgtgcccacctaatcattaatcttaaattgattcatttatttattaaatgaacatctattgagtgccagctgcttccatgccctcgttgagatcgtatctagtggagttatcaaacaataaacaagcaaataaaataattaagacatgataaataatggaaaagaaacaaggtgatataataaataaggatggccaactttgtgtggggtggttaggaaaagacctctcgaggggacatttacacagattcctgaaggtaagaatgagcaaggcatacagagggctcaggaaagagcattgcaggcagaggaaactgcaagtgcaaaaaccccgatatgggaaggggccgctgttcctgtctgttaactgagaatattaatatcttcctgcctactactcataggagccctgtggtgatatcagtaaatttaaataaaaaatgacttaatctgggttagatctgtataataggcagtgaaggagaaattggggtctttttctctacttctaggaagaaaaattattgggggatatgagagaaaacacaataaaacgttcagagatctctctcttgccttctgtatcttgatttagagatctgtatcaaagactgcattgtatggtactagttatcagtgtgggagttcacagaaggcaaagatcttgacctggagtcttggcctggacttgactttggccttaaagaatgggtaaatttggatcagccaaaaggaggcagaagagagtgatttaaaatgagagaatgtgtaaataaagttgctaagatggactgaacatgaatgagaacttaagaccatgaagactcaaaagctggagctggagccagagccagatggacagaaaataattgaagggtctgattcatagaggtggttgaaccgttagtagagcagatttgacccgatgttagacaacacaggaagtcattatcatttcttgaacaagaaaattgtgtggtagaaagttggtaacgtaaatacagattaatggaaatgaggaaaaattattaatggaaataaggaaacaagcaggctaaataggaggaccttcttttttttaaatcgtgcatttcatagtacctggcaatgagaacatggcctatgctcctatcagagaatgaactgcatacaagacatttcaaatgagttaacagtgatacttagtgactgatggaggcggtaaatcaaaaatcaaaatgcctgttcacttgagtccaagggactgaccagaaaataatgtcagtgatagagctggggaagtttgcccagaatattaaatgattaattccatgttggacatgttaagtttcagaaaataacaagacacccattttgtgatgtgtgtacacaggtagaagtactgaactagagctaaaatagaaggttgaatttgagaatgcaaataggtggtgagaactgaagccttagctcttgagaatgcacacacatgattaaaagtgtgtatgtcggggaagaggcaggtggggagtaactgacacgcacacacacacacacacacacacacacagagagagaacaagagagaggagtctgaataagtagaaggcaccaaaacaacagttggataaaagccaccttcttgaggaaataccattatcattatcaccataaaaactacaactacctgttagtgtttactacgtgtcttaaagtctttaaatataataacttattatttctttccacagcctttaaaaaagtaaatgctgttgttatctccattgtacagatgaggaaggttaggacagagaaattaggcaagttgtacaagattgcccagtttggagaagctgagctgagattcaagcacaggcattgtgcttcaaagccctcaactgtgccatatggttatatccaacttggtgttttaattacgtggtttgacttcgatcttatgtaagtttcttgaaaaggagttaattaacagtttttacaagttgggtagaaaccagaaagtcaacagatggctgggcagtgattggataaatccttgtagcagaagacaacatgaaatttctctggggtaaggcagagaaagggaaagaagaatataccctttgctctacttttttttctcctctccatacactacaagttattgatacagggaattgtcccctttgacaagagttacaataatttgtggagaaaatggcacctctgttttttagcattttctatatactacaaatgtatttccttatttgtatacaaggaatgtcaatttatctaaattgactgtcaaccaaagtcatttctttattgacttccactactaaatgagagttagattccaaaagatctgtggtatgcatgaggaaaattttaaatttaaaaaaaatttttttttaagattccaaaagatagggcttgggaagtagcctcaacattggtattactggattaccttcagtctgggagcccaagtgcctggatgtctcagtggagaggctcaggacttagagcaggagttagacactgaagcccttccctctggagaagccacacgtgacttctttgtcgattgctttagtgaatgcttccccagtggctgacagagaactttgcctccattttccatgctcttcagggctcctccagcctctctcacttcttccttgtttgaggaggaaatggtacgcttccagtccaccatgctcagtcatacggcttaaaggagaggggaacaggtacctgcttggtgccacaactatagcaggcctttcttcagtaaataagctagagcttttctttggacctaaaactgaggatgggcctcatctaattaatcttcctaaaacacagttctgcacactagactttcattatttttccattctaaccagaatgaaagttttagcctcgcatttgtggccctccatgttttggcctgagctgtggatgcctgacctcatttaccagtatcccctttttgtcagggaggctgccccattccctgtttattctgtagggccccacttgccgccttctgtcgggaggaggctgatccctcagggattccctctttacttttcaatcttcactccggtctgtggtattatcggccccagttcaatgctgcgtacagttctcatctaaatgccatctccagcatacagtctcactgaactcacctagtattttatctccagctctcattatatctgtgttctagatatttatgtgcatataattatcttccctagtaaactctgggcagactctgtacctaatttaacttagtattttttatatcacttacacttaacatcagagaaagttaaagctgcaagggctgaggagacacacagacctgtgataatgtctttttcaaacttctttctctgtgctctagtaaataatagtgctgaaggtaggatagaccagatctcctggttctcagtccgggtcttatcctccaacaacagtggttctcccactggcttgcacattgaaatcacctggcgtcgcctgtgatgcttttaaaatcctgatccagaagcttacaaccatagaaattagaatctcaagagtaagacgttcacatcagtagcatccaaatctccccacatgattctaatgagcaaccaagattgggaataaatatcccccagtatgatggcccctggaccattgttgctttactgggtaattctgttaatttggtaaactttttgtcagatattaaaagtagaaaatactaaaatattaaagtagaaaagtggtaactattagataatagtatagttcatcttgttttgcttgcaacagtagcttacagttaactgtttgacttttcagatttttcgaaagaaagcagtggaacttggggtaaaattgctacctgcatttcatactccctctggaataccttgggcattgctgaatatgaaaaggtaaaactcttcattttcaacaacatgttttaaggtgaaatattccagattgttgcctaataagtatacattagatagataattacttatatgatactggtgactaacagactccactgggagtcttgagatctgtctttttgttggcagctattagcttttcagtgttccatagcctcagatatgtccccattgtgggatggcgtgacctcaacagagtcattcaggccagacacgattggaggtttacactgtttcatagtgactttgcatcaatgatactgtctccataaataccaaaagagtcccgttatcttttaattgtcatcaaagcatttcacttccaaagaagcaaattcctaagaacctttatttaagttcagctactggtcagaaatatggcagaaatacaatatttggcctaatcagatcccccataaaagcagctggtataacggagactgggagcacctgtggttacccagcccccagttgtaagaagggaaggcagccaatgcactcacccagatcaatccaaccttctcatcctctttggtggagaaccctgatatgccaagttcttgagaatgtggctccaattggaaaagacacacacacacacacatcccaggctgaacagactttctggtgttctcccagagagtagttggagttttcataacttaagcatttcattaataaacgattttgtcttaagcttccttcttaacgccttcctgcccataagttattaattgcctgtacctctctgtgataatgatgagacagtgatgatagctattattgtcactataaaatgtgatgggctctttagtcctcttaccacatattatcctcacaacaacccagtaaggtcaatgctgttatctccattttaccaataggaagctctagtcacagagagattaattaatttacctaatatcatacagtaagtaaatggtagagctagaatatgtacttagatgtctatacgcacatcgatgcatatgtacaaatgaaacagctttctggtttagaaacaccaagagaatgcatagcatggtttggcaagattaatgcacatttcttcctaattatttattttagtgacattctgtccaaatattaatcataaaaccatgaaattaatcagtttattttatttttcctttaacaaatttgtgagatgccatgctttagtttcatttgtatattatatatctacaccttgaaatcatcctgtacctatctataggtgtggggagtggggtggggagagttcacacctctgggccatgttaaactgagatattaatcgttctctattgcagaatgtgatgcctcaggatctgttcttcctttaagggtcctcaggctttctctgtcagcttgaagatcatacatgtactgtagggccttaatgcaggggtggctctgagcttggcttggaagcagcttggtttgtgtttggaggcccatgagtatttgactcctgtagaccttctttcttaccttttatatcttcagaatttgtatttataggtagtattctgaccaagatactactctcttacctaaaacaagatctggtcacaaaagcaccgtgcacaattaactcatttttttccctactgagaaaagtgttatgggcatagtagtacactaaactaattggttatcaaaagacctgaatctaggtctttacagctactcgaggtttgtcttgcagcagtcatttaaactctcttggctaatttgtaaccaggaaggtaggtgaactcagtagttactttgtgaacattttggggttcacagaccactttcagattccgatgaacatatgcctctcataaagtgcatattcctgactacatggatttttacacaatttccaaaagctaacagtacaatggaagaccaccaatgaccgccagtttacaatcctagagcagatgatcactccagccttctcttaaattctgtgaagctagtttctctcgtttcctggaaggtaatgaaattggagaaaggcctactaaatctaatagaggtgtgggctacatctttgcaaaagtcgagtccatttttatgagatgctgatattgcttaattagtactggcctcccttgaaataagcataagaaattggaattcaaaatatactattttgaaatatatttaactttactgtttatttccaactgccaagtagatttttccttagttaaatctatccttagtgtaccatggagatatttttcagtacataaatacttaatttattaaattactaaatcctctagtatctttcatacctatgtctgtcaagaatttattaaccagggcattcaaattttttataagacttcattttgcgcagtattttgcattagaatttatttaatttcagagattacagaaaaattgcatgtggtgaaaaataatgtgtcattttcatttatgtattcactgatgttttgaagttaaactggatgaaattgagcaaccatttggcagctgataataatttcttcttggcaacatgcatgaatttttaattatatattgtatccactctcaatcccatttactaaataccagtgacttacccaaattcacacaataagcactggcaaaattaatagtgatattagttcactaaaattccccctgttcctttgcctaatcaagtacactccttgaatcagctgtacttccagctgtgagactgatttatcatcttaagttttcctgtagggcaagaagcgacatttcatatttatctacaagattacttttcaaaatgtgctgttggtgtcatttgtacatatatactgttttgcgaatcactttattttcacagtatggtccaaggtatagggaacagctggcctagagctgctttcgtagttttggaaggctgtcaccagcaaaagtttcaaaggagtggggaaacatatatctggcaaaatcatattttcttaattaccttctcagaataagagaatgtagaaagctgcccaggagaagaaaaaaggagggcttaaagatgctttttagactagctgtgcattcattgttgactggctttgaaactcttggcaagaattaccactggagagacactgaatgtgctggctgtaatatcataattctgctcttccctctcaattttgaatgtgtctctttgtcaacatctctatgttaacaacagtgtgaacttattggtattatctgttcacattcctctggtattctggttattgcctaaagataattggtttctttaccttttctttgtcaaaactaagcatttatttgagtctctcctgtgataaagatttcttactaagtcctgggaagagtttctacttctcttcactttattcaagaagataacagacatgttctttccctcaggggactcacagcctggttggtaaagcagaatttatttttgtgtgttacacactcacacatgtaattgacaaacctaagatggaccaaggagagataataagtactcaccaggttgaatttgaagcaagcagcattttgaattggggaggtttatgtatttggagacaaaacatcaataagtcaagttgtatttcagtatttgtgcaagctgaatatatgcagagaacctaaataattcactcatatactacatgaggaactctatcccaaaagcggttcagaaaaaaaaattttaattgtcttttctgccacatctatttaaattgttaatccaataagaattcttaattcaatagattctgaaattgtgatttaatggaaagtactcatttaataacctagatgctatacagttcctcactagactaacatgtttccttcaccaatatgatcatagaatgagaatgcataagttacacacctctgctaaaagaaaatcattgcctttctaatattaggttttggtagaactcaatttctctaatgtgaaaatgtcaaagtttggtgtctattcttgttattactattagcaagaggcctatgcttttttttctcgaacttgaagcagaaaaattacctctgtgatttgtaaaatcaggcatttcaccatttctgtatttgcaaaggtaattcaagtctaggtagagtagacttagattttgggttttttaaagtgtgttcttaaaataatgtagttaatgttcccattattcatttctatcacagggcatacagtctgggcattcctaataatttttctgtctttcttgataaatgagttagttttagctatacactattttatcacttctctgtatggatttttctgacgcctgcttggtgttacatttagtagagctgtctacagtgtgtgcttttattgcacaccatgaaggtgtgtataggaaatgactgatcttcattcagactctcattagtcagtgaggtgatgaatgaggcacaacccctcacctgttttatttcctgctttgtaaagctttatttactgactattctaattatctgatgaaaatacatacgatgtcattggttacattacagtttatattattataattaaattgcaggttgctctactttgactgaaatagggctttaattaagaatagtacatagctgcctgtcttctaatagtgaaagattatcctagggaagcatataatgtgtatattttaagaaaaggtgatagcccccttgttgggtttattaatactttggtggtataaaatgtttaaatattacattatagttggttaattttaataaacacaaactatgaaagatgatctgataggttaaatattgttaaagtgttttcctatatctccctatgtttttacttgacagttaaagcataaatttctgcattattaaatttgctaacagttttttaaagttcctggtttcagatttgaaagaagtatattatattttcaaatgaagcagaatacaattccatactttaatataatagaaataatatgaaaatatcaataaacaaattttctgaacataagatcaaattgatttaatggtgctagtattctatgaggcaaaaatattgcttaattatcctaaaaatgttctgtagcagtgatataagcctgagtataaaatcagagctccatcttacactttatgttttatttatatactttatggatctattaagaagtcagagacaagtttagaaactgtagaaaagttttttaaaaagaagttacatctttctaagtattttaagttaaccttctttatggtttctttttcttcccccagttggattttttttaaatattgggttccccacttccctcttttatctattttaattcatttggccatttgtagtcttctggaactagtaatcaacaatactttaagattttaatagtggtatgtagttattaatgtcaaacattagaatattattaccatagttaaagctgctattagcagtctgtctctggaaaattcacttaacttttcataagtaaaactaaaataatagcaataataatgcctatcttgacctcataaggcttttatggaaatctggttaatgtgcagaaggttaaaccttgcagagtgctatgaaacagatggacattggaatttttcttaatttatggttctattctcaatatttcattatgaaagagtatatatgaatatggtatatgataaaatagtatatatctagaactgactaacttggttctgatgtcctttcgtggacatcatttcatttttaagctatcagtgctcctgacctgttcaagctggagttgtattttcctctggcagaaaagagatgatggaaccaattggatgtgtggagagaatgtctcaatgtggtttatgtaggatagtggtggctccgtgctcaagcttttattattttttaaattatttgggatccaacctataggatcaaaactaaatttgctccctaaaattatatttattagtgaattatgtactaaaaactagaactgttcagccgattaggttttaaaaggatgcgaggcaatccagagttatgttcttatcctaagtcttacatgctagctagtgcctaattaatgtggtacaaacccagtctatgaaagtgtgtgtgtctgtctgtctgtctgttataaatagccacatagccctgtttcctagttcttggactgttctgctaagggtctgactgttctggttgctttgtatcagtgactctcaactttcccatgcctcagaataactgggattctaatatatatatacacacacatatacacacacacacacacacacacacatacatacacacacacacatacacaaacacacacacacacacacacacacatataattgctgccttcatctttcccttcccccagtctgtttcaattggtttggggataaaattctggcattttttaaaaacctcccaggacattctaatattcagctagggtcaagaatcattgttttaaatccagcatttatatgctgaggttagctttatttctcatctcagttgcatttgaaaacattgggtttaaaacgtttccctattcactgatggtcaatttaattattgaaattttaaaatcctagaaaattactttgaaaatacccagctttaatagaacagtgcttctcaaactttagaatatataacaattgccaggagagatcattaaaacataacattgctggatcataagcagagagcctgattctgtaggtatttactaagaattgataatttgcttttctaaccagattccagctgatggggaagctactgctgctgctgcttgcccaacgaccacactttgagaaccactgtaataagaaatgactgagccatcagagccatgtagttaaatctcagagccgttcagtgaggcagccaggtccactgttggggaagcaggagtagggcctgtgttctgtttctatcatttgtttactttcattaatagttacacaaagtttccacttaactctaagcagtttgttgcttcttctggaaagcagccaattccaagcagtaattacccaaacagagtttgcatgtcctttttccccttgtactttttttttaatccagtgagactagaaagtaaactttaggcatttttagcatagaggggaaaaaataagcatttttaattagaaacttctgggttactgtttaaaagtaaagctatttccataaagtcacactttgtagcttcaggcaaaatggctttactataaacagctggtaacctggccctgtacctaagggtactgtgaagaatgaagcagaatcagggattaccctcccaccagatgagcaggagggaacagaggtcacttctgtgatcatttaatcctgtcaccaaactttggatcactacagctctgccaggcactcaataccttgaccaaactaaggacatttatttattgcaagtggacagttataacaggatagcaacacttaatttaaatgtactttgtgtatagccacctttatggagacattacggacaaggaagtctgaacaaaggatgttcttagtcatgcattgtgaggcggtaggaatttgaagaacctcaggatgcctgaacctcaggatgcctgaacagtttcctttcttcccacttctctggtcataattgaagttaacactcaggtaaatgggttttttaagtgttttttattctctgaaggcaggagcagaccatatctgcctctgaacacaggctgtagcggtcctcatttcttctgcaccccaccctcccgccttttccttgaatttccatctgctcaggctcctgctgtgtttctgatagggcaagagcaggaaattgacatgaatggaatgaccaggttcacgttttactcaacaataaattagatattttaaaatatttttctatactttcagaaagttctacaatttaagggtaaattgtagcatatgaataattaaagtggaaaaatttatccaaggtgatgtgtagagaatttagaggcagtttatcccgagagttgcttaaatccctttttaaatgacttgtatgtgggaagtctgttaagagggcttcctcacccttcaattttgggcaaatagaaccttggttcaaagcagatgggactggattgttaaatatgaccactacttttcccatagcatctaccacagtttaagcagttaactcaccaggaaaatttcatgtaaggacaattatagttattttaatgcaacaatttcaaagtggctttcatctcaagtttttcaaatgcacagaactagtgttttacagattcagctttgttcactctgttcacacaattggttgcgaatcagcctcagcaatttgaaatttatgctgtgtacagaacttagattgggaacaagtcagaatgcgtaaattcatatacctccctcacaagctaacaatggaataatcttttcaaggaattgaattccccaggtttttaatgacccagcaatcaattttcctgtgattaatctcaaaactggtcttacgttgttattgtgggacaaacctttcaaatatctaattagtaaagtttaattttaaaatttatgaaatagtttgaatacatggttgaaaatcagcgcaggtatcaaggcactttatcagccctcataattgttaatcattgtaaatattcaactaactacattgaatctttgggaattggagggtcaatataaaatatttaggctacagccaatagttttaaaggcctcacagtctcagtggatacattaactactccatgtttcctgcttgtgcagtaatagttatagttgatatgttctgaaaaatgggatgaagaattattaattgcagttctttttattaactagagaaaaaaagtgatggagcaatactgagaattaattgtaatttacaaatctggaaattaatgtgcagctgcgcgtaagtacaggcagtgcaatttggtgatttagcaatcatgacaaattatcttcatctataaggtggagaattgttaggattcctttattcatcttttaataatagacccagtttcaggccgggtgcggtggctcacgcctgtaatcccagcactttgggaggctgaggcgggcggatcacgaggtcaggagatcgagaccacggtgaaaccccgtctctactaaaaatataaaaaattagccaggcgcggtggcaggtacctgtagtcccagctactctgcaggctgaggcaggagaatggcatgaacccgggaggcggaacttgcagtgagccgagatcccgccactgcactccagcctgggcgacagaacaacactccgtctcaaaaataataataataataataatagacccagtttcaggaagactttatgtgaatgctcatgttgcccttttatcctgaaaatgtgagtgggagtttaacattataaattaaatcttgcttcccctctttgtcatgtcatgctatagtttttatggaacatttgtacaaaacagtgattactgcatatgttgaataatcttaagatgctactgagagtttaatgtaccttgtaaattgagaggcttccaattaagtcaagttcttaagataatcactttcaaaactgatcaagtaataggacattagtaaagctcttattgacttaattgtgacaaattaataaacagaccctgtgcaattactataatggtgaacagtttttcaaaatttaagcataaatctattctaaccccccaaagtacattaaaaactatatatgccattttaagatgggtatcatttcaaatagctgtgttcgagttcattatacaagtagtatgaatttgtatgtttctttcttttaaaatatgattacatttgtttatttcaaaggtcaattaatctacttgcaaagcccttagagcatataattttacaagaggtcttccgtatgccatggacaaaacaattacatgttcttatgtgttctctcatctctacttttattatgtcctgtgtccttggtgttatctcttcactgagaactatagaatatcttgtcttattgtctctttgtcccctttggggacaaagtcagcatggtacctttttatacattgaaaaatgaatcaattatgaattacatatttgccataatttttaatatctgacagtgccaattcctataactgtgctgactgtgtttaagaaaaatcagcagaaaagaaaaggcagaaagagcagggatgtaagtcttgcttccatcactttaagaataatgtgacagttacatatatttgcctaggtccatctaactgtgtgtatttaaagtgctgtgctttattgaatataactctatctttttaagtgtgatcacatatctttttttatttaaaaaaaatgtagcatgctacccagccattagtcaacataccttgtttaagcatggattttcttatttgttaaagtaggactaataagtagtatcagttttacaaagatcacatttatgacaggacctagaaagttgaggagctgagcaatattttacacccaagagaatggatcattatggaatttcaggacttcatacaggttgctgccagcatagtgcccatccagatttcctgaaatcatcaaggggccatccacactatgtttgatttagaccttagccagagagggagagggagagggagaggagaagaaaagaaacgcaagacaaaaccaaaaagcaaaaaaggaggaagtattactgactgacggcagcagtgactccctcttaaaagtaccacggacgcaaactcgcagtggggctgaaaaaaatgtaggagagggagttccgtgtggtccagggattacaggtgtgagccaccaccacacctagccaataatgaagtttactgctttaattcttcccttcatgaaagatttctctgtaacatgtgatactcttttatggcattttccacacggtaaaacttctttccaatttggagtcagtcttctcaaaccctgctgctgctttatcactgtgtttatgtaacattcttaatcctttgttgtcatttcaacagtgtgcacagtgtcttcaccagatcccatctcaataaaccattttctttactcctccataagaagcaactcctcatccatgaaagttttatcatgagatggtagcaattcagtcatgtcttcaggccccacttctaattctagttctcttgctattttaccacatctgcagttacttcctccactgaagtcttgaacccctcaaagtcatccaggagggttagaatggttagaatcaacttcttccaaactcctgttaatgttgattttttttttacttcctcccataaattacaaatgttcttaatggcatctataatggcaaatcttttccagaaggctttcaatttgctttgcctagatccatcagaggaatcactgtctatggcagctatagcctaatgaaatgtactttttaaataataacacttgaaagtcaaaattccttttttttttttttttttttgagacaaagtctcactttctcgcccaggctggagtgcagtgtcacgatcttgactcactgcaacctccacctctcaggtgtaagccattcttctgcctcaacctcccgagtagctgggattataggcacccaccaccccgcctagctaatttctgtgtttttaatagagatggggtttcaccttgttggccaggaggtcaggagttcgacaccagcaagtgatccacctgcctcagccttcctatgtgctgggattacaggcgtgagccaccacacccagctcaaaattactcctcaatccatgagttgcagaacagacattatgttagcaggcatgaaaacgttaatctccttgtacatctccatccaagcttttgggtgaccaggtgcattgtcaatgagcagtaatattttgaaaagattctttttgtctgagcagtaggtctcaacagtgggctttaaatattcagtaagccatgttataaatatatgtgctatcatccaggcttttgtcttccatttatagagcacaggcagaacagatttagcataattcttttttttttttttttttagacggagtcttgctctatcatccaggctggagtgcagtggtacaacctcagcttactgctccacctccctggttcaagcaattctcctgactcagcctcctgagtagcagggattacaggagcacaccaccacacctggttaattttttgtatttttagtagagatggggttttgccatgttggccaggctggtctcaaactcctgacctcaagtgatccgcccaccttggtctcccaaagtgctggaattacaggcgtgagccatcacacccagccagatttagtgtaattcctaagggccctaggatttctggaatcataaagtcaccagctgcatttagaccctaacaggagagtcagcctgtcctttgaagctttgaagctaggcaatgatttctcctctctagctatgaaaatcctagatggcatcttcttccagcagaaggctgtttcatctacattgaaaatgtgttagtgtggccactaacacattttagtgcggtagtcttagccaagtcttctgcacttctagcacttgctgcttcaccttgcacttctatgttacagagacagcttcttctcttcaccttcatgaaccaacctctgctagcttcaaacttttgttgtacagattcttcacttctgtcagtcttcgtagaattaaagagagttagggccttactctggagtaggttttggcttaagagaatgttgtggttggtgtgatcttctgtccacaccacctaaaactttctccatatagccataaggctgttttgcgttcttatcattcatgatttcgctggagcttttaatttcctttaactgtttggcacaagaggcatagcttttgttctgttttcacttttgatatgccttcctcactaaacttaatcatttctaggcttttgatttaaggtgagaggcatgcgattctcactttcatgtgaacactcagagtccattgttgggttattaattggcctgattccaatattgtagtatctcaaggaatggaaggtcctgaggagaggaagagaaatgcgaaacagctggtcagtggagcagctcagaacacacatgcttacaagttaagttcatcattttatgtggacgtggttggtggcaccctaaaacacttagaattgtaccatctgatcacagatcaccataacagatatcatcataatgacaaagtctgtaatgttggaagaattaccaaaacttgacagagacacaacgtgagcacaggctgttagaaaaatggcaccaatagacttgacacagggttgccacagaccttcaatgtgtaaaaaacacagtatctgtgaagtgcaataaagcaaagtgcagtaaaatgaggtatccccgtatgtaaattttttaaatgtataatttttaatatgtagaattatgtggctgggtgtggtgactcatactctgtcatctcagtactttggaggccgaggcaaaaggattgcctgagcctgggaggtcaacagcagcctaggcaacaaagcaagacctcgtctctacaaaaaatttcaaaaattagccgggcatggtggcacatgcctgtagtctcagctactcgggaggctgaggtggaaagattgcttgagtccaggagatcaaggctgcagtgagccatgattgtaagactgcactccagcctaagtgacagagtgagaccctgtctctcaaaaaaaaaaattttttttaatgtttattttgcatacatacacacacacatatacaaacacaattcttaaaaatgagttcagaaactcctgaaacttttcctctggaagattttaaaataaggtagaaaaactcaatttttaagttaaatgcaaacatgaattttaaaggtgaaccactttcacaaatattttcattaaatttagtttccaagtaatcttttcttagaatgagtttctttcaaaatgcagatttgttctattgttaaattgtcacctcctttatcttgaagtgggagatcaagtgtgttgttttcttcttttcaaattatctggtaggaagcatacttgctgacaaccacttgtcacagaaaaaaaatcagcaaatgtggggatacctttctattttgtgaaatgacaactcttgattaaatactttgcctcaagacaatccaaaaatctgtttggtgcagatattattgtggtcactgtccagctctttacaaagtattgtgataatgtaataattctactgtgcaaaggttttggattttaaaattaattgcattggtggcactctataactcataatccgcaatacatcaaaagcctctgaaagctgtagaacagtgagggtcccattgccaacttcttattgtggagtctctgcaagaatctctagcatctcttgtgtgtcacctttcacagaagcaccaagggatgggagcaatgtatgtctgaagatttaagaaagccttttttcttgcttttagatttaagaattagcagctttgatagtttcctcttgtaccctgtgcttattgcactctaattaagagtcctgcatttggcttcaaaggctgctgccataaacaataaatatctaaatgtcattcacctttaagcccagaccagtttcttatcatctgacagtttataatgggcatattgtctcattacattaagtggactttgatcctctttagattactcttgagaatatttttttaattggcttaaaggaaaattctaaattatttttaactagatgtaaatattacaagactaaatttgcggcacactcttatttgtattaattttctccactttaaagtaggccaaactgtgttcatgtgcccagagaggttattgattagataaagaggttttcttaggtggttttcatgtgaaatcgcttggaaagtacttaaacacattactctctaatattggttgggtaagcaataaagtggtggagggtgtcaatctgtactaaaagagtgataaatgaacaacatatttggtgctagtatccaaaatttttgctagattcaaagggattcaaattatagaattcactaatctgagtttctgagtctagtgagcaagaaagtgataatttcatatttatgtttgataaagaagtttcaaaaaatggaatttgtggtgtaagcataagcactatatagaataatccttaagaattataaatttgcttttcaagtttttctaaagaagggaaaataggtcccttttcaaactgaagacgttacaaaatacattattgtgttgattctaaaggaaaacagagtaaaagagaagaggcaggagtcaggaaaattatgaatttagaagctataggcagccagataagctaatattagtgccttatgcttctgtaattttctatagcctacaaggatttccaaatatacacacacacacacacacacacacacacacacacacacatatatatgtgtatatatgaaatctcattaatttgatttaatctaatctggtacaagcatgaatatccaattttataatttgaatttccttttgaaatagtttggaactattggaaccgaaagaaataattttatgcttttaaacttcccaatactcagggcaaaggcagggaagataaaattatcttagtattttattggcattgtaggctatcactcattggcattgtaggctatcactctgtctatttgtagtatattgatcattaagtaattccaatgtttttcttttttttttttttttttttgagacagagtctcgctctgtcgtccaggctggagtgcagtggtgtaatcttggctcactgcaagctacacctcccaggttcactccattctcttgcctcagcctcccgagtagctgggactacaggtgcccaccaccacgcccggctaattttttgcattttttagtagagacgaggtttcactgtgttagccaggatggtctcgatctcctgacctcgtgatccgcctgcctcggcctcccaaagtgctggattacaggcgtaagccaccacgcccagcctccagtgttatttttaaaagttttccatgggtcaggttgaattctacgtacctaccagaactatatttcaccagtaatcctagggtttgatatatacaaccacctttcattaagcttattctcactatttaaagataaaaaataaatgtaaagttcaaaatctttctctaaagagttaaaagtggcaactatatacatagcacctttcttgcctggatgtgaaagctaggattatagaacctgaattcttttaaacatgttttgttagaactgattctccttcctttatgccatctttttgactccactgctcttctgtcttctccccgtctttgtgatcatgtgatcaaacgtgaaactatattcagtgagagcctcagtggtaagagtgaaagcatttccccccagtccaggggcttcatccttccttcagtgccttggccaggccctcagggaatgaggagacctttgctcttccctccaccttgtcctgactcctcaagcctccagccttgaggaggcttctctagatgaaagctcctcagtaattgtattagtctgttctcacaccgctatgaagaaaaacccaagactggggaatttataaaggaaagagatttaattgactcacagttccgcattgctggggaggcctcaggaaacttaaaatcatggtggaaggcaaaggagaagcaggcaccttcttcacagggcggcaggacggagtgagtggcagcagaggaaatgccagatgcttataaaaccatcagatctcatgagactcactatcacaagaacagcatgggggaaactgccccatgatccagtgacctccgcctggacccacccttgagacgtggggattatggtgattataattcaagattcattgtctcaaaacatattagcactctgcttttcatactttttccctttaatcaagaatctttaatagttttccaaaagcttcagggcttgtctttaagtaggcactgcactctgtaaccctatgttcatccacatgtagcccctttgaaggactttacctccaacaaaaccctgctatttttaaaggttcagttgtgtcatctcatctgtgaaagatgtcatcatctctttctctcatccttgtcccttccccactttggaaaagtaatcaccacctccttctcataacacttggtttcccattgccagtataagctatactatggagttgagggactccacaaagttccattaatacataactgtgttgaaggcaagaaaatgaaagctcttgggagaattaaaaagtaatatgttcacttggggttttttccccctaaaacaaaaaaatgttcatattcaggaaatatcaggtgaacacccttctcctagatcctggaccaggtgcaggagataagtggtaaacgttttcttggtgactctcacagagtttatagtctagggaagagacaaacattagttaatcacaaaaacatttcgaattgcaggatgtgaagaagtcatttttgagctgggatcaaggggatgtgtagatgagagctaggggaagagaagagagtggatggtccaggcagcagagcatgtggagtgtcaaaactctgtattgaaaaggaacaggacaaggccaagaggctgaaggatggcaaagccccctggggcagagagcagcaggctggagagcgaacactgacagactctgtggtggggtctcaggtttgtcttggcatcagtgggaagcactcaaggtcctgaggaggacatggtcgtgtttgtgtttaattaattcaggttcctgctcatccctgtctcaagagccataaagcattatgaccaaatcatgccagctatcaggagcgatcgttttagattgtcatgttttacctctttgatatttgtttaccttttcccaaaaacacaagcctgcaatgcaggttcctagctggataggcccttgaaatgttgggtatagtattaaactctggttggtctcctggaattggtttcaccatcaagcagtaaagatttcatttgagatcatctgtcatcagatcatttgactagaaactgctaccaaaacaaaggcctgacttgtgagaaagagcaggtatttgacacagctagcaagtttgtattttttagttctgttcacttgtttcagatagtcaaaaataactttaaaaaaagaatcttcctttaatttgaagaagagaatgtcgtgtaaaatgggttcaggttcacaattgctacagcttagaatgagtccagttaccaaaaaactgaagtcagaacgggcagatatatgtacatatctttatctgtttgttttctttatttttaaaacagagaagaggggattgcctgagttgaaaacatgacagagggattagcactgtaggaaaccaagagaaaggttcatgaaaaatgaaatgttctgtgctagtattgttaaagtatttacactcagaggacataagtggatgccattgattttcagtcaaaaatgcttgaagctcaactgcatttgtgaaatatatacctacatatttaagctaacataacaatttatagataagtaatatttcccaaattgcattacccagaatattatgtccatgaaatattaattgatgatctatgaaaagaaaacagctctatagataaataagtttgtcaacactggatttaaaaggtttcattactgtaaacttctcagaactattaactggctaatgtgcaatgtacattgctcatctctgggatggagctttattataacactgcttcccaaacttttttcaccatggaacctcttttatccaaaacaattattagtatttctgatctgcattttttgttttttttttttttgtctcagaacacagtttgatagtcactgattctgataattgttgttatatgtccttcaaaatagtcatcttaatatcattaccctagtaataaagttcttgcctcaaatatatttgaaaataatttgaggtaagtcatttattacacgtgtatactagttactaatgagaatactctgtggtgtgttatatgaaatcttaaaaagtacccactgcagaaaattagcattattgctgtgtttatgcttctttttaataaaaataaaaaagcaggcttctgtttgccctcaatgagagaattgaacgctgggaggccaagtagtgagaacaagggagggtcacacagagttacacatatgaagttttgcaatgggccgctatataagggcccacactttttatgcctatattttgtcattttttaaaaagtataagattgacatactataattataactatttattttcatttatggataggtacataatttgtatctttatttagaaaaattctaacatttccttccaaatttgtttttttaagttcttcagatttattctgaatttcatatcattgtggctaagaaattaggggtttttctttaaaaaaaatagttttctaaaagagtctgagctattttgtgataaaaatttaggatgtatagtcatagaattctttttctgaattacaagggtcttttgtgttctaataacgtattccattatgtatatttgaatggcaagtctagatggttgagtttctcagtgaaaaatttggtgaaagaattattaagatttttgaaaattatcactatatattattaaagaaaaccctaagtcaataataccacaatgtcatgatatttgcattatgatcatttgtgttacccaaagcttcggattcattataaacacatgaaataccactagggttggagtgaagttaatcacattctttgctcttaaactaaaggtaaaactttcttcagttaagttattgaggaataaatatgctggtgaacaatcaataagtaattactacaaaactgtattacaggggtctctctgaaccatatccctttcacaagtctaataaatttcaacattgtttaacttttagttgaatatgttaaactaagaactaggatataaaatgttttgtttcttgtctctttttctctccagtaaatactttcatattttttaaaaagttttggtttcctaagcatttcaatgaacagagcaatgaaatattattgcagatgtatttctctatatatagtgcattctcttaaaattttagtgagtaaaactttttgttaaattcactttataaaacagtttcttttttctgattatagaaaaattttcatgggaaaaaataatcactcgaaatttcaatccgatgttaacatatgcatcactcaattctcatttttaaaaaacaggccaagtgcaatgacacatgcctgtaatcacagcacttcaggaggccaaggcaggaagatagcttgagtctaggagttcaagactatcctgggctatgtagtgacacctcatctctataaaacatttaaaaatagctgctcatggtggtgtgcacctgtggtctcagctactggagaggctgaggcaggagaattgtttgaggtcaaggctgcaatgagccattattacaccactgcacttagcttgggcaatagactgagaccatgtctcaaaaacaaacaaaacaatgaaattgtatacttccgttccattcgtttttgctttgtatccactttttggaggcataatttacctgaagaatacacccattttaagtataaatttcagtgtattttgacaaatgtatacgtctgtgcagacactgccacaatcaagatatacaacttttcgttactcacaaaactttcctagtgaccctttgcagccattcatttgccatcatctgaccccaggcaaccactgatatgttgctgtcagtatacattagttttgtcccttctaaattttatacaagcaaatgtgcaatatgtactctgctgtatagttttttttggtacagcatggtgtttgcggttcattagtaagtattctgtgtatactagttcaatcctttatattgctgagtagtatttcattgtatgaatatactatagtttattctcctgtttatggatgtttgtgttatctctaattttcagtgatcataagtaaaactgcttatgaaaattcacgttcaggccgggcatggtggctcacgcctctaatcccagcactctgggaggccaaggcaggaggattgcttgaggccaggagttcaagaccagctgggcaacatggcaaaactctgtctctactaaaaaatatataaattagccaggcctggtggctcacacctgtaatcccagctactcaggaagctggggcacaagaatcgcttgaacccaggaggcagaggctgcagtgagccaagattgcgccactgcactccagcctgggcaacagagtgggactctgtctcaaattaaaaaataaaaagttcatatccaggtctttatatgaacattttatatattcttcttggtagatgcctatgaatggaattattgatcatatcaatttttattccctactgtctttttcaaggatgtttattgaacagcctgggaagatgtgtctaaaatatcatcttttaggacaatgggcagttttttgtttgtttgatttcatttgtttttagtttgtttgctgtccacaataatgatgtttccttctggaacaaagattgggcatgtttcctagcagcaccttttaaagattagggttccctcggctgtaacacaagccagtgtcatgtgcagcgtccacccaggctgctgtgcgtcacccttgtgtaaacgtgaaaggcaaggggcactgatgcatggatgaagctcatgctgcctgctgttcctttcactcctttcctgtgctttgtgtatgtgtgttatggcaatcaaatatttttagtattcattttgagtcctctttagacatgttagttgtctgtcttcatattagtttcttttctcatggctgctctagggattacaatttacttagagttagtattgtatttcaagtaaattataggaactttaaaatggtagagatctttttaaccatcttaccttttgcgaaaaaattcagatagatgcatggataggcagacagatgtactttatatctacctacataatttgccattttcaatgcctttagttttttcctctgtagctattccctgcaacctaaatatgttcttctagtatttcttttacagcaggtttgctggtgacaaattatctcattttttgccaatccaaaaatacttccctttcacttttgaagaaaagtttcatcagatatattgttgtttaaaaaatacataaagaagggttattggttttcagattttttatcaaattttgaagatgccattcttgcgtcttatggctgttcattgtttctgagaagtcagccattaatcttgtcattgtttccatgtatgtaatgtgttatttattttctgggtactttcaagattttctcattatctttggctatcagaagtttgagtttgatgtccatagctagggtggttcttgttatagttatcctgcttgtgtttgctggttttttaatattggtaaattcatggctttcacaaaatctggagtttttagccagtacctcttcagatattttttctaccctttctcctcctcctcttccttctcctcctccttctctttctctctctgtctctctctctaagagacaaggtttcactctgtcactcaggctagagttcaatggcacttcatttcagcctcaaactcccaagatcaagtgatcctcccacctcaacctcccaagtagctgagactacaggtgtgagccaccgcacctggctccagttatacttttctttgacccctaaatgttatttcacaagtctccaaagctctgttcatttatatttaatcttttctgaatattcttcagatacaattttttttttattgagacagagtctcgctctgttgcccaggctggagtgtagtggcgcaatcttggctcactgcaacctctgcctccctgcaacctctgcctcccgggttcaagcagttctcctgcctcagcctcctgagtagctaggattacaggcatgcaccaccatgcccggctaatttttgtatttttagtagagacgggatttcaccatgttgagcaggctggtcttgaactcctgaccttgtgatctgtccacctcggcctcccagagtgctgggattacaggcatgagccactgcacccggccccagatacaattatttttagtgatatcttcaagtttactgtttcttctgcccatttatttagcacattttctttgaattctttgaatgtatttaaatagttgctttgaagtcattgctaaatccagcatctagacccactcagagtccatttctgttcattgttgttcttcctgagcatgggtcacgttttcctatttctttatatgtctggtaactttgtgttaaaaactggatattttagatatgttaagtagcttttgatatattacgttcttctgagaattattttgttattgtttacctagccattaactctcttggattcaaaccataaactgtgtcccctgccaagtgtgacagctggtatttctgctcagttctttccatttccagctgttggtttttaacctggcaccctggggatcttctccgtacctgtgcaatttagcattcagtcaaggattttggcaaattttgtagacattgctaagctctgtcttctgacacttcagtaaggatttcgcttcctgtatcctgagtagagcatggattcaggagtactcagtctataaaagtagcaaacatgaaatcttgtctagtgcagtctttctttcaaaggtagctatccctctggtttctctcagctattttggtgatccccagtgtctcccttatagcatgtcttatttagtggtcatccagggatttcagcagagattatacccagtgttttggtcccacctcttctatggcttacttgtttccaggattccaccctgatctttcagctaccctgccagcctttaactctgtcctgtgccatcttaaaatataactgcaattttttaaaatcagatttttttaaaaagcctttaactcaaattcttactaattgctgttggtgtctttcaatggttaatgctctgttagtttgtgcctgctttttggtcactttctaatgcctttaaatagttgagttttataatatatatatataatgcccagattttataattgctattactggagtatttggtaaccaattttcttcaccattactagaggccagaagtccctccatttttaaaatatcctcaataattttctgtcattaagcattctctgacctttagtagctgcataatatcagatctcctaaataggccataatttttaacctgtctcccgtttttagatatccaaactcttttcagttttataatagtataattagtactataatgtataaaccatttttacttgggaatataagttttattggggataaaattataatttttagggcaaatttctagaaatgaattcagttagtaagtatgaatattaatacatttgatacatttttccaaacatccctgcagaatagttgtgccagttttcagtgccacctatgaaatgtaaggttacttttttttaagtcaaataactttaaacttatgagatttggtggtgtttggtttctgctaaaagaattatttgatttgttttataagcaaaaaaattattcctgattgttttataaactgcataggctatgcttacattaagaaaaatatcacttgtaatatggttatataaccaaaatagtagaatgagtaggagctttagtttatttagtttaattattagacttatttcagtaaatacaaaaacagaaaatttttaaattccactatagggaactaattttgttcacaaaatattttagaatgaatattctaaatattcattctaaaatattcttttcctgtttcttatttcttcccttcccccctttttaaaccactttgagatataattcacataccatacaattcatccacttaaaaggttcaattcagtagttttgagtatattcacagagttgtgcaaccatcagtacaacaaatttcccttcccttttgaataacaaaatgggagtaccaaatggaatcccagtggcaaggtcaggaaggagagagattatggggcaaggagaagagagattctgccaccagagaagctggatttttctcctcctcactcccaaacactgcccaggatttcagctgtgattatataaataacattttaaaggcaattttgtgcatttttcaaactgtagaaaactagtcatggtgaagaagtttctctgtgctaatgtgaaaatgaaatcaagatcattttgtgttgtcattgtttcgtaaagatgaaaggtggaccgggcatagtggctcatgcctgtaatcccagcactttgggaggctttggcaggaggatctcttgagctcaggagtttgagaccagcctgggcaacatagcaagaccttgtctctataaaaacttaaaaaattagccagccatggtggcatatgcctgtagtcccagctacttgggaggctgaggtaggaggattgcttgagcccaagaggtcaaggctacagtaagccatgaccacaccactgcagtccagcctgagcaacaggacaagatcctgtctcaaaaaaaaaaaaaaaaaatccttaaaaaaaaaaagatgaaagatactataataacaacaaccaaaataaaaaacacttcagggtgtttattagctaaaaagtattatccgtaatacgttttatattagccaaaatataatatttatcttatgctaacagtactgtagcaaaaatgaactctggaaaatatggctcttcacattttgaagtcagttggggaagtttgaatatggacaacatactaggtcatttgaggaaattattgttctttgtaatgttctttgttgccatatggtattgtggtcataaaggaggatttccctactctttggagatgcatagtaaaatatttagtgaattgatatctgtgacttcttcaaaataatttcccaaaagtatattaatatggagaaagaatattatgctttatatagataggtgaaggcactacaacaaaataattactaatatttgttaaatctaagtggtgggtatatgagtaaatttaagtgtttatctcactcttgctgttactttttcatatatttgacatttttcattaaaaataaagttttggaaaataggtctctgaggccgggcgcagtggctcacacctataatcccaacactttgggaggccaaggtgggtagattacttgaggtcaggagtttgagaccagcctggccaacatggtgaaaccctgtctctactaaaaatacaaaaattacctgtatttttttgtattggggaggctacggcatgagaattgcttgaacccaggaggcagaggttgcagtgagccaagattgtgccactgcaatccagcctgggtgacagaaatgagactctgtctcgaaaaaaaaaaaaaaaagaaaagaaaatgggtctctgaatattctagacacaaaacaagaatatgtgtttagtttgctagtattaggtaacatgaggaagatatctattcatatttgtcagtatatgcaaaaattatctttaaaatgcgattgaagaaacaagtaacagtggttatctgtggagagggaataggaaaagtgtggatggggcaggaattggaagtaaaatttgtggttacttttttatgctttttaatattttgaaacattttattatctaataaaaattacatattgaaagagagaatattgtcattaaagattggagcctaaaaaaatagaaaaatttattttatgctcagaaattttttcagataatgctaaagcactgggcttgtaactgttgttgacctgctgataatacatttagaatttgcttcgggggtattaaaaaattggacttctttttctttgttacaacatgtcagcattgtttttcttttattgtctttttataacatgttttcactggggacttttaaagaaaaaagtatattatgagtcagttttgtacatattgggtttttttaatgccgtgttgtttcaaataaatatagattggtgatatctcaattttcagtgctaataaatttcctttgctctccttggctcaggaaattggctaatttaactgctaacctatatagaagtatttatatgaaaaatgacatcctgtagtatctgaaaaaagcagagcacacattgttaaactagtcagacctggtgtggaaacccacccacccttgccacttaataactggagcaagtcacttaaccttgtagagacccagtttcctttgctaaacagtaatatcctaccatctacgaggttgttgtggtgattaattgaattacataaacaactcttacttgtagtgtcctcatttaaagaaggtgcctgtttatttttttaatgtggattaccaataagtatgaagggctagaagtttaacattggttatatgcattgccttatttgtttacaagtcattctaaagagaaggaaacttaaaccattttacatataaaaggatactacgtgaaagtaatgtttaattaaattaaaatttaatcaatgtatctttaaactcaccaagtaaaataaattcctgtgttatcaagtttttacctcttggaattaagctttaaattttctatttcattttaccagtgggttcactggtgattggatcagcaactccaaatatcatgatgtcctttacaaaccttatatattgtccatagtaaagtagttgtcgtaatgaacaagttttggcagaagaaagatttctatggtagtcttttgaaaatcattctaaaatgaagattgtggtaaaagtcctcttatgatggaataaagagaacaacttttattaatttcctgtgcatgtggatattcaaaagtgtatggattttttaaatgatgattctgtaagaactcatagttgattacttagccacctgcaagatattcctttgaggaaaaaaaaaaaaatcaccagacaagattttcctagcttttcttactaagttgtataatgtgtcattgatgtctgtggctgtctcttactattagaaatacttttattacctttttctagaagacgtatgacatgtaagagctttcttaaaatactacatatttggtagttgtgtagcaattacattgctttaagaaagttggctgttaacagtagcaatttgttacacttttaaattttgggaataccttacattgtttcattactacttgtgttacaattctatctccaagtgaacatttggtgaatttttttttttttgagtagatgtctaaaattgaagggaaaaaaaaacaaaaacagatctcttttggttagctaaatgtcagttgcttaatccaaaaagataaaaatgttttgctggactaatccctgtagtttcaaagcattttcatgtgtattattccatttgatcccactaaaactctataaggtggggtaggtaagtggtactttgttttatagatcaggaaattgctgtcaaagacttgaagggacatgcccaagataacacctgaaaattctgtaagtgcataaatgctgcttaatgattatctgacccattccctaatttacctttagtctctctattgtcaaaactcctctggataaaatgttctctgttgtttaaatgcaatgattttcccttctctttatggagaaatattgatgaaaacactaaatctctataaagaaaaaataaatcagtgaaattttgcagtaagatgggaaaagagaaagaaatgccaaagtgaaaattaacttcagaatacagtaagtcctcacttaatgtcatcagcaggttctttgaaactgcagctttaagcaaaatgacatataaccaaaccagttttacccttggctaattgttataaacaagggttaagtttctgcagcacattcatggtcacaaaaacatcaccaaacttctaaagatcaaagcatttctaatattaaacattgaagtacatatgagctatacttaacatttaagaaagattaattaaaaaaaaaacagataattatttacccagttattccagttcaaggttgctggttgccagagcctaccttggcagctcagggtgccaggtgtgaaccagctctggccagtacgccatcccagcgcggggtgcattcatacatacatattcattcattcattcagactaggaccatgtagacatgccaattcacctaacatgcacagctttgagatgtgggagaaaagctggtgtactcaaaacccatgcagacatgagacaacatgcaaactcagtacaggcagtggccccagcctggaatcaagttttttgtgtttttttttttatcgatgttataagtaaaggacattgaaaagaccttatttgaggatcttcggtggtttaatatttgatagcaataattagctaagatattgtagaggtgagcctaatacaatgtgttatctgatgtgaaaaacaaaaatatttatagcttaaaacagtaaactttacatactgtatatactactataactttctctcctgaacctaattaggaaaaaataagttattgtacagattttcagggtcttttaaacataatcttaggtgagaggagaaagctttctaaatagggtacagaacccagaacacatatggggaaaaattgaaaatttttatcaaatgaaaattagtataacccaaaacatgactaaaatcaaaagacaacaaatcaagaaaaaaaattacaaaacataggacggataaaaggcaagttttcttaatgtataaaaagctctttctaaaaccattaggatgaccactggtggctaatgtggcatgattgtagaatttttaaaaattaggagatgtctacctgtttgtcaatagaggattggtttaatgaaatgtgattcttcacttatggaatgtaactatgcagctgttaaaaattatcctagaaaagtgtctgtgatgagctactactaattgaaacaggcatgttgctaagtaatgtatacaatgtaatcctatttattagaaaaacaacgaactccctttctagatatccatatatgtgtgtgcatgtggatggataacattggtgaactaggattggcaggttggaggcgcaggaggaattgcaatggggtagggatacagtgttagatttttctctatcatctttacattatttcactcattacaatgagtatgcattacttgtgtaaatttttttaattataaagcataatagaagtgaaagagggagtaacactcaatatgtaaatgagacattcataaacaggtatacttctcagaaaaagaattccatttgctgccgagcgcagtggctcacgcctttgggaggccgaggcaggcagatcatgatgtcaggagatcgagaccatcctggccaacatggtgaaaccctgtttccactaaaatacaaaaaattagccaggcgtggtggtgcatgcctgtagtctcagctactcaggaggctgaggcaggggaattgcttgaacctgggagggggagattgcagtgagccgaaactgggccactgcactccagcctggcgacagagcaatactccatttaaaaaacaaaacaaaacaaaaaaaattcaatttgccattcaacactggaagcttatgattaaataaatgcaagttaaagcagcattaaggtgttacttttaacctaaaagattgaccaagttttaaaagtttgataaatgcccagttagtgagcaactagaccattctcatgcccattaagagggaatgtgtattaggacatactctttggaaggcaattgggtaatgtttattaaattttaaatacatactttatgacttggaattagacttgtaggattttatcctggagacctatccatgcatgtgcaacattgtttatcgtagcaaaacttgaagcaaaagaaaaatgttgaataagtaacctactgtacatccacagaatactgtgcagctgtaattaggcagagcaccaggatactttctgttttcagcaaacacagtatacaacaacatgtatggtatacttccattcatgtttactctgagaaatgacagtgggatctggagtatgtggcagattcatttctgttacataatcttttgtttcttttcaattttttaccatatgtatgttattgttatactttttaatgatttcagaaaagccattgcagaaaaaatgttcctcaaattgaacaaattgatctttataaataactaaaaaaggaaaattaaaatgcatgaatttggctttttccttgtaattgtgggtgatagttattatagcaaactctgaaaagagaacgcatgcttgtctttaccacacctgctcctacttcactcttccccgtcttaaatgctatcagtacttacccagctgctagagctagcaaactagaagtcatctttgatcctgtcttcccttatccccaaatccaattcttcctgacaactcttacctcccgaacatcgctccagttcctccacgtcagtccatctctactatcagcacccagaccaggccaccaacgatctgccttttgcctatacaatcatttgcttgcttgcctacactcctccttttatgtaacctattcttcccacagtatccagagtgaactttagaaatgtgaatcagactttatcatcccctgtttaaaagcctggaatgcttttccactgcacttagaataaattgaaacgcttgatctggcctagtgtccctgtgtaatctgcccctgcatcagctctccagaggccctggcactggagtcccctcactgactgtcagctacaccagccaagcttctgttttcacactttgcagactcatgcctaacttaggacacttgtaagagccactcccaggtcttcactggcaggttcattcgatcgtttctggtctcaccttgaagatctctgcttctacatgttcttcacaacaagccagtctaaagaagcttctcatcagactccatcacatcaacctgttttattttctattttgcacgtcacacattacaagacagttttgccatttttcacattggcattccacttaactgaaataagtaatcttaaattctaagaatatctgttttcccccttgggatccaagaaaacattttcattttgagtaaagagaaaaatagcccaaaaaatattgttattatacttaaattgacattcaaggaaaaagaaggaactcatcccaaccataagatatattttgtgccaagtgtagacccaatctataaattgtggaatcttcccactggctcattgctttatttctcaacagttcatttcacaccagatctatctggaaaagtctggtattagtctagtgtaaacagtctgaagttcagcctctctcctgctgtttcagattcatctatctcgtagagactcttcttatcacattaccagtctctaaccctaatgattccctagaagtgagagttttgggcctaattattacataaacttttctgtatcctttgccatttacctcatactgtatgcttgatgccatgtaaagcccagattccattagcagaacataaagaagaaaggtttttattttctttcttccttttccttaaagataaaatgagaatgattagtatctctaatttgttttttgttttttttttctttttatactttaagttttaaggtacatgtacacaacgtgcaggtttgttacatatgtatacatgtgccatgttggtgtgctgcacccattaactcgtcatttaacattaggtatatctcctaatgctatccttcccccttccccccaccccacaacaggccccagtgtgtgatgttccccttcctgtgtccatgtgttctcattgttcaattcccacctatgagtgtagtatctctaattttaaaatgctattctttttattttagcattttataatgctttctaaaaaatacagtttccaaaagttaacagttttcttgtgtcagcattcatttatctgagtatttccttaaaggcaaaataatgacggtaatttgtttcaaaatactgtagtgggccaagtgtggtagttcatgcctgtaatctcagcactttgggaggccaaggcaggcagatcacttgagctcacaagttggagaccagcctgggtaacatggtgaaaccccgtctataccaaaaatacaaaaaattagccagccgtggtggtatgcgcctcaggaggctgaggtgggaagagtgcttgagcccaggaagaagaggctgcagtgagctgagatcatgccactgcactccaacttgggtgacagagtgagaccctgtctaaaaaacacaaaacaaaaatacaaaataccatagtgatgtttttactttttgcattttacaatttaaaaacttattttataaactgcagttatttctgtcaacactgacatattttgaatatttcttctagaaaatatgtagttttactatcagccagttactttgttctttgaaacattttttaatgttagtatcattattaagaggctaccagaagttcagagcatgaaaaatagccccattttgattattcttactttataaaggtttttagggctgggcacagtggctcacacctggaatcccagcactttgggaggccgaggtgggcagatcacgaggtcaggagttcgagaccagcctggccaagatgttgaaaccccgtctctactaaaaatacaaaaattaagccaggtgctgtggtgcacgcctgtaatcccagctactcaggaggctgaggaaggagaattgcttgaacccaagaggcggaggttgcagtgagccaagatcgtgccactgcactccagcctggctgacagagcaagaatccatctaaaaaaaaaaatgtttttaggcatttcattacatttgcaatatatttatctaataatataatcttaatcactgaaaatgtataaacatgtaaattaaaggtaaacataaattgaaagtatcaatacatgaaaatattttaactcttgagtaataaaccttgttttctatttcatagaaaatataatggattaccgtgatatgttagaaatggatttgtcgctgccttattacaaatgcagcagttataaaatggcatctattatgtaactatctttttgagggagcgctggtggtagtaaaagaaacagaattgtttttctgcctttagatcggcatgagaagttgaaacacagaagatgtcgcaaggcagcaaagagctgattatatgcagattgtcctttaacgctgactatattttatataaaggtgtttctaaggaccaaaacagggtacacattgacttcgttgtagtagtttatgttctgttgaaaagattatctatctttattgctgagttttcctcattttttattctttattgtcctttttattcttttgtctttttctttaatctttatgtttttaaaattttagatgccaaagtgtttcataacacagcatccaacaacctccaaaccataagttgtaggcagaaggaaggaaaatgagaatgaagtagtttggtagctttattcttcagcatctgtttgagagtaatctctgaatctgtttgtttttatcacaagctatgcgcacatttttatttgtgcattacttctttcataaaaaaaaccaaaagtaagaaaagctaccattttaaattataagatggtttaattaactgtctggtttcttttggttgggtagatgcatttaatttgaagagaaatatctaaacttacctcatgcagcttaaaaattacaccctaattattgatcctgattacctagacatcatctgttttcctaaactcgcttcatattaattcatcatttgggaatttgaataccattttctcccggtgggttccttaatagcatccattttactgatcctgccttaaaacagttgattacccactctgaagtgtagtgataaagaatgtattaggcatcaaggaatgaatccgttccatttaatcctaagtagtttaatatccggaaaagacctacagtaaggatctgctgaaatgggtaataagatatcagtgtgtttcatataccagtcagatgaagttcagtttattttatagaagtttaattagaccctcttgatcttggctaagtaatgcccagaggaggaacagaaatggttttccaaaaactgtttttcctctactcagctgccagaacaaaatttaattgagttgcaattgagaccccaatcctccagcatttcagggtaggatatcttggtcatcaaaaataacctgagcatatttcctagggtgtttggtgtttggatggcacggtaacgggcatagagtaagcactcagtaaattatgcctgactgactggctcagtcttaagttgctgagtttggcaagatgcatccccgaagtgcttactttttaacctgttgaacagaatcacttaatattggcctttatgcctcagaatttctgccaaaaactaccattacttttggtataattgatagtaaactgttctttccaatagtaattgctctggtaattcagctgggccctgagactaatggtgccagacttgtagctttcatgggcaaggtaaaaattttcctaattattgagagattggccttaggttaccaatgtttttatttcatttaaaaagtataccaaaaaaaaaaaacctactattggccgggcacagtggctcacacctgtaatcccagcactttgggaggctgaggcgagcagatcatgaggttgggagatcgagaccatcctggctaacatggtgaaaccccgtctctgctaaaaatacaaaaaattagccaggcatggtggtgggcacctgtatcccagctactcaggaggctgaggcaggagaattgcttgaacctgggaggtggaggttgcagtgagccgtgatcgcaccactgcactccagcctgggtgacagagcgagactccatctcaaaaaaaaaaaaaaattcctactattatttcatttaaaaaaaaaagataagcttaacatcacaaaagtaggaaggacagagattcagaataaaagacaatcatttaaattgaataaaatttaagccttcataagaagttaccaccctgttgttattttcctcatttcaccttttcttgactcttagaagtcacttcagaccattgcaaatttgtgatggtaaatcatgggatcagcctggaagaggaagttttccttaaattggctataagaggggcatgtatgtggtgacactaaatatgggattagattatctagatgtaagtttagggtgggagccaatgacacaacctctttgtttttgcttttcggttttattaaattaagcatgtattgagcactgctgttttcttggcactgctgtagactttgggataaaacatgtgcgtgatgcacagatatctgttgctgatgatcttagaaactaggagaagcaagtaatactggccacactggctacagtaagagaccataggacagaatttggagagttactaaaagcctgaagtctgtactgatttcatgtgtcttaagccatagatgatccacagacccatagaatgaaagacagagatggaaaacatagccaaatttcactatggtgttagtgtcttaagtactgtcttgaaatgaaaatatgtgtttaactcttacagtgatgggacagttgtatctaaaatcaaagtaaggggaaattttaagagatgtttggcaaactaacttcatatattattattatttccgaagatggaatatactatgcttctattccaacttgaagcttattagaaaaatatcttgatataaatgattgtgtgtagatttctcctccccagttttaaaaagactcaatatgatgatttacaacaggtggatgtgcaatatcccaagggctatggaggctaccatatgaggtgggatatcattggcccacactggaaagagaaatagctctgtaagtagtggatgtttatgtctctaatacacattcccaagtccttcctcattatcagtttagataattaaactgacatcttccagctggcatctttgtagacatttttgtctgaacataagttagctttaaaaagaaatgattcataaacatgacaggaatgaaaaaaaaagaaactagacaccactgaattgtttatagtggcaaaaacataaaaataaattagcttcagtgtccagtgctgcagtgagtttaaataaatcggaatatatccttggaaaatttttttaaataatgtatctgtttagtcagatagtatgcactcaacagcaataatgatgtatgttgattggcatggaaaatgtttgtgaaaaatgcagtatatatttaaagcagcatgtaggactgatttttttttaagtggtgtatatgcatgcccatctaaatacaccaaactgctttttcatcagttctgctcgcctttttggtggtgttctctgaagctattgatagaatatcccaacttgcccagtaactggacagaaactgcactcgacttatctgcaatttgttgatagaagttagcaaggagatcttacccaaaagatagatgggaacgagaaatgtggcatctttgaacctctcaggagcaggttatttgtggaatcagagagtgcctctcgccatctttgtcttcataacccccgtcttcccgcacagcccaaggtagtcagatgtaagaacagcagtactgcgagtcaagagtaaactaaattgttacatcttcggtttcagctctgtctaaaacaactacccgtgatgagatggagcaagatatgactaattttaaacattattttggcccttagttaaaaagttgtgtggagatttaccctgctgctgtttgaaagcaggaagctggggtttatgggttaattcagtaaatagctgccctctattagccacctttccccagagagatagtcattgggaaatagtcctccacagtcagtttctgcaagctgcaatagaatcgtggctagtcttagaatgccagtcccctggaattgttattccaggtcttagtgaggtcctaagagtgtaaatttgaaagatcagcactgtgcaaaccttttcaggaaggacgcgtttgtaagtgaagctcaaattgctttatctaaaaatcaattcactttgagaatacagctaaatgacgcaatcgttgatgaaatttctgattattctttcccaatctgtgctaaaatccaaaaggaataatgttggattatctgctcttttgaattaaatatccctgtttgccattctgtttgcatacatgactgaacctttgcaataattgtatgggatgtgagggagtatttttcttccaaaaattgataactgtataaccccaaggagtcagctatattctggactatgaacttgaatgaagtttgtttacagctcagaaattattcaaaccagaattctcaagaaaattatttttggttcatttcccattttgcataaaatagcaagcagtgaggaagaataaatcgaaagtcatagctaatcaagactttataactatttaatgctttgtttatatattcatctggcaatttttagaattgcttcagttctataaattatctggtacatttgatgataataggtagccaaatatatttgttaatgatccaaattgtatcgggacagtcactgtaacctatacctttttttttttttttttttgagacggggtcttactctatcaccctggctagagtgcagtggcaatcagctcactgcaacctccacctcccaggctcaagtgatcctcctgcctccacttcccaggtagctgggactacaggtgcacaccaccatgcccagctaatttttgtattttttgtagagatggggtctcaccatgttgcccaggctggtctcgaactcctgaacccaagtgggctggctgcctcagcttccgaaagtgctgggattactggaatgatgcatcacacacagcaacctgtaccttgagttaccttaatttaagattattttgaaagaatacaccatcaatccagagcaatcctccaactagttgaatcattacgggctctaggaaaagagttagcatctctcccataggattcagatatgaatagactagcaccattagtactgtggttccttcctccagccctattaaccattcccagaagacaggaggaaaagcacataaagcccattgctatcagagctctgaggtctgtaaataattatgccttcttgtttttgagtaaagtaggatgaaatgtattaccacagttaataaactacattcaaattatagcctccaaagcaacaaaagcattccacactttcaaaagatcatagtgactcaattcctttaaagagatgtttctaattatagttgccaaaatctattattttagttgtgatatatttctttttaaatatttattacctttatagaatactgaaaatttaaaaattgaaacatatacattaagtaatactccaatttaaaatggaagaagtaggaattggaagaaacagaaataaataattagagtgatgtagaagttggaagttctgctgcagaatcctttgaaccaaacacttggcagctccccagaccacatttattgcctttttgtgtatatatttccactggccaacttgtcgtcttggcttgaaatgtagtcattgtaacaagattggtaatatttaaatatcttttcctttcatgcctgtcttatggaactaatggtttctgaacacaaattattattttatctttaaaatatttttctaaatattattagtttttataaaatagaccagataacaccatagctgtctttaaaatactgtcataatggaactgaagttagagacattttaaatctcccactgccatagataaaattcgtttttggcccagcctcacctttggtaaccgggaatgcccgagacactgtgaccccctctccaccagaccaagggagctgaactcttactctggcctcatttccctttgtcaccaacccccccatttgagtgtcaaatgcccatgtccatacatcattctaaacattaaagccttataaacacatagattcctcagtagatttatagaatttaaaagacaaaaatgactttagaaatcattcagttcatctccctcaatctgtgagtgaccaaagcttacatgcttgctatgcaagacaggaggcagccatttctctgagacacacagacacatttcagctgtggcggcatgtggtagatagatgtgtgccccatgtcctcatctaatgtctatagttgtgccatctctaatttcttgaaccccttccctgacttataaagagccagtagaaccgttgatctcataagtaatctaactgaaatacattaattctgcagactgaatgaatggtaaccaaagatgtcctttcatatgaacatactttatattctaaatccagttttctttctattagtataacatttcctctgctagtgattttaatgttcttgcttccgtggttgggggttgggggggtggtgacagaaaagagtaccattttccttctgatatgaatgtgtacaaagaggaaggaaggataaatttaaccctttttaaattaaatgttaagaaatgtttctaaacgtattgaatgcttttccagtatatctctggatttttctcgattcaccacattaatggcagagaacaaatacatggatacaaagtaatttgaggtttcatttagtacatatatattgcttaactttctcatctgagtgtgctaccacatgctctaatccccaaacttaaccagtccctgaagatctggaaggcgggctgggcttcctcaacactgtgttctctttcttttccaggataaagtcatcatctcctcttaccctgatattgccttatgtcgcagctttgtttttaatatttctccagaccacagaaatttgtagttttgctaaataggcttattgacgttagtcagtgatggagtgattggaataaaacagtgatatgtcatgacaactagttaatgaccaattaccatgtgcatttgccatatgttagtaaactttgaaagtagctattcatcctatttggatgattggaaattcttttttataagccaactatgaaaataaaacctgactcacattcccagagcctaataaatttagggcattttgtaaaataaatgaatatatcattttcagatctctgtgtcttatttctctttactttttcttagatgtactgtatatcagtgttttggaggaaactctaggttttgctgtagaaaggagcaggaagtgagagtgaggcgagcccaggactgcaagcgccagtaatcctcatggtttctctcttcctcagcagcctggcagcagacgccaggacaggactgaaagggtttacccagagctgtgactgatacatggcaaaaaacaaagtgggggtggacaccaagagcattttgatggggtctaccttagaaagagaggaaagcaagaattccacaagccattaagacctggctccaacctgtccttccagccttctctcccaccaaccttcctttcctccattctgcagtgtaacagctgcctctggttcctggccagcccctctgctcgtgtgttctcccttgcccagattctcatcattttttcctcaccaactcgtacttgcccttcaagaatcaactcaggagtctcttccttgaagaagtcttctgtgatccatccccactacgctggattgtgtgtcccagctttagatgctcagagaactcttcacacatttatctcggcattcatcatgtgtgattggaactatttatgcttagttcttgttctgtcattgcactattaggtctttgagaaaaagtgattgattatcataaccatgcttgtaacccaatgccatgtatagtcctagcaaatagtaggcatgcactaaatgtgcatctaaactaaaagtgtaggattttagctatcagaaagggaatttattaggagaataacgaactttattcttttgaattaccacatctttcttgaagtgttaagtggctcttcagaaataaactgtacccaagagtactgccatgtctcaggagtcactttatgtgtatttgtatgtatgtatgtttataacttttttaaaaggcctagttttttaaaaaagcatttctccaagaaaggccatgaagcagtaatttctgaagctcatggctttcacctttccagatttttataacataattttgttgagattcttgatcataggttatatagagtacagaatgagttagcaccttaggtaatatgcttagaaaaagataaaatagtgtgaagatacacgtaagaaaggaagtctggtaaatgcaggaagatttggagagggatgaagtgagtgtataattagtgaatctttgaaatttatcttctatccacataaaattttgtatataatgtgaatgtccaaaattccttggtctcttaggctgaaattaaaatgttgaagagctttatgtggcatttgggcatggtgggagtgttttggtcagattttcttttatattctatgtggaatggttatgcatctatatagcacctgtattttccaaaagatttgtgtgttcaccaacagcaagtactcagcagcttttttctaaattaagtcaacagtaattttcaatttggagataggagacaaaccctaaaactggtagccaaagaagacagtgcttggttttataatatctagagtggactattagctaggatgcctttttttaaaagctgtctatttcatgtctgctatttagatagtgaaaaacggagttaatctgacccataactcttcgacgtcatctcttctttagtggtattggaaggaactggccctgggcctctggaggcagcagtattctggcagaatttggaaccctgcatttggagtttatgcacttgagccacttatcaggaaaccccatctttgctgaaaaggtgagattcttcaatgtgccttggcctgcaaagcaacacttatgagaaacagtattgtctctgagaaggtttaggaatttttgaagtggaaataataaccaaatttgttatagctctttctgaagttttgcaacatgcagcatttcatttagccaaactgtaaacctacagcctttccagtgcaccactctagttcaggatgtgagggcacagcttccacctctggttccctttaccttaagttagttacttaactcatctgaagtttgtttccttatctaaaaatatttagtaataaatgcactgcatgagccaactatgtgaaagacagactgaaagtgtcgtacaaatgtgatgttgcagctgaattggtccctcgttttccgaaagcaaaccaaatatttggataaattcatgttccccccatcactctacttttattttcaacctgctttttggcttccctttacagtaaaattgcttgaaagagtcgtccctgttgtctacttttcaagtctcttgaacctgctccagtaggacttttcccccagccacacctgtcacagtgaccagtgagcacaacagtgccaaagccacttaccattctccccttcatcttccttgccctcttagcattcgacacagtcagttcttcgttcctgagatacacttcgcgcttggcatgtaatactctcccagtttgtctcctcttttgctggatgctccttctgtcttttttgtgtcctcctcaacaccccaccctctaaatattggaaagccctagcactcaatcctgtgcctctgcttgttgatattcactccctacattgttgcatctagtctctgggctttacataccatctctatactctagactccaagtttattatttcagtcccaacctgtcccctgaactccagactctatatctgtttattaaacatctccactaagaggcccgatagacaagtcccacttaaaatgcctcggacttaacgcctagacgtgcttctccagtctttgctatcttggtaaatgacatctcactgtacccagtggtctcctcctggttcttcttcttggtaaaccccaggcccagtccactaagaaatcctttgggtgtctcactgcctctactgctgtcctgatctgggatccatcaggtcacctggtgtactgtatgtacaccatacagtagccacctgaccaccccttcctcaccccctcagccttctcatgacactcagagtaaaatatgcccttattgtggcctgtggggcctgggtgacctgggccctggctctcctctcctctacctgctgacattctcccctttgtctcctcacctctggcctcagtagcattgcaaacctgctgtctcctcagggcctttgtacttgctcctctctctgttccgagtgctcttcctccacatttccacgtggcctactccctcacttctttaatattctgctcaaacacctccgccttgccaggccactctgactaacatgggatagcctctccacatcaccctgtcccgttaactctcaatcagctcgggttaccataacaaaaatgcagccagaaacaaccgaaatttatttcttacagttctggaggctgggaaatccaagatcaaactgcccatgaggtaggttttattctgagcctcttccctgggcttgtagatgacgagaactgtcccagtgtgtgttcacatgatgtcttctttgtgctctgagggagagaaggagtcacagagagagagagagagctcttgtgtctctcatgagggcactaatcccatttaaggctctaccgtcataacctaattaccatctccaaataaatctccaaatacaatcacactgggaagtagggtttcagcatatgaaattaggggtatgcagttcaatccatagcacccttttatttttttccacagtatttatcatctcctgacatactatacagttaggtgttacttaacagtgtttattcaacagtggaccacatatgtgacagtggtcctgtaagtttataatggagttgacaaaattcctacggccttgtgacatcatagttgtcataatgtcgtagtgcaatgcgttacttacatgtttgtggtggtgatggcataaacatactctactcccagtcacataaaagtatagcacatataattatgtacagtacataatatttgataattaaatgactgcattactgatttatgtactactatggtttttattgttattttagaatgtaccactttttttttaagttagctctagaagcaaggtccttcaagaggtattcctcttcaaggcattatcatcacaggagttgacagctccatgcgtgctactgcccctgaaagaccttccagtgcgataagatgtagaagtggaagacagtgatattgatggtcctgtggagtcctaagctaatgtgtatatgtgtcttagtttttaacaaaaagtttaaaaagttaaacaactttaaaaagaaattttaaatagaaaaaacttataagaatataaagaaagaaaatattttggtacaactatacaaagtgtgttttaagctaatggttattacaaaagagtcaaaatttttttaattaaaaagtttataaagtaaaattacagtaaactaacgttaatttattattgaaagaaaaatacttttataaatgtattaataatggctaagtgtaccatgtttataaagtttacagtactatacagtaacgtcccaggccttcacattcacttattactcacttactaactcatccactgcaacttccagtcctgcgagtttcattcatgataaatgccctatacaaagtgccctgtatttatgtatagggttataaaatgtataaccctatagaaaggtatcatttttcatcttttatagtgtatttttctgtgtttagatacacaaatacttcagtacagtaacatatgctacacaggtttgtaacctagaaacagtaggctgtgccaactacatttgtgacagtgtgctctatgatgtttgtacaagaattaaattgcctgtgtttcccagcatgtatccctgtcattaagggacacatgactagacttattgatttattgtctgtcccgtcccactaggatgcacaattctaagagtgtggtgactttgtttatccactggccccttgttcctagtatggcatctggctaatggtagataactaatcagtgtgactatattcacttactgccattatgtttgtaataataagctaacagcagttatctttgttctaactctgcatcatttaagtcaacttgtatgttcaagaagaagaagaatggcatgaaaattgttttttagattttcacggtaacattttattttctattataggtaatgaatattcgaacagtactgaacaaactggaaaaaccacaaggcctttatcctaactatctgaatcccagtagtggacagtggggtcaacgtaagtcagaagatttgcattattatagctctttttggtactgtactcgtggagagagaggaagcacaaaagcagcacagattttgttgagaaatgtttagaaaaggagaaaagggcatggctcctttaataaacaggcttctgtcatcagattgtgttattaggacactggattgtgtatttttcatatataactccaagtgtgatgacatataagcacatttacagctattaatcagaaagggaagatctggccagagtagtgtggggatgttaatctgtaacaagctggtcatgtggatagaaaggaaattcattcctttgtactaatgactatgagggttttatagagagtaggtagaccattctgcttcctaacattctgtttctgcatggctatataatgagagaggagcctgaatttttaagagttgggaaattggaagagcaaacagcctgtttttctcttcttaattttaagctgccagatataaaggtttcttgccagtagaattacctttaggatgggagaaagtattgcacaagaacttttgatcctagaagcctgcacttaagactcttcagacgattttgagcaggggcataaagattcagagtagttgaaagaaatgttctcaagctgatttggaaaaacagtagtagattaaatagctgaaaacaagtgaagaatattgagatacccaactgtagcaagagtacactgccttaagattttactctaatttgggttttttctttatattttaatatcatgttcttagatacctcattattactttagaagtacttttcttaaagaatagtttaataggaaagtatatgccaaaatccatatgctaaaatatgtctgtagctctggaaggcctagctgttgaaaccttaggactataatcaaggttaccacttacctaagtgtggtcaacagatcactggaagtccttgagacctctgaggaggcccacaaggtcaaaaatatttttattataatactagtataatgatatataataacaagacatataatacatgtcttagtcatatttactaagccagtacacagtatcttgcacttagtggatgtttacttacttaaattttgtgaatacatatgtgctctgtatctcatctctctttctgcctctgcttttaatagtggtactttgaaagactttctgccttttctaatgtgttgatatttacacctacagtgttaggtgatactgctgaagcctcactgagaacaaaggcgaacaaacaccaaatagtactaatattcatattttttcttttttttttcttttttgtgggacagggtcccactgtgtcacccaggctggagtacagtgtcataatctcagctcattgcaacctctgcctcctgggctcaagctgggctcaagctatcttcccacctcggccccccgccccgagtagctgggactacaggtgcacgatgccatgctcagccaatttttaattttttttttttttggtagagagaaggtctcatatttcccaggctggcctcaaacttttaggcttgagcgatccctttgccttggcctcccaaagtgttgggattacaggcatgagccaccacaccagcccccattgtattcttaatagcattttaaaaaaggatactggtttcacttatgaatgtgcttactgaaacagtaaaaaaaaaaaattagtgattctaataaataccaacctgtgagtacacacctttgtcatgttctgtgaggtgaaatggaaaatactcataaatcactcctgctgaattatgaaaaatgatagttgcatcaaggaaaagctcttgggtgttttgagttgcaagctgagctagccacttactgtttcacagattcaacatttttacttgaaagaacaatttaaaaaatgattatttaggctaggtagtcaggagccatgttcttgaaaatgagcttgtcacttcaagaaaaagtcacagtatttgtgccaatgattataatccaagtttctaaataaaaaatagaattttggaaaacttgtacatgctaccatgagcttgacacaaatacttttcctgttagattgatgatgatattaacaaatgtggttttctgatattgtataatggaatgggtcaatatttgaaagatctgcatagttcagtgagccaggattttccaaatgaccaaagcatgatattataagatcatatatggaaaacaatctgtgtaaagtacaagatagaccagtggcttttaatgtaacaatacgaaaattcattgatgtaatttctaattttacaatgcaattaacctttaaaaaagaaaccacttgttgactattgttgtaatatcaaagaaaaatatccacaattgtgtgaaaagcctgttaaaatatcctttctttttctgactgtattactgtgtgaggctgacttgtcttgatgtattacagccaaaacaacatatagcaaaggattgaaagtagggcagacatgagtatccagctgtctcctgtcaaggcaaacaagaaagagatatgcaaaaatgtgaaattgtgtcagtcttctcactaattttttgttttgttttgtaaaatataacttttttgaaaaattgtatatgttaacataatgggcatgtaattattattttaaacgaggtaacgaaaatatttttaaattattttaattttccaatgtagtaaatataggtattatttacataaattatttggggtgtccatttcttttgaagattacaaaagggtgctgagactcaacagtttgagggccaccagaggactagggataaaacaacttgtgtatatttctgttttgttgtttgagatgggagtctcgctctgtcacccaggctggagtgcagtggcacagcctcagctcactgcaacctccctgtcccatgctcaagcaattctcctgcctcagcctcccgagtagctgggactacaggcatgtaccaccacacccagctaatttttgtatttttagtagagatgggggtttcaccatgttgtccaggctggtctcgaactcctgacctcaggtgatccgcccaccttggcctcccaaagtgctggaattacaggcgtgagccacgctcctggcccttgtatatttttctaagtataaggtgacaggatgtgattctctaaaagcacaagcatttttggagtattcctcaccacacatttcaaaagctgaagaaaagtctccttcatttactgtttccttcctatgatttaggatttagaagctgctatgaagggggacagaaggagccagttgtactggaacatctccgcttcaccttctgggtcacctgtatgctatgtatttggccatgtttcctagtacaaagagccctttatatttagattccttatgggccaatttcctgatggaaaaaaaaaacaaaaaacaaaacaggattgatgagtcttagctctctctcctgccccaacccccattctgtgttctagccagaggaaaacacacttatttttttattcttcaatcgaggcctgcttggccatgttcaggtctttgcttgtgccatttccttagccctcccacctctcaagacccagctcaattgccatttcttccaggatcccctcttcagtgctccggttgggatttattagcatccacttttcctctattctttccctgccccagcgctttgagtgctttcctatcacaaaccttttcctgatgattcacatccatatgcatcttcctaaggatccaaagcttttgcgggtagtaaccatgtcttagtcatatttactaagccagtacacagtgtcttgcacctagtaggtgtttacttacttgaattttgtgaatacatatgtgctctgtatctgatctatctttttgccccttacctttttttttttttcttttttggagacggagtcttactttgtcgcccagggtagtgtgcagtggtgcagtctcagctccctccacctgccaggttcaagcgattctcctgcatcagcctcccaagtagctgggattacaggtgcccgcccctacaccagggtaacttttgtatctttagtagagatgagttttcaccatgttggccaggctgatctcaaactcctgacctcaggtgatccgccctccccggcctcccaatgttctgggattacaggtgtgaaacaccacgctggacctgcctctgcttttaatggttgttctgcttgttctcttttagcagttgcccctgctcctcagttgtggctgaaaggcagtatccggtcctggtcactgataatatgaactgatcttgttactattgaggccagatggcagggtttcctgtctgtacacagagtatttatcatcccttgatttctataacagccatccatctatctatatctagtctagctagctatgtgtagtgtcactagcatcattgggggattgtttcaaagagagaaattcagatgaagtcaacaaaaattttaaaagggagatattgagtattttaattcttctttgtcttgattcttttgctacttgctttttctcttttttagatattagaaatccttttatgggacctattcttatgaagaaaagaataaattactccttcagagaagagcgtaatatttgactgactacagtacacctcacctttagagcagttggacataaaaataccatattatgttatttccagaagtaggttgatcctttcctgctgataaattcgggcctgctctccccgacatccactaagatgtttacacaggactgtgttgacaaacagccatccaggcctgaaggaagcttagtgagtgacatgctaaattaatgagaagacctgtttctcttctacgttcctttgtcttgtttttttttttttaatgtgaaatttttataggcaggaaattttaaaaatagaaaactagcacttaccaaaattaattaaaacaaatgtattcttatataacacttttttcttttttaaaaaaaatccccagctgctcaaacttgcttcttccgtctattagaaaatcataacccaaggggaggaaaacatcaagctgcttctggccattggttttcagctctcattgctttaactccaaatgacacgtctggatcctggccatcatttcctatcacttcatcgagtcagtgttgttttgacaatgccaaaccatgatttgcttttccacgcatcacttgcatgtgtctcctacaatcatgttgataacaacagggcttattattgatgagttcgtacttagtctatttagtttgtaaatgtcagaggtttctgtgttgatttaggaaactgtaaaggtcacttcaagaatcagacttagaatttttaaaatatatttttacactaaaatttaaactataattctacactttctgcaaaaagaaaatcacatacttaactactttaaaacatggctctttagcttgagtagttacagccctttattaaggttgacatagaagaattttgctttgttcgtcagttatttgttgagtacctaccatgtgcaagacactttccaggggctggggtggactgggaaacataataggtctggtctctgccctcttggttcataatcttgtggaggagacagaagaaaatgttaccacattatgaaattacaggtgataagtgtgtgctaccaaaaagtgtgtgacaaaggaacctagtggcattgtcagagaacactcctttgaggaagtgtcatttggtcccagatacgaagtatgagtaagaactactaaagaaggggaagggggtcctagggtccatttcaggcagagagaacaaggcctatagaagccctgcctgagatgagatggaacctgatgtttttgaggagccaaaagaagggctttatagcaagtgagcagagagcaagtggagcaagactgaatggcatagagaagattgagatcttgcatggcaccaaacacacaggattgaaaggcttcgagtaaagggtgatctcattcatgtattaagagggctattctggcattaatgtggggaatagattgaaggggcactgtcattagaactctgggccaggcgcagtgcctcatgtctgtaatcccagcacttttgggaggctgaggcaggcagatcatcaggtcaggagttcaaaaccagcctggccaacatggtgaaaccccgtctctactaaaaatacaaaaattagccaggtgtggtggtgggctcctgtaatcccagctactcgggaggctgaggcaggagaatagcttgaacctgggaggcggaggttgccatgagccgagatcgcaccattgcactccagcctggtgacagagcaagactccgtctcaaaaaaaaaaaagaaaaaaaatgaagatacctatcctacagttgtgagattgttgataatacgtgtagtggatctggcatgataaatggcagtgaaggtggactataggaatggagtattaggaggaaaaacttcttcttctgccccatatcctttctgactgcccctgtcccataggtatttgacccttcagattcatagcactagaaaatttatcaaataataataggctgagcacagtggttcatgcctgtaatccctcttctgtgagaggcccaggtgggaggattgcttgaggccaggagttgtatatcagctgaggcaacatagcaagatgccgtctctacaaaaaatttaaaaatgagcctggcgtggtgatgcgtgcctgtagtcccagccacttgggaggctgaagcaggaggatcacttgagctcgggagttcgaggttatagtgagctatcatcgtgcctctgcactccagcctgggtgacagagtgagtttagaaataataataatggcaagaacctgaggagcttcttgttttatttattacaaaccaccttctaaaaaagatttgctaatactcatagctttgccagaattttatattattcagaactaaagcaaataaaaatgtatttaaatatatactgtgaacattttagttgggtgtttttcactagagaaccagatttttagaattaggggtaattacatatcttttatcttccatgtttacaaaactactctggtaattatttagagtatgttacattagttaatagcccatctgctcatttcagaatatctttctgaaaataagagatttgttggaatttaaatgtaacagtgacttgcagttgacatagggttgcatcctagttgctaatgtgattttgctgcattatctgaattaaaagctgaatcactctaaaattcatttccctctctttccagatcatgtatcagttggaggacttggagacagcttctatgagtatttgctgaaggcctggttaatgtctgacaagacagatctggaagctaagaagatgtattttgatgctgttcaggtaacccaatatttaaatcatctttgccactcagccctaacttataatttgtatattaatcaagttttaatgaataagtggtatactacatgagtgagttacaaagtatttccaattaggtagagttcgatatctgctaatatcatcgtaataatggtaatcatatttgatgtttatttctaatagggccgttaaagtttttgcatggtttaaacctcagttaagagtcacatatctgaaaaagtagtattctttgataaatatgaattctctccttaggaccacaatttaaattatgcagggggaaatcctgaatttgtattctgacaattgcctaagttaaaattgcctgagaagacagacagtcccaatggctacctccatgtgaagtaaacttgtccccagagataaatggacagtactctaaggaaatccacacataaaaatctgaacaaactcatatttcagggaagatcattaatagtatcaaagattctttacagtggagaagtaagaggcaacagttgagtgttgaattgcctaccatgtgctaagctgtgtgttaggtagctcctttaaatgaagcggtggagttgggtttttttctctctcacagtacttgagattattacccagttttacagataaagttgctgtacctcagagagattacatgtcgaaccaaaattaagattaaagtttgtctatatcagcacctgttccttttaactcatccactgtggatttatttgtaagaatttccattctacacttaaatcttcatttactaatttgcaagcagtaagttagtaaggtaagttagaaactacttaaagtctctaggaggaggctagtataaaagtaaactaagaaacacctccagttaagcctcaatcaaaaccgaaaataaagttagaaagtaaataaagttagaaagaaaattactttatctaaaatatttgtactcttcaggaacaaaattttttagtggaatcaggtgcttttgcgattaagtattttatgtggtaatacatatattcttttaatattattatcaaggcttctcaagtagtgttgtaaaatagtggctcagtcctcagaaaaattttatttttcttgacagcttagaaattttttaataaagtgttaattcataggaaaaaaatggaaatttgtaatcccaaagatgtagccattataaaattggtctttctaacaagaggtctgggttattttgacataggcgtacttttttatttaaatataaatgcagcttgctttgttctggttaactacactgagtatgacattggtttcctttacaagtcttcactacttcacatgtaggaaccagaagcgccttagtgagaacgttggcctacatttggcacagcctttataaaggcacatgattaacatcaaaagcaaactaggatatgatccacatggcctcttttaggtttatttttcctcattgctgtgaggtttcagattttaacctggggagttctccatattttatagtttccattctgtcatcctctaattaccatactggcagacattttaattattctaatcttaaattggccgtctaagatcttgatgttcaaaaaaagacagctttaaaatattatttgaaatattttcttcctaattcctaaaaccatacccacacaacttttagtatattgtattcagacaaatcattgacaggaaaatccattaagaacaaatgaagtcaaagtgtttcctgcttctcttagtagtaaaagctaattttcaatccactgtatattttcaacttagaaagcaaagctagaacaactaaatttctgttttgagaagtagcattgtcttatacagcaaagtttatttctgctaagttgtactttagaagattattgtaaccaaggggaggatgctgtacactattgttctggacaattgattactgaagatatggctactctgttgtagcttcaagtagattttgggaagcatttaatcccagagtgatatgttttatttgattattttaataacaaaatattttgagctttcaactggctatcatggccctatctggagactacactaggaactcacaatggcaaatgatacctgggcagaagacatatcagacacttacgattctgaaggcttcatcaaaccagttttttaaatcaattatacaaggattaaatcacaaaatatatagtactcttttttctaatcaattatctgtatccttgacacagttttttcagatctactaaagactatccttctttgtatttatttatatttcccatggccacacaaaattattgctttgaaggtcttggaatttcattgtagtttttattaggaggtagcaacttggtccgaatcatgccagaaatactttatttaggatccataacagggtaataatgtttctctaattcatcctcaaaagctactactcttgccatgtagaaagaataatttcttaggtgatgaacaagtatctgcttgaaggactttattgcaatttgtgttatgagaagtataaatagctaagatgttcagtcgcataaaataagaatgaaatattaatgtaataactaaaccatcaataacattagcttaaccacggttaatgagcacagtaatatgttcatttatttcttaccatcttggtttcattcgtttatttctaataaaggtaggaaaggttttagcttcctgtgtgttcattttcattcattcttctctatcacaagtttttttctgtgtctattattcccaaatgtgcttcctaacaaatccctctctcttgatagcagtgtacaggtatagacacagtcatgtcctttttccttccatgaagtaattgtggggcagtggggagaacattttctgttagagtaattggagattagcaatgccaaacacactttatttttgctttttaaaatataaggcatattttacttacctgtctagtttaagagaatatcaacagacctgggatagaaataaaagatgttttataaatcatttttgtaaacattatcatttctcccaaatttaaagatttttctgatttttaaaatatatacatttattcattatataatagtgtgctttttaatagaagtattagagaggaacttgattcaagcgtcaccactttggagatgtaaatgataattataaatgactcttatcaagtgccacttgcattagtgactgctttataaacaaaatgtggcagagtcgtatcaggagatcctgttgttcccatttatggattaggatgctgagatttagagatatagtaagcaaattgttcactcccacaaattagagatagtgtcagagctggaatttgaagccaagtcttctggccccagaacacctcctctttgccactctattttgttatccctccaagcctacagaagtgaaaggaagagttctgccaccatcctggatctcatgcacaaatatgctgtgttcttcatccaccttagggcctgggctgtgttatttcaccacttatggaaatgaaaatgtaccaaaccaactattactgctgcacagtggcctgtctttgggaaggagaaagttttttgaatatgaggaatacaatgtttggtcacagaaccaagcaaaaccaaatgtgctggcgcagcagtgttaattctgactaatcaaacaaataaggcataaactagaggaggaatacagaaagcaatagcatgtaatttcaggttgaatggatttttaacaccaaactctgattgtcaggtgtattctattcttttttttttaatgttgggcatatttttagtataaatttgagaagagattacaaaatgttaaaaaataagtgtttttcacaggctatcgagactcatttgatccgcaagtctagcagcggactaacttatatcgcagagtggaaagggggcctcctggagcacaagatgggccacctgacctgcttcgcggggggcatgttcgcactcggggctgatgcagctcccgaaggcatggcccaacactaccttgaactcggggctgaaattgcccgtacttgtcatgaatcatataatcgaacatgtgagtacatgttattcttcatttatggtctattcccacatgctttgatttaatgcagttttgtcattgctgccctcaaaagactatccgctctgcctatgaagcttgatgatcgtgattaatgtctcaaaggaatgtatattttattttaaaaggcaatgcttttcttcctaaaaatatctacctttagtttaccaagaaacaaaaatccaggccataaagagttaaagccagcctaatttactgacttctgcttttgccaataacattgggcaagggtctctatctccctgcaaagagaaacttagcattttattaaccattattaatcttctccacatcccccatgaaacagatcatgaatcccactcccttcttataaaataggaatttgaaacacaaagtgtaaataactggccttctgttacgaaattacttaggattgtcaaccactaagtttctggctaactcaaatggtatttcatggtgccttgtatctgcctggtgggtgctcagtaaatgggggttaaatgaaaaaaataaattgttaatattttctaaaatggactcttttcaatgactaaattgtttaagtatatgaatattatatattacatgatgtttataactcgtttttaaaatgactactttgacatttctcttcagtgttgttaaagtacagtcagaccttcgtatccctgggttccacaactgcagatcagaaatgttcccaaaaaatggatggttctgtctgtagtgaacatttatagagtttttgttcttatctttattccctaaacaatacagtataacacctagttacataacatttacactgtattaagtagtataagtaaacaaggtgatttaaagtatatgggaggatgtacccaggttgtatgcgaatactttgccattttatataagggactcaaggatccatggattttgttatcctcggagggtcctggaaccagtccctcatagatactgagggatgactgtactttctagtttcatttaagttattgactgtaagcactgtccaggaaaataacccttattcattcattccatgtcctttagttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggtgatgttttaatttgcatgtttcttatagataaatttcatagtaaaaaatgttcagtgatacccataaatcaggcttatcaacttttctataatttttaatgcttcgaccaggattttttccacccaggactgtgtattttcattgaagtcattttatatccctggcttcagctttgctttgtataacattgatatagatatatctactgatagacttagatattgaaggagataactagaaaggcatagtctaaaattaagttcccattaatacaaaaatgatgatctcttaattccacctaagggttgttggcagcttggggtattcacctctatttcaataaaccacttcatgtttttttctgtctttgggctttaaaatgctagtatatgcttttacttagagtaaatagctacttagatctaacttttagaaagcacttatagaagaattactttgtataaggatattcctttaccagtctcaggtttcttggaatatctataagctttccatctgcccagtgtgttgttttgtctgtcacctcttgggtctcttcctgctgaggatagtatacctccttcctaaaccaatctagtgaatgctttgtgtgccgaatgcctgaggaggcaacctgcaggatatgcatctaacaatgtctgtctaattgtaagagttattattcctcaaggagtgggagggaattcaggggataagaacaagcaaattctttaattacactctcattctctagcactctttgttagaaagttagctatctttaaaaactgtccatgaggaatgacttctctcaggaaatctaaaatgaatattgcctttggtaaaatttaactaatatcttaggaagccatcggtgaatcttgcttattatcctcttcatttaatatgtgtcttatcattaatcatcagtcattttaaataacagcaattctctaggcctctttgagggggcagttttattacatttaatcagtagtcattgtaatttctttacatttctgtttttttcctctggagaaaatgttaaagttgaagcttttctaaactttggtgatagggaattgttttggtcttcaattggccagcaaatgaattgaatattttaagttgaaaatatcaggaatggtgtgttccatcaaatctaaaacaccataattagtaagaagcatcattattttatataccactaagaaaaataacactaccaattaagttatgacatccattttatagatgttagaatgtacaaaatgtatggccgagaaggtatcaaaaatgggaagtaagcaaattcgtattgccaggtagacaggatgctttggtttgctgtgttcttcagggggttgcttgtttatgagatcataaggttggtttatgtgttatgatttttatttcttgtcaactctttaacataatatatgacctgaaatcgtttccctgtgtcacaacactgaggtctcaattttggggatgcccccagtaacctctgctagaacctgagctatagtggtgagccaggagtgctgtagggtcttgcattttttaaaccagaaaaactgggacttcgaaggcatggccgcacgtttttcccctggtgttatgcccacccccgtggcctcctgtgtttcagcagcagccccgcatatgcttgcagctcccacctccagcacttggctgttctgatgcatacttgagaccacagctggaaaccatgtcaggaaaagaaggtggaagagcttttccctagccagctggctgtggtctgggaagtgctggggagttaatggctgtcaaccaaggaggttttggagttggtggataactgtcccagtcttctttccttcaagaatcattctggaatgcatgctacatggttcttcagagggtttctagcaggagtgagcctcgttgcacacagttgaacaatatgattcattggctcttctgtccctgttttgcttttcccacttgcccacttcctgatgtcacctccctgatagacttcctgcatcctgcgtccaacccttgtctcatgctttatttttaagggaacgcaaactgaaacatagggggtcttaaaaatcacctcatccagctttccgcttaaagacaagactcccctccatatctttgcaagatagctgttcctcatcaacccaaggactttccagcaaaggggaatgtatcacctaataaagtaactcattccaattggtaatattgaaggtgttagaaagttatttattttgaagccacaatttacagtgttctgtgctctgggggtaccagagggaaaaaatctcccttctgcatttcagctcctcaattatccgaagacagcaggttctgccatctcttcctttcctcatccatcatttcccttgattttcttctcctgacctggtttccagctgtggtcttttagggctgaatagtgtgaacctctcttctctcttcgcagtgtgattttttcacagcttatggtccaacttgttcttttagtagatttatatttaaaaaaaaaaaaaaaaaaaaactgggaggccaaagtgggtggatcatgatcatggtcaggagatcgagaccatcctggctaacacggtgaaaccccgtctctactaaaagtacaaaaaaaaattaaccaggcgtggtggcgggcgcctgtagtcccagctactcaggaggctgaggcaggagaatggcatgaacccaggaggcggagcttgcaatgagccgagatcacgccactgcactcgaacctgagggacagagcaagactccaactccaaaaaaataaagaaaaactggcttatattgaaattatggtcagtgttagcttctccatttgctaccgttgagtcacatctcctttgcactgtgctttttcacccatactttcagtttgtaaagtatttgtaagccgtcttcctatcttctaacaaagcactcccttcccagccttctttcactgatacacttgagaaacctgctttctgtgtcttaattaaatttctaataataatgtcaaataagatgtgaaaaggtatataatccagcagtacaacactagagagttcttttgtgggttaacagcactccattaatcacaggtgttcaagcacttgtgagtctgcctgacagaaataatatttaactgataatttcttttgctttttctcaaaaatgtcatgaaagccaggcgtggtggctcaagcctgtaatcccagcatgttgggaggccgaggtgggaggatggctcaaggataggagtttgagatcagcctgggcaacaagtcatcaccctgtctttacaaaatttaaaaattagcccgtcatgctggcacactcctatagtccctagctactcaagaggctgaagagggaggatcacttgagcccaggagttcaaggttattttgagctaagatcacaccgctgcacgccagcctgagcaacagagcgagactctcttgaaaattttaaaaaaaaaaatcatgagaaactgacaaattccttccatttaaacatctgataacttacagcatgagctttatcagaatattgtatgtatatattcacatagattatataatgtctcagctgatctatggtaaagggtaaagccttacctagggatttgggatttttttttggctttagggggtttttttttggtagtttcaggttttttggttttgtttttttgcacagacattttctttgctcttctaaacctaaccttttccactcagacatttcgactctcaggaagtgacttcttttcctccttcctactcctgcctcctcaggcttcatcctgtttccaaaccctctttgatttgttcaaggtgcctgattctctgtgttctatccttgagttcagacgacactcaagcagacagccttactccacggatcagccatttatatatctggtaggcaagagaatactcttctgtcctctgacttaggatttaactcatgatgcttgctattttcttacctacccttcatcctttgtttagagctccaatcattataaacattctcatatcctgttctctgctatttgcacatcccagtcacataggatcactaataatagaagcatttactcaaaaccaaggtggtccccatgcctagaggctgagaatcccaagaacagattatagtacaatgatgatctggttagacttagtcatacaaacacatgacagcttccactgttgagatgctgatagaatcagggctgttgtaagggcccaggaaagctatttgtccccagcttcacgttcctaaagtcttaaaatctagacttttgcgtaaggggtgagggggagttcttgggtgcttttcctttaaaaaaaaattttttttttttaatttaccaaaaacttcaaaagcaaagtgactgggcctctctaaacctctgaagcccttgttattgtctaagcatttcttcattttgttttattctcacgtacaaccccatgttgagaaggaagatgctgcctgggacatggaacctctggggccactgataagggggtctcaagctggaagttggcccactactcaaaatttttggctgtgttcttgaatactatagcttaccccaagaggacttgtggggaacaagaatgagagggtgaactagaaagaaaggtgattaggcattgtccaccccaaaagcaactcctctaacaaaagaaggagcttagagcagtttccatggagaggaggagtggctgtttatcatggctggccctctcattagctcattaccaaaaaacctcaagggaacaactaagaaaaggttttgggattaaaatctgtttaaagaaatatccggaaatagggtttcccataaaaaccttgcccattttttctaaattctgatttttttcctttttttaaccaataatttttggcttattctacatatctggtatttgactctttgtcaaaaaaaaaggaggaaagaaaaaataataggacttgaaagtttctttcttcatgctcatcctccatttgacgcactgtctggaacttagaatttaatcgaagcatctgtttttaagttgatcggtcttattttcttcggggctttttaaaagtatgaaatcatgaggcattttctttattttctttattcatgtggcctgctggccagaatttctttaaccaggtaattaaatgcttctcctcatagtctctctgctctctcccttctgtcctccagccctgatgtgaaaaatcaataacctcattatcagtatctgcagatgggagctgagctctcagtgcaacatctctgctcatgagaatccgtggctggtacttactttccctcgcctcttttctgggctctacattcttagagccttattttcctccaaaatcctttctagccagagaaggtttttctcaactgataaggcaaagtctatgctttccatcttcttggtagttggattaaatgggagaaaaatggggtacaattatatatgtaaaaaaaaaagagggacagaattatgatccacaggggaaaactgaaacgtaagtgaaaaatgacatgagaaactaagagtaagtatatcttgtttacattttctttatttcactataaaatatattagggttttagtcttaaactttattatttttgtctacagtcaataaatgagaaccagattgcagatggcaatttttgtacgatggaaatttttatttgaccatataattaataggattagtaggatgtgatggcagaaaataactttcctagagatgaatatgcctggtaactagcagagcaacaaatgtaatttcaaaatataaacagcacaaaaaaaaaaacaactcaaaatgaattaaagacttaaatgtaagacctgaaaccataaaactcctaggagaaaacaacaggggaaaagctccttgacattgagcttggcaatgattttttggattcgacccaaaaacacaggcaacaaaagcaaacataaacacatgaaactacatcaaactaaaaagtttccttacagcaaaggaaacaatcaactaaaaacacaacaaaaatgtgtgcaaaccatatatctgataaggggttaatatccaaaatatataaggaacttacaattcagtagcagaaaaacaacctgatttcaaaataggcaaaggacctgaagagacatttttccaaagaagacgtacagatggccagtagtgaaaagatgctcaacatcacaaatcatcagggaaatgcagattagaaccacagtgagatatcacctcatacctttttaaatggctattatcaaaaattcaagaggtaatcagtcttagtgaggatgcagaataaagggaacctttgtacactgttggtggcaatgaaaattgatatagccattatggaaaacagtatggaggtttctcaaaaaattaaaaatagagctaccatatgatccagcaatcctaattcttggtgtatatccacagaagatgatgtgtatccacatcagaagatgatgtatatccaccacagaagatggtgtatatccacagaagtagtgtatatcaaaacatcacactgtacaccttccagtatatactatttgtatttgtcatacatcggtaaagctggaaaaaggttaaagaaaaatagaaacaaacaaaagaaagaaagtgggctctgaaagggaaaaagaaaacacaaacagcagccatcttagtggtaaccaacaaagtggaaggcaggttggtttaggttgttacctaaatgttcatcctcacactgcccaacccatctgttttccaaatattcattaaattcagacaactacagaaatgtaggatcatttctctctagagagttgtcagtggagtcatcccatcttcttccatactagactgaaaaaaaaaaaaaacatgtattttaggaatagatcccagccacatgtctctcactgtctttcattttcttcttttagctctgttaccaatatcactgatgagtaccctacaatcaattttcagaaactcagatactctgattatagaagcagctgattttgttccagtacggtttctcaaccagtggtttatgatcccagttgacattagcagtctctccaaactaggggtcagcaaactctttctgttaagggccagacaatatcaggcttgggggacagccagctagtctcttttgcatctacttagctctgtcattgtagtacaaaaacagccacagacaatatttaaacaacatggctgtggtttaataaaagtttatttacaaaaataaacagtggactggatttagcctatagttcatactttgctaaaccctgctccagaccatagggggaattggtaaaaatcagtgaaaaatttttccaaaactaaaggcagaagtgtttcaaattaggtaagatatgtggtccatatgttctatgacttcatttttaatttacatttagtttatggttttaatttttttttacctaaaactctataacaaactttcatttaatttgaatccaatttgtaaaaaataaattttgactgggcacagtggctcatggctgtaatcccaactctttgggaggccgaggcaagcagatcgcttgagcccaggagtttgagacaaccatgggcaacatggcaaaaccctatctctacaaaaaatacaaaaaattagccaggcatggtggcgaatgcctgtggtcccagctacttgggaggctgaggcaggagaatcacctgagcccaagaggtagaagctgcagtgacccatgatggtgccactgtactccgcccaggcaacagagtgaggccctgtctcaaaaaaaaaaaatgttttatctgaacttgacaatctaataataaaaattagtgacaatcagtttactgaaatgtgacttttttttttcctcctctataatttaggccttggaaaaccattgcagagtgaatggaggctattcaggcctaagggatgtttaccttcttcatgagagttatgatgatgtgcagcagagtttcttcctggcagagacattgaagtaggtgaaaattattctaaaaccatgtggctaaggtacctgaacagatctttgtagatgtctttatcatgaacacattcaagtaatatcaagtatgcctgattcagaatatcaggcatggctataattgcaggtatattctcaataactaggttcagtgacttggtactgctaacaccaaagcactgagtagctgctttaccccatgttaatgagtataacccctcagggttttgatatatttgactcttgtccatgtttcttggtaagatgaatgcagacattgatgtggtttttgctgtgtgtttgtggtttcactgcctgcctagtgtcttgggcctcatatacttatgtttctctcaccagatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccccactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtcaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaa

SEQ ID NO: 38707 - DNA, 6960 bp, Homo sapiens
attttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggtgacacagacgggactctcgcttgcgctttccagatgcatcagagatacttttggtgcggggctgctctgcggggcgcggtgcgcggctggggactgtaagggccgggggagggagtctccgaggaggcccggggtcagggaactatcgggggagggggcgctcttttcctggcgggcctctgctctccgccgccgcgcgtgctctccgccgccgcgcgtcctcaccgcgctcctttccctttctttttaggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggtaacaccacccgagatgcacttgggtcctgacccagtctgggccgggtgtgacggggagcgggcagaggggcatcggttaaatgccatgaatctgtggccatcacgagtttgggcgcgcgttatttctttgatttttgattttttaaaccagtaaactgacgtgcgtggacggtgttgagtgtttcagtttacttgatgctttggcgctacaactcttctcccaggtcctcctctgccctctcttctcttctttctccttatgttttaactcttggctttccctgttggagtcttgtccagagtagattctgatacttggcagaatgaaatgatgtaaataatttttgagtcattatatttgagtctagcctttgggaaaataacagcctgaagcagaagtgagtcaatgagttttttattgtactggaaaaggtgaatagatttcacagcggcattcagctgactacgtgttaaaggtctatctggtggttcttcgtgctggttcatatgttaagggtatagtggcaccccctccccaccctccactttagttcaagacgggttttatatgattagttaaaattgtctgaggaggcaggctcctggaatgtcataatttagtttatatttgattgtaactgcagggtgcccctggagggacacacaagatactgataacattgattgccgcaggcggagaggaattgggtggcttggaacaagggcgagaggctgactaacctaccgctgaatgcccttccgagtcttttgaatgttgtttggatactgtgtgaatattgtgcctattagaccgttttcaaaaagtaacacttaaaaagtcagacatgacaacaaaacctcttactactgtgctacgtctgccaaaagcctcaaactattacctctagtccctttcccagacagtaaaactactcgttaaaagtattttttttctattttcagaagaccgtttaagcctgtaggtagtgtttggctgaaacttgacaaaacaaaagggaaagagcaaaataattctcagctgtgaagaggatgtatttatttattgatttattattttctaggtttgctcattttgttttatcttttaaattgtaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattg

SEQ ID NO: 38708 - DNA, 22097 bp, Homo sapiens
ttgacagcggacatcatttccaccgttgagtttaattactctggagatcttcttgcaacaggagacaagggcggcagagttgttatttttcagcgtgaacaagaggtcagtaattttcagtccacaaatcaaatgcaattattcaacctttcgcatataacttagaagggaggaagcaaaattattttctcattgtctcatttcattaagattcagttccatcacattagccatacagaatctcctttcagaaattatctaagttctggcctcagctgctgagccccggtgaagtctccaaggcctttgtcttcagagtagggaggagattccgctggggaccccatgaaggatgcagggtggtggtgaggtgcatttatgtgctttcattccataagaactcacgcggctctctctgaaaatccctttatacgcctatgcaggtactggcccagccccgccgtcctgccctgccatgaagtgtgagcagctttctcagcacttcctgcagagaagtctggcaggggtgtgaattctctcttcccttcagggagaggtgagcagcactcactcctccatgcccccttgaaggcttcacctgtctggagggaagggaaccttcagagtgtgggccttggaggagcccacagctcataagcaagcactggcttcccggtcacggcactgccttttcactgatgccttgccagccccctccctcttctttctgttgagcctcctcagaggtcctaatgagcagtgataaaggaagcaagatcatgatttggtagtcaaggattcctggcaagaaccctggctctgtgcagctaagcctggggtctgaaatatttgtcctgccttttccttataaatacagtcccttgcccttcctgtctctgagtttcctaacagatgaaagggacagtttatcatctccaaagtctggtctctaaatttgtgtgacgaactttggtttagaggttggtgggccctggttcccctctctgcagatctgtacacaggaagtgctggccctgccccccaggaaggggagcctggaggaggactgtccctgggccacatgaggaaaattgacaggtgctaaccaatttcattatcaaaacatacctgttgcagctttattttgattatgtccaggtagttaaagatttttttaaatcctgttttctctgatttgggatggtaagaaatccttttgtgaataataagtatatcgttaatatttcttcacagtttgatacatttataattttgcatttttatctcagaagtagaatatcacacaatgctacttaagaaccatataccttggccaggcgcagtggctcacgcctgtaatcccagcaatttgggaggccgaggtgggctgatcacctgaggtcggaagttcaagactagcctgaccaacatggagaaaccctgtctctacgaaaaatacaaaattagccgggtgtggtggcacatgcctgtaatcccagctacttgggaggctgaggcaggagaatcgcttgaacccaggaggcagaggttgcggtgagccaagatcgtgccattgcactccagcctgggcaacaagagtgagacttcatctcaaaaaaaaaaagaaccatacaccttacctttctcaacagaagtaaaagtgggttgtggtgtttaaatgttacttttaaagcaggaggagtttttgtttttttgagatggagtcttgctctgtcacctgggctggagtgcaatggcgtgatcttggctcactgcaacctctgtctcccgggtttaagtggttcgccctgactcagcctcccaagtcgctgggattacaggcatgcaccaccacgaccagctaatttttgtattttagtagcgatggggtttcaccgttggccaggttggtcttgaactcctgacctcaggtgatccgcccacctcggcctcccaaagtgctgggattacaggcatgggccaccacgcctggccagcaggaggattttttaacaaattgttgagtcatggctatcttaatgcaagacttcacttttagcttatttaaaaagtctgtcattgtagcgatagccttagggaagatgcctcatccctgcctaacagattttaggttagaaaatggaatttctcttgtttttgtgaatcgttgcttaacctaaataataatagtctcaaatataaaacaaaccctgataaaagtcaagcatctcgttctaaaagatattgggtattatagagtgttaagtgcttttttaagatgaagttgttatgtgagtgacagatttatacaggagcaagtccctactgaagttgttcagccagctgcaacttgacaaaccccaggcagccttttttctttttcttcgtatttcggttcacgtctgaaaggctttcacggtccatccattttagagcattcggctggttgccccatgtgcccttccctgtggacttgagtgtgtctgtgggtaagggcggcagtgcacgtgttcatccatggccggaggccgcggatggtgttgcagccgccaagagggtgaagctgctgcccatcaagcgaccccagctcccagttagaagctgcagcaaggttcacaggcgtccacgtgtgcgtcttagaatcgaaggagcgtggaggattcggaaggctagtgagtgagcaccagattgtggaaggtgcagggcctgagattcaggagtcaggtccatagaggcccgttgggaagctctggctgtgcagaagacgaggtgggaagcatagtcagcaccttgagtttcaagcttttcttacttttctgtgcagattaagtcttacaggaaagcccagccaataaaactaaggcccacagaacgtatgggtgtggctgtgcggcccactgccctccaggctcagctctagccgccaggaatcaggtgaaatcagaaatcagcacgtccaaaaagagaaggtgctcgcttcctcctcttcctgtgtgttacttccctgctctcctgcccgtgtccccatgaggcttcctttagaattctctcctagcagagcggcactccatgagatctgggagtgttggagaaggctgaggggttgcttgggtttggggtgactgggatgggagttggaacccgttcatggcagagagacaagcctgcagcctagggaccattcttgttctggctcttaggagaaaggccagggcagtgcaggcagcactttgacttggacattttatttttttgcttctattccgctgttttttcttggtagatgaatgtcttgggcataggactaatttagttatacagatttttctttttaaataatttggttccacttttctcccttgaaatagaactgtctgttgaggggctgtgcttttttgtagagtggtaggagagggtcaaaggagaacagtttcaacatctgccccgtgcagcacacgcggggcagtcagcagcaaggcgctcagctcctgcccgtggaggcttcggttgaaggaatgcaggaatgccctgcctgtcagactcagtgcggcggacaggggcaggcgaggcactcagctcctgcccgtggaggcttcggtggaaggaatgccctgcacgtcagactcagtgcagcgacgcggggcaggcgaggcgctcagcttctgcccgtggaggcttcggtggaaggaatgccctgcacattggactctgcagcagtgcgggtgtgggtagcttcttgggatgtcttctcctgatacttgatcagattggaaatatcaaggaacatctgtttagacttgaaagttcgtttagttccattcctttagcatatgtactaaagtgttaaacacctaagatattagatattggttatagagcaagaatgaaagtactggcgtccttgattttgaattatgaaatatttaatacttaatagaaaatttcacttagggcatacagaagattcagaggttaatatagatgtacctgcaaacccaccacccagaggttatcccttcatcaaaggaaggagaatgctcgggatacagatgaagctcctgttgtcccctccccatttcagcctgctactttcctcctggtctttttcactctccctctagcttcccagagttgctcatgattttgaagatggcatatgtcttcccaagcatgtttctccacttctgtaacagacttgttctgtacgtacgtaagcagcacctcactctgggcacctgtgcagcctgcttcacttgtgcagcactgtgcggttgtctgtgctggctcatttatctcagcggcttcgtggtggtccctgcatggccctgtggcttactgttgcccttcgcctctggttggcatatgtgtggcgtctggttcactaccactgtgttggagctgccacatcgctgtgtcacgctcctcaggcccgtgctggctctcctctagagcagactcagcagacactttctctccagggccagattgcaaacatttttgcctctatagctcatgcggccttttcacaaccactcacctctacccagatggtgcagaagcagccagagacagtatgtgcacacatgggcctgactgtgttccactaacacttgccttaaatacggcaggctgcattcagcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaacacggcaggctgcattcggcagacctgctccagaaaatacggcaggctgtatttggcagacctgctccagagaacacggcaggctgcgtttggcagacctgcttcagaaaatacggcaggctgcattcagcagacctgctccagaaaacacagcaggctacattcgacaggctgaattcggcagacctgctccagaaaatacggcaggctgcattcggcaggcctgcttcagaaaatacggcaggctgcatttgacagacctgctccagaaaatacagcaaggctgcattcggcagacctgctccagatgcatacctagaagtggagtcgaagagtcggaaatcaagttcgttcttttttttttttttttccctgagtttcatctgagatttttttgagccaggattttttagctttaaaaaatatgtatggtcatttgatattcaaatttatagtactgaaattttctctacactgtgctttgttcattaaaacagctctcatgtttccttgcagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatggtaagaattgtgttctaagtggctgtttgatttagttttttatttttaattttctgtgtgtgtgtagattcctttttattttagaagttattcctgctttaaattttggggggagggtaagttatctagggtagcaagtgataggttgaaaattcaaagtatgcaacaaaaaccacacgtgcactttattatgctgttactctgcacgtctgcacatctttctttattgtacaaaacacctccaattggaaatattcatgttcagagaccccatagcttataacccaatataggaccacaccgctttctaataccagtactcaaacagtagtgatgcatgttatagtttttcttttcatatggagaatgaggtttttattttcagataaaactataaaattatggaaaataagtgaacgggataaaagagcagaaggttataacctgaaagacgaagatggaagacttcgagacccatttaggatcacggcgctacgggtacacgttgcctttgctttatccaatgctgttgagaagttaagaataaacgtttcagtctgctgtctggagagtgctgcgcggtggagtactgtgaggtctgctgtgaggtctgcctcgtgattcctgaaagtcgtttgcactcatgtgtgtgtttaaaagcaaggtctttctcctgttttcacaaaggcagaaagtcacatgtggtccttaggaaacacagcaatactaaggggaaaactcatatttaattctacagcagaaatctttgtggacatagcaaccacccttctctcagaaggttcagaacagcacctgggaggttggagttcagatgaaattcagaacacctcacaggtgcagtagcacaggttgcaggtcgaaagatgagctgtgggccacaggtacattcaggacgcttctcggggaatttctttggggttggtttaggcagatgctgatggttcagaactctccacctgtccatccatgagcatcattacttttttaattgttaaattatttgctccattgttggtagtatgaaatgatcatatttcatcaattctgatgcctaaattttttcatattttaacatttatgaaaccggctaaaactcaaaacctcaatgtcttataattggcctggtgctacgcaccactgatgttgtcttaaattagatggaacatggtgaagggtgtccggcaaactgggctcgagcccaggtgtgtcttggtgagaaaccagcacctgtgcagaggtgtgtcccctggaaggaaactctgcctggtcccaagggggtgccgttactagattggaaaaccgttggttgtttgggtggttgggtggtttggttgcggggggtgggtggttgagttgggtggtttggttggtttttaatgagatttcagccccttttacactattgtttatcaagtgaagactgagtgagtgagcccattccacattagtcttggagagtgctacagaggacgctgtaccgcagaagcctttccctaacacatgtgcctctgggagtgatgttgggtctgttctgatgccatttctccagctttgccgtgtggggtggctacacctggggttgtgcattcctcaggaggagtgtcctcagacttctcacatcgatgttgtcaccgtatttcctatgagttcatcaaagcgagaaaggctgtggcatttgctgaaaatctagtttatagggtcctaatttgaaccaagatgttttgatccaaaatgttggtgatgtctgatacacagtgctgccgcctttgcacccctgaattagtgtaaatcacttttagtgacagtaacacgagttgtgcagttccatcatcatgaaactgctgatcctaaagtagaagtgtgatgggacccccgagggtgggcacttgaccccctccagccttgtccatctcttctgcagccaacaccacctcccacccagttacctgtgcacaccccaccctcagaaacccctgttcctcctgatcagaccctgccacaacccatcagctcacgtgctcattttgggagaacagtaggcctttactaggcccagtcttggttttattcaaggctgcttttgtaggtttagcctaaataaaacgggtataattggtggccctactgaaggtgtgtgagaagtctagttatttcattagttggtgcatggggaagagaccacagacaggtaattctgtacattgacttaggtcggtatttgagatcttacctctctaacagttcagagtgggctatttatgtatctgagcctaactgggtaagagtcagacatgttgctgtttttaaatttttgctcttaaattattttagtgccagaaaagggatataattaaaagaagaaatcttggccaggtatggtggctcatacctgtaatcccagcactttgggagaccgagatgggaggatcacttgagcccaggagttcaaagaccagcctgggcaacatagccagaccccatctctaaaaatgaaagcaaattattttatatgcaaattaaaatgttttcaataaaagaaggaatctttgtaagtattgcagctatcatatgttttgattaatgggaaatttgttagaggattggggtaggtgtgtgtttttaagcctgaacttggtagaactgactcttcttgctctagagaatccaagggtgtggtcagcactacctgggttaaaatgagggaagcctccctacacacacttttccaagttggttttttacagaattcagccagacaagactcagttgagagcttttctttttcccctaagctttcaaggctctcccttttggtttctaattacaagaataacaaaaaatactatcattaattttttgttttgattttaaagcttatgtttttcttccagctggatgttagtgagacacaggcctttttccttttttcatgtgtgatgctattcctcacgcctgagctctcacctctgaccataggcggcctgcagccagcgcccactcctctctgtcctttctatttctgtgcgaattgggcttccctaggaagcctccctgaccacagcactcaacacagagatgggggcgggaggtaccttctactttttgttttaacctcaagtgaagtgtaatatataatacatacctccagataagacatctgccctataagtgaccagctccatgaatgtttgtagggtgcacatgcccatgtagccagccccagaccaagaaatggaatatcctcagctccccagcaccctgctgtgcaccctgccagtacctggagccagtggaggtttgtggggtttgcaccgagaagcatagtcctagtgcagtgagaagaggtgtgtgcatctagctgcaaggagaggacaaagggaggggtgcagctgagccacccaggaggactttgctgtccagcgcctcagtgtggccactggaggacacacaggagagggagccgcaggcctcggtgcctgggcagtttgttaccctgccagctgatcttctcttcagcaggaacatgtcgacctcggtaatggaagcaaggggaagacttggaatagacagtattccattttgtagcatattttcataactctgctaattggttatttgggggtattgcctgtacagaattattacttagccatgaatataaacttgtcctctttcgttatctactataagtgttctaattatgtgctgctgtgatctttgttttgaattcctatttccttccatttttaggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttagtatccttcctcagagggacactggcgtcttcccgagggtgctctttagatagtaatttctctcgtccctttatacacctgtatctcggagtctagtcttgtaaataccatcactgcacagcagcctgtgatgtaagttctctgtgatttgaaatgtttgtccctaaaaatacaaatttctttctacctttgggaaaaagttatctgtataatgggaattacctgaagtccactgcctgcctggtttaatcagaggcagttttaaataggctacatttgaaaaaccaacattatgtgttctttttttttttctaaatttgctaatgaataatagaaaatactggcttaggttagagcagtgtttaatcacccatctgagcagcagcttccagttagaacctgtgttcttctgtggctgtgcacagtctgggtggccccagccctcctcacatgggcccctttccagccagcagccgggagcatggggcttgcttcgtctgcagcctctccagggtccctgccgtcctccctctgctgtccagtggcttgagctggggttccatgtcgtatgttggttttcttagttgtttcagcttgaagggtgaaactgggactgctagtctgaattggcccacagctgaattctgccctttcttatttttttcagttgaaggatttctgtataggatttctgttggatctgttctagctacacagaataagctcttcatgtcaggaagagcagcatcttttggaatttggcggcattcttgtgttgtagttttgtgtgggagtgtgggattttgcacagatggtactagcttggttttcctatttatatgattaagtatgtactatcttgctattaagggctttctgtataacattaataatagcagcaagatgaaagcggtgttcgcttgtctgtgtctccccctgggccggggcgttgctgtagtctgagtgtgctcatcccaatccccttaccaggcgctcctttggaattcgggatgtgtaaccagccttcttaatagctaatcccttaaacctcactgcgtggattatttggcgtcctatttcgcgtgactgaatgtagactaattaacaaccagctgagctgagcactgtgccttaaccatgcactcccagacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagtgtaagtgcgtctgttgttgagatggagtctggctctgtcacccaggctgcggtgcagtgacacagtctcggctcacggcaagctccgcctcccgggttccagcaagtcttctgcctcggcctcccgagtagctgggaccacaggcaggtgccaccatgcccagctagtttttgtatttttagtacagacagggtttcaccatgttgaccagactggtctgacctcaggtgatccccctacctcggcctcccaaagtgctgggattacaggtgtgagtcaccgcacctggtcacgcctggcgtcttttaaagcatctcatttagagccacttgttcttcagacactccaaagacttagagagttcttcctgttccccaagtgcctttgcacaactggggagccctcctttgctggggccgtccgagtgtggctgtgtcagaggctgctgctaataagtggaactcgaggtcatgcttcccacaggcttatggctgtagggtgagtgtgcttttggcaccaccgagaagcggggtcacttctgcccagagcctgggtgtctcctcagaggctgccagcactgagtcccgccaagagccacccgttgcctctgcctctgtgcgtgagacctgggctgaggccgccagcacacaggaggccattcccagctgttggaatgagctcctgttcatgttgagcttggctggattggaagccacttcccttagctgaaagtctagcattttaatccagtgagctttcaagctccttttaggtgagggaggttctggttttgtttttatttttagccataaagaatgggcttgactttatagagcactgtagtcagcgtgtcccagtgtcctgaaacattgctgacccttcctccagtgccagcaggtagacacacgtccagtgacttcctctgatggggaagccgccagtcaatcccaccagactgagccgctgctcatgtgcagcggcgcccccagtgcctcggtggaatgtgcccatggaccgtgtgcagcagccttttcgcctgttctctttcctgaggttgagtgtgtttttaagaattcgtatttctactagaattcctgcgatgaggatgagtgtttcgtagcatttggcctgtatcttaagcataaaattcttgagtaaataatttcagattccagttctatttgtcatcagagtgatttatttgagtaaatgcttggcgtcggcacagctggcttcaagttaatttcagatgctaagccgacaaacacaggctcctgcatcaagaaaaaagagaaaaaacctaaagcagcttcaggtcaaggaagcacaagccaggtgcagtggtgctcacctgtggtcccagctaccctggaggttgaggcgggaggatctttctgaaaataggaatccagttttgtcacagtagagcttgtgtatattcagtattggagacaaaccttggctggctggctttgaccggcgggaccgtcttggtggttaaaatcaggaccacagcgttgccagtcaaggtggtcactcctgcagacccacaaactgtcgaccctccaaaaagcaggcagtttcttagaggcacagaccgctgtgtctgcatgaccatataatgctgtttgtgtcttcctgtgatgtgtatgcgatagaatttcacgtgctcgggcctggtgccatgaggacgcggagacactcctacaggaatgcggtggtgctgaacctgggcacacatcaggatgccccgaggagctcccacagatggcagtgcccaggaccttgcctagagattctcattcagggtccgggtgagacttgggcgtctacgcttctcatgcccatcccttgtccatagctggtgctagaatgtcttatccgaagctcttgcccacggaagtcacagaagatcagaaaacctagagaatcagaaagatcagaagacctagtgttgaggccaagcccttccagagtctctctgaaggggccacttcctacttgaacttgaaaatgatttgttctctgatttttaaacagaagctgaaaacattttattttgtttttcagtttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggataggtaaggcctgcgtggagatgagctgtcgccccaagcttgctggtttccgagagtgcaaggtcagtgagggaggcgagctgtcctccagcgtcagaggaggacgctcatagggtgttgttttccagaccttttgattgatggatgatagtatcaaggtagagaaaataggatctctgagcaagtttctcacctagcttgtcattccatttatatttagacaagaagtatagcactaggtacaggccggctatgtgttaaatgcttagtgaatgatagtgtattactttttattatgctgataatgagtgaaaaggaaggaagtggggaagtgattcacctcactggaatgaccgcgttgcagtctgcctttccttctggagagaagtagatgaaaacaccccagagccactgcctgtcatgcccagacacagcgtggtcatggctggtctgaaacaccaatgtaatttgtaatgtgatggttctagtaccttgataatttattttgtatacattctttaaagatagctatgattagtgtggttgagagttacgttttttttattatgcaaaaagttacgtttcagatgatggaagattgtcttgcaccatttttatatagaatttttgttcagaattcaagagaacagaggagtctattggcaataagtgattgactggatattctgcaaaaccctctggcataaacacctagaaatgctggatatgatacagcaggtgtctcttcaggtgcatagttgagctcacagataagcaagggaaatctcacaacggccagaaactaagagggagctgaaaccagaatggcagcctctgaaggcgtctattccgagagcagccttgcagccccggctggcctcaggagcatcagcccatagcaggaaccactgcccctgtgaacagcaggttatggtgcaaagctgaagccttgtcccacacgaggtgacttgctcatggtggcttttcctgtatgtgcttggtaattttcaagagctgaagccttggcccacacgaggtgtagagttggaacagggacccctgaagatggtgtctccctccactggcagatagggtccaaagggcagtttgtctgtctgaggccttgcatgggggtggccagcactgccctgagaagtggaagcaaaacctcccctcacaagggtttgcagtttgggtttgtgccagctacatcatgatctgtaaaatctcacactgtggagctcctgcctccacgagggctgtgtgcgggcatcgggagggaccggcgtgtttccagatctggcttctactctgtttgcagactgacctgccagcctgtagcatctcacggatgttgactgaagacatgaggttcccgggttctcatggcacagctggcagcatgagcctctcgttggcctgggttccccacgggtggacacttgaggccgtggctgatgcacactgagcttggagaaccccactgctttcacagcgggcagtaaacacacctgcactttgactagaagagacatgacctcattcctcaaggccgcttgctggaagcacagccctgagaagtggcccaggtggagagaatggcattggcaaactccgtgagaacacgcatgctgggtagctgctgccagcacacccaggtctctctggatttcgtcacattaaaatcatctaaacatgagctcacaggtgaaaattaccaagcacatacaggaaaagccaccgtgagcaagtcagcagaaccacagcagaactgaacctccgagaaggcagctgttgagatcctaagttaaagaagataaactaagaatgcttgagatattcacagactagaggaaggaaacagcctgaaccaggagccacatgaccgctaaacgtgacctggagactggaaaggaatcagagggaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgacagatgaaactgtgtgggtttagcagcaggtccattttggctaaacagatcttgtattagtggatggaaaggaaaaccagaagaaatgcgggctaaagagccaaacagaaaacaagagacactaggaaccgtggaggccagggtgaggcacagcacacgtttaaacaaagtttgggggtgtgaggcttaaagtgacagtggccagcaattttctctaaattatgaaagcctgaatacacaggatcgggagcacagcatccatccatctcataatgaaattgcaggacaccaaacgcaaagagaatatcttaaatgcacccaaggaaaaaacgcaaattacctctgagagcggacaccgagactgagactcggctttgccacggccacagtgggagccagaagccgtgtgacagatccagcaagtgtgactccttactctccaccgccagcttagaatcaagccttgaagtagatgctcgttcaagaatctgcttgtgataaaggcattttcaaatgggaaacaatgtatcacaacaggaaactcagtagagcgagctgtaaagggagcctggccctgcagaaaggggctgagacagataggcagaggaacgcagcctgcagggaagagcagtgcaaactctgaagctctgccacctggacggccttagttatctgtgtttgggggagaaaaattagagccctcaccagccccacacaataaataaataagctctgagtgtttctaagcctaagacatctttgtgagctctggaaacaagggcttctttaagaaggccccaaaagcccaaggaaaacattaagaaattcaactacattaaattttaaacttctttatattgaaattaaaagtgaaaacaaaatccacaaaaggataacgaacagagattaagtatccagaataggtgcagaattagttgtcaacaagaaggtggcaaacaactcagaaaagagcaaaaaccatgaatggggtttcgcagaaatggaaaaataaatagaaatgctcatccttcttagtgatcagcaagtaaagccagagggacgtcctttcatgcccatcagaatgatgatggtttgggggagagggtggagaccagtggtcttacccagtacccttcttgtgacctccttggtgacattcagtcgggttgggagcttcttgcatgttcagacaagaaaacgtgctcagatacctgaaatagcaaacaactggagacagcccacaggtgcatcattagaggaatggacaggtaagttgttctctatcataacatatactgaaaagcagtgagaatcaattattagaactacatggatcacctaggtggatctcacaaagataatccacaaagaaaattcaggaggaatgcgtacggtgcaatgacatacaacatgtttaagacatacaagacggttttgttttaagaatctgtaactattggccaggcgcagtggctcacacctgtaatcccagcactttgggaggctgaggagggcggatcacgaggtcaggagttcgagagcagcctgaccaacatagtgaaaccccatctctactagaaatacaaaaattagccggacatggtggtgcatgcctttaatcccaccactcaggaggctgaggcaggagaatcgcttgaaccttggaggtggaggttgcagtaagctgagattgtgccactgcactccagcctgggcgatagagtgagactctgtctcaaaaaaaaacaaaaaaaatctgtatacaaaatataaatgtgtgtggggatgacacatatgtactctagcaagtgaggaccccaactggggatgggataggagaccatctttctttccagagtggcaacacagtgcaggggggtccctgtcttagcagtgacttgctggtgtgcagaggggtcactctcttagcagtgacttgcgggtgtgcagggggttcaccaccttaccagtgacttgcagggggtccctgtcttaacagtgacttgcgggtgtgcaggggggttcgctgtcttagcagtgacttgcgggtgtgcgggggggttcactgtcttagcagtgacttgcgggtgtgcagggggtttcactgtcttagcagtgacttgcgggtgtgcgggggggttcactgtcttagcagtgacttggggggtccctgtcttagcagtgacttgcgggtgtgcgggggttcactgtcttagtgacttgcgggtgtgcggggggttcactgtcttagtgatttgcatgtgtggggggggttcactgtcttagtgacttgcgggtgtgcgggggttcactgtcttagtgacttgcgggtgtgcgggggttcactgtcttagcagtgacttgtgggtgtgcgggggttcactgtcttagtgacttggtgtgcgggggggttcactgtcttagtgacttgtgggtgtgcgggtggttcactgtcttagtgacttgcgggtgtgcggggggttcactagtgacttgcgggtgtgcggggggttcactgtcttagtgacttgcgggtgtgcggggggttcactgtcttagtgacttgcgggtgtgcgggggggttcacttagtgactttcgggtgtgtgggggttcactgtcttagtgacttgcgggtgtgcggggttcactgtcttagtgacttgcgggtgtgcggggggttcactgtcttagtgacttgcgggtgtgcagggggttcacttagcagtgacttgcgggtgtgtgtgtggggttcactgtcttagcagtgacttgcggggggggtccctgtcttatcagtgacttgcgggtgtgtgtggggggttcactgtcttagcagtgacttgcggggggggtccctgtcttatcagtgacttgcgagtgtgcgggggttcactgtcttagtgacttgcgggtgtgcagggggttcactgtcttagtgacttgcgggtgtgcagggggtttcactgtcttagcagtgacttgcgggtgtgtgtgggaggttcactgtcttagcagtgacttgcgggggttccctgtcttagcagtgacttgcaggtttgcgggggttcactgtcttagtgacttgcgggtgtgcggggggtttcactgtcttagcagtgacttgcggttgtgtgtgggggggttcactgtcttagcagtgacttgcgggggggtccctgtcttagcagtgacttgcaggtatgcgggggttcactgtcttagtgacttgcaggtgtgcgggggttcactgtcttagtgacttccagttgtgcggggggttcacttagcagtgacttgcaggtgtgtggggggttcactgtcttagcagtgacttgcggggggtccctgtcttagcagtgacttgcaggtgtgcgggggttcactgtcttagtgacttgtgggtgtgcggggggttcacttagtgacttgcaggtgtgcagggggtttcactgtcttagcagtgacttgtggttgtgtgtgtgggggtcactgtcttagcagtgacttgcgggtatgcgggggttcattgtcttagtgacttgcgggtgtgcaggggttcactgtcttagtgacttccaagtgtgcggggggttcactgtcttagcagtgacttgcgggtgtgtgggggggtcactgtcttagtgacttgctggtgtgcgggggttcactgtcttagtgacttgcgagtgtgcggggggttcactgtcttagcagtgacttgcgggtacatggatagtcactgtattttttattcctcttgatatatttcaaatattgcaaaatacccttagattacatatccccaagaacatctaaaagcgttcccagtaacatttgcttagtccattcactctcaaaaacacgccagtcttcctacctggaaacttctgttgagggatgcgatgaaggggagtgaggcgtttcagtgctgcctcagcccaatcctgattctccgtgtggcagcgccttcttgtgttctaggtcgccccacagaaccagttatgtgcttacgcctgtgtctctgtctgtgctgttcccttcctgggccagcaccaggctgctgggcagcgcccttgtttgcagtgtggaaacacccactctggggctggcactatctgtcgagaatttaaaagtgatcataaatctgtatgaaagctgatgtgcttttcgttattaccatgcaccagcaattccagtcagtgtcggccatacatcatctgtcgtctgtgttctgaataatggttactgttgagttttaataacataaatgtaagcttcagattcacacattcttattacttaccctttcgtaaacattgtgttttatgtggaaactaatttggggaacccccagtcaatggccctcacgtgccaacttggctgcatacccctgttccaagaccacgtgcacagcttggcattgctggagggcgctgggcacaccttgtgtctcccgcctctgtggcgctgtgggctcctggatggaagcaggagatgggaaataaacatggatcgctgaatgcagtttctcttctctgagttcgtcttttttttttttttttcccctgctttgaagttttagacaaggtcagtcagacactaggtatttgccagcagccagggtcagtgctgggccatggaagggaagcggcccgcttctttctcatggcaccttgaagacgcgccagcgtgaaaggcctctcaccgcgcatgaccatgggggcaggacgtgagggcgcgggttagtgtcaaaataggaagaggaggcgagcttcaaggacggctggagaaaccagaagggcattgtttgaacacatctttcatcagaaactggactcatgaagccatgggtcaaatcatggcagcgtttgcatcattcagctatttttctgtcatttttgtagaaaatgtaagattgcagaggtttttaccagtattatgaagttatatcatgaggatgtgtgcggtagtagaatttttcgacagcagagacatttgaaagccattacagttgatcttgaagaaacaaaagcatggacggtattgtattgtctggaatgtgtgtgaaatgcagttgttctaaaattctgccacactttgcccagtggatttttactatttctatccgttgcctcatttgaaagaaactttttgaaattaatagaaaagcagtttaactccaaagaaacattgacagatatgactagtaactgttgaacatgataaggattatgttcaggtcattatggatcattgacaaattgcagaacataaggcttaaaaataaactgtgctgttattcatgagtgagataaataggtggggttgtttcaaaaaatacactaatgttaaaagtgtgactccattattttgtttctcctgtgacatggattcttactgacatgattatagataaagctcggtacacattttcactgcatttctcttctgcccattgtgattgatcattcctgatttctgaaagtaactgggttgtgggggagggtggcgtgcgctgtgcaccccaggggtggggtctgagtccttgctgccgctccccccactgaggagtgctgctgtctgctcttgttttgaacagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatcc

SEQ ID NO: 38709 - DNA, 62494 bp, Homo sapiens
ggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtgggcatgggcccggggctagggctttgctggagccggtggtggcctgggccctccggtcagggaggggcggaatggctgagcgcctgaacctcccttcctgtgcgctcttaagacctggatattgtgttctcgctccccaccttcctcctccctgttattcacaccacccttcctctgcccagcgattccctctcagttacttacactttctccctaagtccgacctgagacttcagacaccagcaacacttaacagccctgttcccccgtgtcttcatctttacccctctcccctctcccactctgcagtgatggcaatgcgaaagcttgcgccttgcatttacctggcgcttccacctgcccggtagctcgggccacgggcagttcggccacacccacgctgagaacaacccctgggcgagaaacatcttatcccaaagtgttgattgagactatgccctctctttttctgatggttgttttcttgtttggatacttgttaatctctacatcattatatttttcaaaggtatatttttgtggaatgaaaaggaagtattagaaatgagctgaagaccattcacaggtaaagagaaaaatttttaaatatacatttaggattaaatgaaaaacagaaatgaggtgcgaggagcgttagatttttcaaagcattacgatctctttggaactaaaatatagtggttgaaatgtgatatgatgaagtaatgattgtttttgccctgcagagagtatgtctaaataaccgattcccttctctttttgtgttttgtttctacttacaccaaacatgaactttgcaataaaattacactggtaacttacaattgtttttctactatttttaaaaaatggcctctacttaaattcagtataagcaccttctgaggaaactccgggaagaagatcgactgctgtgtagattgtctattataacaatatatttcactgtcatttctggtagggttatatgagaagtaaaaaaccctatgtttccttctagtccctcccaaggacatttcctacaagtgaattctgctgaaaatgaaaattagacagctttaggaggtaaagaagtagctaaaaggaagaggtattacaggcaacgctataactgggtagaaagaggaagcacctgtagctcattgccacctttgtgttctgatgctcgtcagaggtcttttctcagtgtataaattgctgagggtgtgtgtgcaagctacttactaccactcatgaccttttttctgctatcttcagtgatttcacaaatctagctacatggatgtagaaagagtgaaaaatagaacctggggcattcacactgatttgccatttaatggagattgtattgctgaccatgttctgtgataaataaattgtgctattattgtttagttcaaaatgtattttaactgcctgcttttctttcttagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccggtaggtaaacgtttgtttttaaaaatatttgattatatttttggtacattttgatatttatttaaattgctttaaatgatcaaatgcttaagaataatcatatgtcaaaattataattcaacttgtatgctagaaacaaaagcaccaaaatgttctggattatttaggatcccgtgaaggaatgtcagtaccaaaaattcagttccctcttaatttgtagacgattttccaacaattctattaaagacattaaccccaaaacaaacgataatatccgtgaagtagttgaagtagttttcttattaaagtaggttaagatcaagtgttttagaacaggaacaaaaatatttttttaaaactcagagggtatgacttgctaaaaatagaagtaatagctaataatagcatgttttaactttgactgttttcttctgtgtatgcacaagtccacaaaccagagttagaaagttttataaattaatacttcacagcagctgaatataatgccagtcataaatatttatgtacacattaatgtaaatctttcaaaactaaactcattttaatttttatggtgtttttgtaatttatttgattatttcttagtgagatttagcgttcatcattaacaagaagacatagttataattttctcttttctaggtagaagttttaaaataggattattttcattgcataaagctgagcaagagaaacaatatttctttaaatattgtttagttgattatcttttcctaagatccacattctatttaaggtttttatttttttttaatttttctttaaaatttcaaataatgatttttaagtttccatataaaagacagtagaccttctaccatccgagtattatttaaatgaaagcatccttcagaaacaaattttatgaagcacagtaacaaggaagaaacatttccgatccaattttggattgttttctttttttttttttttttttttttgagatagggtctcactctcttgcccagactggagtgcagtgacgccagcggcttcctgcaacttctgcatcacaggcttaagcaattcccctgcctcaccctcctgagtagctgggattacaggcgtgcgtcactactgcccagctagtttttgtgtttttagtagaaacggggcttcaccatgttggccaggctggtctcgatctcctgacctcaaatgatccaccctcctcagtctcccaaagtactgggatcgattttggggtgttttctgatactggcttttatgtaattagctgatagattggggcacatccttttttaattaagttgattttacctcaaatagaaaaataacctacaaatgtattgatttataattgttataggagtaaaaaatatttatgaaattaagagtttcaacaggcttattattttcagctgcattttttaggaagaataactcatggtctgataacgtctgtcaaccttttgaagagtcaattatttcattacttttcttacttttttttttttttttttgaagattatagtttcttaaaaaatacttcatttcaacccatggtaactcatgtcatgttgtattacccctccttatgttggtatatggtctcccagaagttactagattaattaaacctacatatatgttttgaagaaacttggattgtgtatctgaaataattgtattatatctaatattttttaacagaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtaaggtgatacgatattacttatgaaatgtgttttatctgagtaaaagaaaagtgaattctgtttcaccacttagcttatatatttaagatgcgtcactttgattagctccttttaatttgctgtgggagtgaaatttaaaaggaatgtcagttggtatacagagatgatctgtacagatatgaagttgtattggttaaatcttgttaaatacttttaaaataaggattgctatttaataaaaaatatgcattcatggactgcataatgacatttcacttaacaatggattgtatgtaggacattggtcccatgaaattataataccatatttttactgtaccttttctatatttaaatacaaagatacttagcattgtgttacagttgcctatggtattcagcagtaacatgctgtacagatttgtagactaggtgtgtagtaagctatactatctaggtttgtgtaagtacactctgtgatgtttttgcaacaacaaaattccctaacaacacatttctcagaatgtgtcccattagtaagtgatgtatgactatatgtttgcattaggggtagctaaatatttctttcagtattttttagtattgaataatattaatttctttcaatatattttagagcatcatattgtccaagaaaggcgaaacttcaagtttagtaatgatctcttcaatagaaatgccgtccttctcatatggaacccttactgatttttaaggtgttttggccttcggttgacattaaggtcaataccttgaaacattatcaataaaggttccatatgagaaggacgaaaggtgttttttttcttaaacatggaggaaaaaataaggtggaaggaggaaacaaagtaaaggaactaaggaagagagattgtaaacacacaggtatcaagggaggaaggtgtgttcagagacccagtgtttctcctagtcattaattaacctcaaatgcaggctaagaactgaatatgcttctgtattagactaaatgaagtattttaaatttatatctggaggatttgcttttagtaaatatgattttttttcaaaatagtattttcaagtatattctctacaccttgatagtctatatcaagagttagcagactgcatttcataggccaaatctggcttgccatttgcttttataaataagttttattggaatggaattactttaatttgtttacataatatatgtgacttctttcacacttcaagagcagagttgagaagttgtgatagaagccatacatcccacaaagcctaaaaaatgtatatttactaaatatttgtgtctgcctctgcaaatactctaagctttttagcagaagatattctaacatgataccatgtgttaaaaaccatataatctgaaaatcaaatgaggtctgtagtctagttaacagtgtaccactctcaatttcctggttttcgatattgtgctatatagctacataacatgtcaccattagaggaaggtgagtaaaaagtatacaagagtctatatttttgcaccttcctgaatctgtaattatttttaaaaccataatataaattttatatggaggtaaaattatgtgaatattacgaactaccgcatacacatctatgagagtccatatcagaattctaatatctttagatcaccctaaatgtactgatagtattatttacttttttttcacttaggatgttgcatattctctaagtttgagatataatatagtagtttgatttttttgatgattaaaacgagtaatctatttttatgttgcaatttatatggtgaagttttgattttataatttttatatacttttaaaattaggtatttatgatgatgatcctgaaatcataacattggaaagaagagaatttggtaagtttgtgggcttaaggttttataaaactaatacaagttcgatctcatctaaaactctaggggatatatatgtttgaaatttagaaatcttttggagtttcgaacagtaataatgtaatatactgtatcttaaatatttctagcagaatgtggggaagtgtaccataataaaaacattaatatttatgtagcaaaatgtgtaagtatatatactaaataaaagaaatttaaaaatcagttcagatcaggtttggatgccaagtgagcttgctgcaaacttacagcaaaacttctcagagctttttgattttagagttttggataaaggtatagttattttggaagtagatttaatttgattggcaactttgtgtgaaaatggccataaaaatacagttctgcattttccattgcattttagaaaattgtataccagaatagattcttatactttcatcctttgtacagtaataataggtttattttttctatttcagagcaataaattaaacttcaaatcaaatttcaattttatattgctctatcacaattgtatttaatttagaaaactaaaatacagccaggcgcggtggctcacacctgtataatcccagcactttgggaggccaaggcaggcagatcgcttgagatcaggagttagaaaccagcctggccaacatggggaaaaccctctctactaaaaatacaaaaattaggtgtgcctggtggcacgcacctgtaatcccagctacttgggaggctgacgcacaagaatcgcgtgaatctgggaggctgatattgcagtgagccatgatggcaccacaaaaaaaaagaaaactaaaatagcgtaccagtcgcaaaaaatacatataaatctatatgtttttcatatattatcgttaaaaatttattacagctacttgattttatacagtttgttccttctaagcaagggtggcttttttttttttttttttttgagacggagtcttgctttgtcacccagaccagtgtgcagtggcacgatcttggctcactgcaacctctgccccctgggttcaagcgattctcctgcctcagccttctgaatagctgggattacaggtgcccgctaccacacccagttaatttttgtatttgtatttttagtagagacaggatttcaccatgttggccaggctgatctcgaactcctgacctcaggcgatccacccacgttggcctcccaaagtgccaggattacaggcatgagccaccacatctggccaagggtggcattttaatcttattttctacatcatgctggtgagcttcacatacaaaatagctgttcaatgtgttactttgttaaaagccttctaggtgaacacttgaacatgttctaagtgaatagaaaatacatctttcctgtgttctgcaaataagacaatttgattcatttggattgttaatagaattaatgctcatgtcacaagctggtagaatcataactctcgtgtgagttatataaacctatagctgttcctgtgtggtttttattgtctctcatctcctaatatatcagtaagtgttttgtgtaccaatggttcagaaaacatcggaattacagatagaggaactgaacaaaacttgcaagcttactaatccatgagtctacctagaatgagacttcactgatagttatattgtatatgggttcacactttttcagatgtgtcactatgcagaaaagcttaagaactgttaatagttcatatagaaccccaaatggtagttcaagataaattgcagccacaaaacttcagagataattcataaataattaaccttgcttgatgagaggaatgagcaggagcattgttgtgatagagaaggaccctctagtgaagctttcccaggcatttttctgctaagcagatgttatcatttctggctctctagaaagtcaacaagcaaatgccttctaagctcttctattatatgcagcataggttaagtaggtttaatcaattctgacagctactgtaaactctgaaagaataaaataagagacctacataatacagtaaggattgcggggattaaatttaatataagccctaaataagacattaccttggaaaatcactttatttgaaaagattgacttttttttaacaattcaaaacattaatacatacttgctaaaattatagatttgaacatgtgatatctagccaatagtgcagtttatattttatctgtaaaatgacctgatgcaaattacaaattttactcacttaaaaaatttaacattgtaaaaatgtgctttcacattcaagataaaaaggcgagggtaatctgcttttggttaaaggatttccatatgattccatgttaaaattagttaatattttaaaataaaaatttcagaaattacagtaagacattaaaacatgcatggtattctaaatacgtgcaactaattcaggctaattagaaacaggtacaggactcagtgttcacctacatttcaagtataagatagacctgtggggaaaaagttaatctgtaccttacaggcaaagtaattacattttactttgctaatagaagctgttaactggagttgtatgtatattaacagacagtagctgtagttgtatagtttagaagtggaaagttgcattttgaaatgtaataattctattctgggtcactgttaggcacaacatcccattgagctgtgatgatacagtatttaaaatattttaactttattcttattactcagcaatcagtgggaacttggcaaatatgagaagtgctcgatgaagacaaagtacaggtgtacctcattttattacactttgatttattgcacttcatagataatgcacttttttttccttaacaaattgaaggtttttagcaaccctacatcaagcgagtctatcagctgaacgtgtttccaatagcatgtgctcatttcatgtctctttctcacattttggtatccaaactttttcattattattctgtctgttacagtgatctacagtcagtgatctttgatgttactattgtaatcattttggagtgtgcccataggatggcatacttaatttttgtgtctattctgactgctccctcttccttctcccttttctctcccacttcttgggcctccctactccctgagatacaacattactgaaattaagccaattaataactacagtgacctcttaagtgttgaagtggaagagatgcacatctctcattttaaatcagaagctagaaatgattaagcttagtgagggaggcatatcaaaacccaagacaggctaaaaggtagacctcttttgctagttaaattataaatgcaaaggaaaagttcttcatggaaagtaaacgtgctactccagtgaacacactaatgataacacaaaacagccatactgctaacatagagaatgtcttagtggtctgggtagatcaaattatctacaacatccccttagcgaaagcctaaccagagaaagaccctaattcttttcaattttatggaggcttagagagatgaagaagctgcagaaaaaagtttgaagctagaaaaggttggttcatgaggtttaaagaaaacagccatctccataacatcaaaatacaagatgaagcagcaagtcccgacatagaagctgcagcaagttttccagaagatctagctaagatcattgatgaaggtggctatactaaacaacaaattctcaatgttaatgagacagccttccattggaagaagatgctatctgggacttttttttcatgcctgctaacaccatatccattctgcagcccgtaaatcaaggagtaatttcaacttcaagtcatattatctaagaaatacatttcataaggctctacctgccataggtagtgattcctctgatggatccaggcaaagtaaattggaaaccttctggaaaggagtcaccattctagtgtcattaagaacatctgtgattcatggaaggaggtcaaaatatcagtgttacaggagttgggaagaagttcattccaaccttcatggatgactttgaggtgttcaaggcttcaatggaggatgtaactgtagatgtgatagaaatagcaagagaactggaattagaagtggagcctgattatgtgactgaattgctgcaatctcattataatgatctcattataatataattatctcattataataatctcaccatggggcggtgaggagttgttccttatggatgagcagagaaagtgatttcctgagatggaacctactcctggtgaagatcctgtaaacaatgttgatatgacaacaaaggatttagaatattacataaacttggttgataaaacagcagcagggtttgaggccagttttgactccaattttgaaagaagttctactgtgggtcagatgccatcaaacagcatttcacgcttcagagaaaatctttcaggaaaggagacatcaatcagtgtggcaaacttcattgtcatctcattttaagaaattgccacagccaccccaaccttacacaaccaccaccctgatcagtcagcacccatcaacatcacgacatgcatgacttgctgaaaggctgaaatgactgttagcattttttaccaataaagttattttttgttccttggttggtttgtcaccccacctggagagtgcagcagcaggatcatagctcatcacagccttgaactcctgggctcaagcaatcctgctgcctcagtctcccgactagctgagactgcgggcatgtgccaccatgtccagctatttttatagagacagggtcttgctgtgtttcccaggctggtctcaaactcctgggctcaagtgatcctcctgtctcagcctcccaaaaggctagatgacaagcatgagccactgcgcccagcctattttctaattaaggtatgtacattgttttgtttgttttttttttttagacataatgctattacataatacactgtatatagtgtaaatataacttttatatgcactggaaaaccagaaaatttgtgtgactcctttatagtgatacttgctatgttgtgatttggaaacaaacccacaatatctgaggtatgcctgttaccagggtaggagacatttttactacaagaaaggttttgtgtcaaataccattcaaatttgttttacagcatatttttatttaagacttatgaacagtaataccttgtgtaattattgctttctatttttatataaaaataactacctcattacttgtttatagctgataagataatcccttctttcattaaagtttgcattaattctgttaatatttttacctaaatttgtactggtttgtggtctaaaccaatatggcaattttttcgaccacctctatagaatggtcatttgccagactttgaaaacattgccaaagaacagcccatagtcctgaattacacactttgcctgtaatgtgtagattaactgttttcccacaggtctgtcttatacttgaaatgtaggtgaacactgagtcctgcacctgtttctaattagcctgaattagttgcacgtatttagaataccatgtgtgatttaatgtcttactgtaatttctgaaatttttattttaaaataataaattttaacatggaattatatggaaatcctttaaccaaaagcagattaacctcgcctttttatcttgaatgtgaaagcacatttttacaatgttaaattttttaagtgagtaaaatttgtaatttgcatcaggtcattttacagataaaatataaaatgtactattggctagatattatatgttgttcaaatctgtaattttagcaaatatgtattaatgttttgaattgttaaaaacctcaaccttttcaaacaaaatgattttccaaggtaatgtcttgtttagggcttagattaaatttaatccccgcaatccttactgtattatgtaggtctcttattttattctttcagagtttacagtagctgtcagaattgactaaacctacttaacctgtgctgcatgtaatagaagagcttaaatctcagtcactcttactatttgtcttctttatttctctcatgcacacaaactcttacgtgaggtttggctgctatttcttgtgccgtcactttttacaactttatggccatatttatcttgcagtttgaggctgcttctttttcaagtatgggcgtaggagagtttttttaaaaagctattgttggtttgacatttgaaatgtttcttgtggaaaaaaaatttttaattttttaaaaatgtcatttatgtagaagatatagaaaaacatcacacagaaaatgagaaagacaatatgaaaattgcatgactttttaaaattctgatctccacaaaaagtttttaactaaaatatgcatgaacctttaataaataattctaagttgtttgcattttatgtatttttagatgctgctgttaattctggagaactgtggtttgtaaatttttactccccaggctgttcacactgccatgatttagctcccacagtatgtatttttcacatcctcattactagttttatttctaattgatctgcaatttatatgttagaatttttttttctatgaatagtaatcaaaaataattatcaaatactttaaatgtctggtttaaaaatatatagcttggagtgtgttcaagggaagaaaagtggtcttatcagagaaatatgttttctttttctgtcatagtggagagactttgctaaagaagtggatgggttacttcgaattggagctgttaactgtggtgatgatagaatgctttgccgaatgaaaggagtcaacagctatcccagcctcttcatttttcggtctggaatggtaagggataaagttagcattttttaaatttgtgaaacattatgacaagttaaatagtagagaaaataacagtatgtagaatttgcagaacattttaagtcttgttttacaaggtgccatctcactagtcttctgtaataataaacattttggattatgaatttttttttttgagatggagtctcactctgttgcccaggctggagtgcaagggtgcagtctcggctcactgcaacctctgcctcctgggctcaagcagttctcctgcctcagcctcccgagtagctgggactacaggcacccgctcccatgtctggctaatttttgtatttttagtagagacggggtttcgccatgttggccaggctggtcttgaactcctgaccttaggtgatctgcccacctcagcctcccacagtgctgggattacaggcgtgagccacagtgcctggcaaaaaaaacaccattgactttgctatattttaaaattaaatgtttgccaatttcagtttctgtcttaaggaacataatttatacaatatgtatattgtatttggtagtttacaaagtattttacaagtgttgtctcattgaatgtaaagctctgatatcttttttcttagtttccagtgaggaacctgaacgattataaatggtattattaaaatgtgttccatagaatctgtactgtcaagattatcaggatatcatttggaaatacattctgctattgagaaatagagctttgctgcattattcaagataatgtaaaaatcaaactctttggtattatttttattgagttttaaaaagaaaaagtaaaagatgtttctcttcttacaaaaaccaataggccccagtgaaatatcatggagacagatcaaaggagagtttagtgagttttgcaatgcagcatgttagaagtacagtgacagaactttggacaggtaattttattttcttaatttgcttgattttcagggtattttgaaatcagtattttgtttttaatggcaatattaacattttggtcatggtattgaaattttaaagtgtcttttccatgtttcttagaagggaattgtgtcatttactctgaactctgctgaatttaacaaactagttaaatttttacagaaacttgaactatcgagatatgggaaatggatatgagatagggctacggtaaaaaaggcatctctcaaagtgcaaaaaatgttttgtaatacaagtgttttattgcttttttaaatatgcttatcaatcagtaaattcaaacctattctgtttaattttaaagtttaaaaatgcttctaatcttaggcttttaactcattaactgcctttaggcagattaagctaataatagtatttgtggctcaagatgttcattttattcattgagtaaagttacgtgtcagaaactattaaatagtggggctgcagtaataaaatatatagtccctgccatcagtgacttcattagtgaggaaaacattagtaaacaattaaaatgcaatataggtactattattatagagcttaagggagcataagatgtgtaaaacaacccagttggggaaaagagaaagagttagaaaatacttcttgaaagaagtcatatccaatctgtcatgaaaatgaataggaagccttaggagatcactgtgtatttggggaactggcaatacttcatgaatctgacaaaaagatcaataattgggtcaagtggtgtggggaaatataatatagctggctaaataggtaggcaaagctcaagtcacaggggcctaacttgccaatttgagtttttttcttaatgaaataatgaatttaggttttatatgatgaaaaaattggagagccattgaaggaatttgtcatactcaagagtatctttggaaagataactggtaaaactcagagtggattagaagagggtgagattagaaaggaaaaattacttagaagactgtttccattagtaaaggagtaataggtgatcagaatttgctttttttcttttatttttaaggaaattttgtcaactccatacaaactgcttttgctgctggtattggctggctgatcactttttgttcaaaaggaggaggtaatactattttttaattttgttggaatgagaacatgacatttaaatttttggtgacagttttaagtatgctactgtaattgattattaagtactagaaactacaatttatgcccaggattacaatttttttacttaatgaatattcgcctttttcattattttacacatgaggttattattcattttttaatgtatcctctatgtttttatgttcagtggaccagtttttcagcttagactcatgataaattgtaccttcagatagccacagatgttatttgacaatttgcaaaaataactagttgtttacagctctaacccctcccaaaataataattttttggaaatatggactttgcttcatgcttatatatatctctcaaacatacatagatttgcctcatacaattatatacttgaagatgacagcttcttctaggaacctttccttgaataaattaagttgaaaattcagtactctgcatagcaagccgtaaactgtaaactgtgttcaagcaatgtggttggttaaaaattgttctaagacaacaaaatattataactcaatgtatttgcatgtatttaatcccaacatgagtcttctccccacatttcatctctcagccttcatgctgctatattgaaaaggtactgccttgtaactaaaatcaacccattaccccatcctgtaaggcctatgctagaaagacactgccttgcagcaaaacgtcagccttaaacttaactaatcaccaagggattttgtctcattttggcctattgcccaaatttctgttcatccacacatgaacaaaagttcttacattctctgagattcttttacttctcacctcaagtaaattgcttctccctgtctttgtaggctctgtgatgctatagctctctttcttctaaatcttctctcattgtattctagtgttcatatttgcagaactttcataaaaatagtgaaggcactatttaaagattttattgtattttgaggatcctttatatacttctatcaaatatctattacattttatttccccccaattttgagatctcttggataaaatggattgttgataggaggagagattgagagtattaacctaaagagagaaaattactttttctctgtagctagacatcctagaaattaaagggagagaatgaaagaaagagggagcgagggagtgtgtgtgtgtttttgtgtgtgtgtttgtatgtgtgtgtgtgtagaaggatttccatatctatcaatagagtccagctcaattaattgccttcgaatgaacatggtaatttgggggaaaggcaaatgcaagtattttcatcaggcttaataaaggtaaaactgcctcataaggtttttttgtccccagattgtttgacttcacagacacgactcaggcttagtggcatgttggtaagcatcaatcattttgtaaaactatatcaccatgtaaagaaacacatttagaaattgatttgaaacattttcttcccttatttcttgaacatttaactcacctatttgtaatcttattttctgatgactgtattcatagctatgtgttttttcctgaataattagttacgttcaataaattttaacgtggtatcaattctaagtgtcatttactttgtaagtattctgtaatttataagttcctcttcaactgaagttacatgttagtgtttttgtcatttcccaactttatcttttgttgttttcttttttagtcatttttaaatgtatatagctctcatgttatggctgggaagtagcctgagtgatgttgattttttaacaccattgaaataccctttgtggctttgtggcttgacaaagccacacaaattgtcagttttgaaaattttggaaattctttgtgagcttgaatataataatgttatgttaggtgtaatatatgttaggtgtagtattacatttattagatcagatttattaatcatgttatttgtttttggactacatgatctataatttctaagagggatgtattaaaatctctaccatccatcattgatttatctatttcttatatttctgtcagttcttcctttacatattttgacattatattgttggcagcagtatgatcattatatcctttggcggctatttatttctctttgtgcattatggatttgtttacacaaattctgttttatttgatattaaaatcactaacttagtatgcttttgtttcattccctttcttatttcaccctatgcctaggcctttagtttttcagcactacacattaaaatcacctgaggagcttttaaaaataataaaaaaacaaaaccatgtcccccagaccaattaaatcaaaatattcgagggtgaggactgagcattagtatctttattttttttttaatatttggtgatcagagtgattggcctatatttttcctttccagtaaagtctgtgcacttttagcatcaaagttaggctggcctttaaatgtgttggaaagtattatctctttttctcttctttggaaacagtttctgtacaactgttgttatttctttctcaatttttttttttttttggtagaatttatcagaaaaccatctgggcctgaagttgtctttgaatccatatttatagacttttctccaatctctctcagatagatagatagatagatagatagatagatagatagatagatagattttctacttcctctatttggtaaattctgtttttctaagacttcgttctttgaagcaaatgtgtaaatgtattgctataaaattgtacataatatcctatttttttatatctgtagtatctatagtgatgttctttcttactttctgatcatattttgtgtgtgtgtctcatgtctgtttttattcttattctgtccaaggagaggtttcttaacctttataagtcttttcaaagtctcaagtttcagctttattgatttttttttttttactgccagtttcttgatttcattgacttaagcactatatttccttccctctacttttttatgatttaatttgctgttcttgaatgattagttcattgatcttaggctttcctttctaatatatgaatttagattataaattagtgactacagctttagatacatcttctattttgatatatatatatagtattttgattatcagtttaaaatattttttaatcttgatttttatttctctttgaatcacagattctatattttttgttcctaatcataaaggttatttttaaaagtaattttgttatttttggctagcttgattctactgtggataatgaacatggaatcagtttttttaagttgttaagccttgtttcatggcccaacatatggtaaatttttataaatgtttcatatgcatttgaaaatgaatcctgtaattcacaggtacacatttctataaaatcagttgggtccaatttgttagctatgttaatcagatcctctagatcttaataattttattgtctgcctattctatcaataactgagagagtgtcttaatatcctccactactttgtggatatttctatttcctttgtttctgtcaatttttattatctattttgatgctttgttattagatggatattaatttagaattgtatgttttcttggtgatttgaatctctaacctgatgaaataaccctctttatctcctttcgtgccttttgcctccaagtctaccttgactgataactaatatagctacaccagctttcttttgtttaatgttggcatttttccattttttactgtcacccttactgtatccttatatttattgcctgcaatcagcatgtaattaggttttgtatttatctagttgctattttttatcttagtccatttacatttaatgttattcttgatatatttggccctatgcttaccatcttgttagttttatatttgtcctacctgttttatagtccttttttctttcctttttgcttcttttggattaagcaagtgatttttaaaatttcatttcccatctctactagctctttggttacctgtccttttattgttcatttaatgggtaccctagaaattttgtacatgtatcctgacttactcatttgctacctaacgcaagagtactaaacagaaattattttactacctctgaaactttgctgttatgtattctaatcaaatatgtttttttctaagttctgtcttaaatgcagtaaagtgaatacatcttaaatgtacaacttaatttttacatatatatgctcccatgtaacaccacctagatcaagatctattctttcttagcttttaattgtttgtgattttctgaagtttcattatgatatacataggtcttgagtttcttatttattctgattgagattaactggacttcttgatcactgtaggttaatatctttcatcagttgtggaaacctgtcagctggtatttcactttttgtttctatctcattctcccttatctttccgagatcccagttgaatgtatgttagaactctatttgtttactaacttgcccagtgcagaaatttttttcagtaacttaaggttatgagaaatgtacttttcgtacaggatttttggagctcactaaaggattagcttagccactgtagatgaaaactgggaagatactaatttaaatgcacattgtagacacatacagagaatgtctcataaactgtataattactaaaaggatagccacaatgaaaaatcttaaacagtagtttggtttattttctttaacctgaaagactattggacagctcactttctataaaaattgtaaatgtcgttttttgtggattcgtagaaagaattataaaaagtagatttctactattagggaaaaaccatttctcaagttactaagtacaattttttgcacttaatatttctaaatttattaagtaatttataatattagaaatctactttttaactttgctgtagaactaaggcatgaagttttaattttttggtagaaaaattgtgtttttagctaagtaaagctctaaatccctttaactttttgcctcccatttacaacatggtttgttgtttctttccattttaggatggtcttgttaatgtaggatggatggactgtgccacccaggataacctttgtaaaagcttagatattacaacaagtactactgcttattttcctcctggagccactttaaataacaaagagaaaaacagtattttggtatgaatcactttaaactaatttatttacatataatgtgcaaacaccctcaaaaataatacattatttttgtaagcagtgagcaaagaaatgaacaatttatattgtctgattgtggaacccttatttagaacacatacttaatttctgagattctttttaatacatgcttcaaattataaaatttaaggattatttttaaactgacgattacatttcatttaaagtcattacatctttacatttaaaattaccttacatttaaaaccattatatttttaaaccccaaaagtatggagtacattcctgggttatacgaaagagcatttatagcatgagttttcattgttttctatttaattgtttattttgttttttttgagatggaatctcactcttgtcgcccaggctgtagtgcagtggcgtgatctcggctcggtgcaacctctgcctcctgggttcaagtgattcttctgcctcagcctcctgagtacctgggattacaggcgcctgccatcatgcctggctaatttttgtacttttagtagagacggggtttcgccatgttggccaggctggtcttgaactcctgacctcagatgatccgcccatctcggcctcccagagagctgggattacaggcgtgagtcaccgcacctaacctaattgtttattttctaatgttaaaaatatagatcagtggtagttttggctggggcctaagtatttttctaaagcaccccgtgggattctggtgtaaactcagttttgacatcttgtaatgtggtatacctccttaagtttgagtgaggaaactgaagctcaatctagttgtcaaggagctaagataaatagtgggatattggatgggtcactacggaatcccaaaagaaagtaaggactgtgataagacaaatctcccttagttttccctctgtactttaattctgcttttttagatgttgataaagataacatatactcatttcagaaattcatatatggcacagagctgtaaaagaagatgcaaaattccctaaaaccaaatcactaatagacagccaccatcaaatcttggtaaatacccatccagatctctactgaaatatatatgcaattacgactttgtgccagcaattctctagtttatacctgtgactcaaacctctgttctccactccagatgtattatacacatgcacctatacgtatatgtgtggatgtgtgtgtgtgcttgtgtatgtatatgtgtgtgtgtacatacttacatatcactgctcattcaatatcttccttaggatattagtcagtgtctcaaatttaaatgcctataaccatattcccaatatccctccataaatctgcttcatccagttttttcccatattatttgatgaaaactctgtcctttattattcaagccaaatgccctggagttattcttgatttctctttttctcataccttataaccaattcatcaagaaaatctatggctttatctttaaaatgtgtttatacacatcaaatggatggatggatacagatacgtaatttttcataaatgggattgcatagtagattctattttgtaatctagttttttcactcagtgtatcaggaagatgctttcttatttaaaaaatgtacattttatatgcatactttatcattttataaatgaatatgtatacattatccttgaagtaattaatgatccctggatggtaagtcactgactagatgtgacatacttagtttaatcagttctttcttggtgtgtgtttctactttctcaagatgataagcagtgttgtaatgagcaatcttgtatctttatccttgtgcactttttcagttatctgtttagaatgggagcattgtggccattttaaactcaattggtattgccagattgccctccggaaaagttgtactagtttattctgtgccatccgtcaacaaggattgcctacaccctgtccaacaatagagcctcttgccttgagtattataatctctgggcttcatgatagaaaattacaaggtcaaaggctgtctgagacaggaaacagaaatgagtgactctggaaatgtaataacagggagtggtgaattaaacattacttgtccctccccaaaagcagtcaggttttttttggtttttttttttgagacggagtcttgttctgtcgcccaggctggagtgcagtggtgcgatctccactcactgcaagctccacctcccgggttcacaccattctcctgcctcagcctcccgagtagctgggactacaggtgcacgccgccacacccagctaattttttgtatttttggtagagacggggtttcaccgtgttagccaggatggtctcgatctcctgaccttgtgatctgccggcctcggcctcccaaagtgttgggattacaggcgtgagccaccgcacctggccgcattcaggttttaaaaaatataaaacagtatgccagctaaatatatctggtaggtggaattcagaggctagataagacagcagtcctttataggtgtaactaacaaattctcctctaacagaaacaggtttataatgagattctagtagattaagcactgcaagtttatataggctgtgtaataggcattttagtaaaagtcttcatagtgaataggactaaagtgaataagatgtagaactgaggcgtgaaagatttgttatggcattttaagctctttgatagcaggaactatttcatatagacctctaagaatgtttatgatatatatatatatatagtatatatcatatatatttatatatatttatatatataatatctcatatatatttatatatatatatatctcatatatatatattcagttttaagaaaagaatcttagggaaaaaacctgaatttttattcttatgttgtacctattatttttagccatatgtttgttctcatgtctagcatgattaaactgtggattccatgattgttcgtacaagtttttagtgaattttagatctttcaagtaatacttaaactgttaaacatagatggttcataattaaagacatatattaaactctgttttgtcaactttcatatacattttcttgatgtaaccattgctgcattctttataataacagctgcttcattgagagaatcagaccagcagagagagagagttatatgacaaaatatgctgaggataaaatattgacaaataaagaagatttgttagaagggccttttatactcgtttgtgttttaaataagagactcgggccgaaaacaagtttaagataagatctgtatcattgtattttactctaaaaactcctaagtggtttggtttttagatgaaaacctctataatgagcaaaagtccattccaattttccacttctaagttcctcttaattaatcttaattattggttggggaatgaagtgtctttgatagtctattattcttccttctagtgttataaaaattcttaagtgaatgtgtaaaacattggcattctgtaaaacatgattagcattaaaattaagctaaagataatgtggtttttcttgatgattgggaggtcactcaggatttttctgagcatttttatagaatacacatcatagttaattaaaaattccagttaatgcaacatcttataatggaatttattgtatatcactatttaagaaacagcttagttatataatatttttgataattgccaaaatacactttttttgaaaaaagacatttggaattgtttgaaaaactatttaccttctataatcattttcctaaaaatactacattggaaattgaaaaaacaaaagatatcaaatataatgaatatttattcaaaaagattacaatgtgattttctttttctagtttctcaactcattggatgctaaagaaatatatttggaagtaatacataatcttccagattttgaactactttcggcaaacacactagaggtaatgtttttattaataatgataagtagcaatgaatgttcgtaacatttcaggtcttaacattttaaaattagcatttgttttattcatctctagagagaattgaaagtagcagtttcaaaggattatatattagtcaattgtaggttaaattctaattggatatctggtgttgctaattcaggatggatctgtagttctggaaaacctactcagtcctgaaggtgggcttcaaaaggaacatcagaaaaggcagaattttaatcagagcaactttgggtctgattcataactttttgttcttgcttacagaacggattatattgattactaagaagaagtattcagtttatggatagaatgctgagaaatattgcttgtggtagaatcagttttttttcctattaggttggtgcaaaagtaattgcagtttttgccatttgaaagtagtggcaaaaaccacagttacttttgcacaaaaccaaatacttcctaaccacagatcttttgaagtctgtatcactacgagatcttatgtgctaagcctgaaaaagctgacaactttgccacccaactttttagctatatgctgttaaaatcatgtatttgtttttggcagtcatctactttaagattttataatttagtgactaaccctcctgtaatatttgttgattttacatagcattattctaagtaaactacaaaataagagaatgagtgggtccgaattttagacagtattttgaaataatgggtaggggagctaaaactaacttcaagtcatagaaatgaagattagaacccttagaatttcccatctctgacattttgttttctttatcacttttaaggatcgtttggctcatcatcggtggctgttattttttcattttggaaaaaatgaaaattcaaatgatcctgagctgaaaaaactaaaaactctacttaaaaatgatcatattcaagtaagaaaaatgtattctgcctagccttctgctggtgtactttgttgttaatttaatgcatataattaaattttaaataacataaaaactcttatttgaaattataagaagcctataagtgcttttagtcttggtttgtgcttgcttttcctcttttttattaaaagtttatatgtaatctgaaagtggttaattttcacttattttggcatttgataaacctgtatcatacaatttttctggaatgcatactgtaggaggttatctttccattttttaaattcttatttctttatataagtaattcttggtcgttgtttaaaaatcaggacaataaataagtacaaaaataaagcaattatctaaaaaaatcacccatactcttaacattgttcataaccctgctatgtatttactctatataaccatttaaacattttgtgagtgcccatatgcatatgtaggcatatgtatatgtgtgcacatgcatacatattgtaatggccattgtaatagacatacacgtgtaaatttatatgtctgtgttttaatcaaaatggattcactgtatgcttttttttttaacttctgtcatacaacaatatcataaactttttcacagacctgtaaaaatgcatatatatttatatggatataaaatctctatatccatgtacacatgtatatcctccttattccctaaaggctacatagtggcttactatatggttatgccataattgtttaggaaatcctctcttactgattttatgttgtttcctttattttttatatcaaacgatgcagaacttgtctttaatatgggaaattttcttctcttttcttttgagacagagtcattctgtcacccaggctggagttcagtggcgtgctcttgactcactgcaacctcagcctcatgggttcaagtgattctgggttccagtgattccctccagagtagctgggactacaggcgcatgccaccaagtccggctaatttttgtacttttaacagagactggatttctccatattggccaagctggcctcgaactcctgacctcaggtgatccacccacctcagcctcccaaagtgctgggattacaggcgtgagccaccacacctggccacatgggaaattttcaactcaaggttatgttttcttaaatggtttttattctcattactagagtcctccagaaagttttatcagtttataatctcactgacagcacgtgagtggccatttctccacgctgtgcccaccatggtactatcgttctttataatcttcacaattccgataggccacaagtgatatgttaacaatattcactttcatttaattgctttcaactggtcggggaaaaatactttttcatgattattaacaaatcataattgttctctagttaattttctctttatatctgtggcccattttcttttttctgatgggatgtttgtccagctttttctttgtttttttttctttttttttaatgcagtgtagtgtcactctgtcagccaggctggagtgcagtggtgcgatctcggctcactgcaacctccgcctcctggattcaagcagttctgctgcctcagcctcccaagtagctgggactacaggtgcaagccaccatgcctggctaatttttgtatttttagtagagacgtggtttcaccctattggtcaggctgatctcaaactcctgacctcaggcaattcagctacctcagcctccccaagtgctgggattataggcatgagccaatgcgcctggcccttcttgtttcttaatggatcttctctcttaaatgccacagatttgttcctggtttatatttggctgttgtgcttacgctcttctttttcacactctttgaaaacatcacttttttcttcattatttctgcttctgaaagtgatctctcctctatctcaagattatataaacattctctacatcttcaaaaagtaggtttctggaataacttcatattttcttgggaattcctcaggttttttttaactctctaggaagcatttttttaactaaattgagtcttaatattaaatgtaaatgaattatttctgtctcttattttcgtagcctattagcttctgtttaaaaactgtgtcattagggcagtgccatttttggattatcatgaatatttacaaatcaaatgggtaagacagtgtttttatcaaatttgacctttttctcctttaggttggcaggtttgactgttcctctgcaccagacatctgtagtaatctgtatgtttttcagccgtctctagcagtatttaaaggacaaggaaccaaagaatatgaaattcatcatggtaagaatggaaaaaaatgataaaaaaaaacttagcttcattttcaaatagaagttttctaattgtgctttttaaacttattttttacggacatgcttattgtaaataacttttctcagtaaatatgaggacagatattttgaattatatgtagtcactttattctctttacccttctttttaacatgaatgccttttctctattcagtattttgatcaggatttctggtgataagtcaagctagtgagaaatttaagtcctgcttgtttgcaaaagtaagcaacacctgcagtttatattccagcttgccatgtgtatcatctcagccattataggcaatttccaaacattcttttggatgtttctcccactagacttccagacttcttcattaactgccttgttatctttcttgcatttataattttatttcagcttatttgggactttagctctgcattcatgtgagtgcagtctcaattccaagagtttggactacagcagagtccttgtcctgaaagaggtcaaatatagcaaaagaaacacacagactaccaactaccatgcagttaagtgaacaacagataccgatgaaatgcccattagcacctagcactgctttcaatgttgaggatataaatttgtaagacatgaactccttcaagaagtttaaaatagtgtagcggggaacagaggagggagatccataagaaaacaaaaaatactttaatggtcattgtatattaatgacaacaagatcaaatagatttctgcatagtagaggtcaagaagtggtatttgaattgagcataaagtgctcaatttccccaagcaactataggggaaaagaagtgagacctctaggctggaggaactttggggtaagataaccctcacagtaactactgtttattcactgctgtctccaagtcagacattctgccagaagccttgcatacgtgattcatttttatctttacaacagcccagtgaaggagaaaatggagactcagaaaggttaagtaacttgccctatgacagacatactagaaactagccatggtagattttgaatccaaatttgtctgactccaaaacctaggctaatagccgttaaactataccatgcactaaaagtgctagaaatgactaagttttaataatggaataatactcttttttatctctgaaatagttctcagaccccccctcttctcttctctgtgcttactgctttgtttcaggcccatcatcgccttcatctatgatagtattatcctctgggaggattgcttatctcctagcctttcttccttaaaatcaattccttgttgtgtttgcagttattacccattcttgtgtcacttttctgccttgacttaccttatttcttatagcataagcgtcagattccttagcatagaagcaataatctcatctgttttgctcactgctctatctccagcacctagaatggtgtctggcacatagtaagaactcaggaaatgtttgttaagtggatagggtatgttcacagtctggctctgccagtttttccagtcttaattcccactgctgcccctccagatagtcttagctccagctacctttggatgtttgtgaatgccatgttctttcactcctctgtgccttcacacgatttttcctcctgcattataatcactccttcctgttccacagaatatttagcaaactccaaattgcctttcaaaacttaaagcagcttcttccctggaaaatatattatgaatctccaagcacttccttttatgtgctcttactaactttgtaatagaacttacattgtttctttggattaaaatagttattgagcatctgcatgtaccaggtacagtactgaggaataggaaaaaatgtgaactatacttagtaatctctaatacaaagaacattgtggactattagggaaaacagacaagtaaactaacaaatttttattttttttttttatggacaagttttttttttatttgaatttttttttaatttattattattatacttcaagttttagggtacatgtgcacaatgtgcaggttaattacatatgtatacatgtgccatgctggtgcgctgcacccactaactcgtcatcgagcattaggtatatctccccatgctatgtctccccactccccccaccccacaacagtacccagagtgtgatattcccttcctgtgtccatgtgttctcattgttcaattcccacctatgagtgagaacatgcagtgtttggttttttgtctttgcgatagtttactgagaatgatgatttccagtttcatccatgtccctacaaaggacatgaactcatccttttttatggctgcatagtattccatggtgtatatgtgcccattttcttaatccagtctatcattgttggacatttgggttggttccaagtctttgctattgtgaataatgccgcaataaacatacgtgtgcatgtgtctttgtagcagcatgatttataatcctttgggtatatacccagtaatgggatggctgggtcaaatggtatttccagttctagatccctgaggatctagactgacttctacaatggttgaactagtttacagtcccaccaacagtgtaaaagtgttcctatttctccacatcctctccagcacctgttgttttctgactttttaatgattgccattcaaactggtgtgagatggtatctcattgtcattttgatttgcatttctctgatggccagtgatggtgagcattttttcatttgttttttggctgcataaatgtcttcttttgagaagtgtctgttcatgtccttcgcccactttttgatggggttgtttttttcttgtaaatttgtgtgagttcattgtagattctgcatattagccctttctcagatgagtaggttgcgaaaattttctgccattctttaggttgcctgttcactctgatggtactttcttttgctgtgcagaagctctttagtttaattagatcccatttgtcaattttggcttttgttgccattgcttttgttgttttagacatgaagtcctttcccatgcctgtgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtatatatgcggcgttatttctgagggctgtgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaggcattggtagcttgatggggatggcattgaatctgtaaattaccttgggcagtatggccattgtcacaatattgagtcttcctacccatgagcatggaatgttcttccatttgtttgtatcctcttttatttccttgagcagtggtttgtagttctccttgaagaggtccttcacatcccttgtaagttggattcctaggtattttattctctttgtagcaattgtgaatgggagttcactcatgatttggctctgtttgtctgttgttggtgtataagaatgcttgtgatttttgcacattgattttgtatcctgagactttgctgaagttgtttatcagcttaaggagattttgggctgagacaatgtggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttatggagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccacttcctccttgtacctgtggtagaattcggctgtgaatccatctggtcctggactctttttgtttggtaagctattgattattgccacaatttcagctcctgttattggtctattcagagattcaacttcttcctggtttagtcttgggatagtgtatgagtcgaggaacttatccatttcttctagattttctagtttatttgcgtagaggtgtttgtagtattctctgatggtagtttgtatttctgtgggattggtggtgatatcccctttatcattttttattgcatctatttgattcttctctctttttttccttattagtcttgctagcggtctatcagttttgttgatcctttcaaaaaaccagctcctctttctgctagcttttgaatgtgtttgctcttgcttttctagttctgttaattgtgatgttagggtgtcaattttggatctttcctgctttctcttgtgggcatttagtgctataaatttccctctacgcactgctttgaatgcgtcccagagattgtggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgcactgtggtctgagagatagtttgttataatttctattcttttacatttgctgaggagagctttacttccaagggtgtggccaattttggaataggtgtggtgcagtgctgaaaaaaatgtatattctgttgatttggggtggagagttctgtagatgtctattaggtctgcttggtgcagagctgagtttaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattaggtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcagactgatgggtcttgactctttatccaatttgccagtctgtgtcttttaattggagcatttagtccatttacatttaaagttaatattgttatgtgtgaatttgattttatggacaagtttttaaaagtgtttgcagtggagagtatttattgtctattgcttagtagtaaattaccccaaaactcagtggtttaaaacaaacatgtattaattcacagtttttcgtggtcaggaatctgagaaaaatttagctgggtagttccagacacggattttctcatgaggttgcattcaaaatatgcaagggctgtggtcatctgaagtctagactggctacagggtctggttccaagcttacttttgtgattgtcaggaggcctaagttcctcactggctgttggcagaggcctcagttcctcatcatgtgggcctttgtagggctgctctcaatatggtagctagcttctgtgatagtaacagagatgaagagaagtagatttgtaaaagaccaagaatgcaaagtcagtattacttggtgactgatgagatgtgtgggaggtcaagagagagagagagagtcaagaataatacctatgtttctgacttgacgaaattgcagttgagtgattgtaccgttcaatgtaagtggactgtggtagcaatgtagaaaatggattagttaaggaagactgggtgaagaaacactagctaggttattgcagaaggccagactgagttcaggcagtagcaatgggttggaaatggtaagagatggaatggatagaattattatgatacagggcagagaaagaagtcaaggctcactctggggaattatatttaggcacctagtggataattatgttattgccaagataaggttggtgagaaaaggagcaggtttggaggaaaataacacagcctcaatttgaatatattgccatgtgtcaacgacagagacgtcttctgagaaatgtgtcattaggagatttcatccttgtacaaacatcagagagtgtacttaaaaaaaactagatggtatagtccactacacatctaggctatacagtatagcctattgctcttaggctacatctgtacaatgtgttacaatgtactgaataccataagcaactgtaacacagcggtaagagtttgtgtatctaaatgtatctaaacatagaaaaggggtaatgtgttgcactacagagttacaacagccacaccatcactgagccataggaatttttcagctccattataatcttatgggaccccatcatatatgtggtccaccattgcctgaaatgtcattatgcaggactgtattgtgtttgacgtgtttacgtgatatccaagtacagtttttcactgggcagttggtaatatgggttttgaattcataagagaagtctaggttgtagaaaatgatttaggagttaggccatagtaatcactgaagtaagcataattaatttaaagaaccctataaaaaagtcattattctacctctgaagatgagggaacatttcaaagagattttgactttttttttttttttttttttttttgaaatggagtctcactctcaccaggctggagtgcagtgtcgagatcactgctcactgcaacctccacctcccaggttcaagcagttctcctgcctcagcctcctgagtagctgggactacacacgtggccaccatgcccagctaattttttgtatttttagtagagacgggggtttcaccatgttggccaggatggtctcgatctcttgacctcgtgatctgcccacctcggcctctcaaagtgctaggattacaggcgtgagccactgcacctggccaattttgacatttttaactagtccaggaaacagaagagtgtgcaagaaaagggtgctcctatcagagctaagccctgtatagtatacagcacactaaaacctcaccaaaatcaatttgttcataatttatcttctttagtattctgagtattaaaactttgaaatgtctctgtgcatacaaaaagcagaatttggatttgaatttctctcattcactttgaaaggaaagaagattctatatgatatacttgcctttgccaaagaaagtgtgaattctcatgttaccacgcttggacctcaaaattttcctgccaatgacaaagaaccatggcttgttgatttctttgcccccgtaagttatttttatctgtcagattctaacattgtcagatcttctcctgttatggcaaaaagacattttctagataactctgaatcattagtacaaaaactgtgtcattccattatggccactaatgcatattgcttttaaatgagtgctaatgtaattactcctccagggaaggtttgccgctaagtacagtttgtcttacttagcatattacttgttgcagaaatgatgggggggttttttgtgtcatttggctcggtgcttatgaatattttttctttcctagtggtgtccaccatgtcgagctttactaccagagttacgaagagcatcaaatcttctttatggtcagcttaagtttggtacactagattgtacagttcatgagggactctgtaacatggtaaggcaaagtatcaaaaattattctaattaattttataaaatgaagaccttttggctgtttattattaaaacattaaaataacttagaaataatacatcttctatttagagtagtaacaaattatttaaacaaaataatatttttagaaagtggtatcaaatatgattggattaaaccatgcatagctaatcaatgcattgaatgtaaataaggtcttatttatcaaactcaggcaactattttcattaacttcataaaatgcttatatgattttccaattattgaagattgttatatttctttaatatttttgacattttataatttttttcctttggctttcttcatacttctaagtatatttgctggaaagaagttaaaacaatgaacaagccttttgaaatctttgtttaaatgaaattattttctcaggtaaatattcactcctcagttgcaggaagaactaaaaattatataccgtagaatgaaagtacgtaatatcacgtataaaatactttgggcaaaaaaaaaaaaaaaatcaatcctatagtagatctatctccagatctattagtctttaggaaattgaatgacaggggagcatgttaagtgacaccatggatatgaaatctgcacttcccagtatgggagaactttacaggacaaatacccagtatatacattgtatatagtggaggagagattaaaaagacttaaaagactatcagtcaaatacaacatttagactttgtttggatgcagtttaaacaaaccaagtgcaaagaaagagataattggggaaatgtgaacactgacaagatatctgatgatttcaggtaattattgttagtttttgacaacaaaaatgatactttggttatatggaggggagtccttatattttaaatatactgaaatatttgtggatgaaattatagatcatctgaaatttgctttaaaatgatcttgggagtagactagaaagggagtataagtgaagtaaaagtagccatgagtcagtgattattgtagctatatgaatacgcgagagtttgttgctctctacttttgtgaatgttctaaataactcataaaaaataaaatgtttttaaagaacatagatggagaaaagataaagggaaaaaagaaatgggaagaggaaggaaaacaaaagaaagccatacatttttagaacatcacagaagtttaagccagcagcaatggcacatgcctgtagaaatttcattaaaatacatttttataaaaggaaataaacaaggcctttggttttgaatgttttctctgtaactttgaaagaaatgccaaccaaagatacaaaattgatgtgataaacaataattatcttaattttaatttctttagtttagtttttttttttttttttttttgagacagagtcttgctctgttgtccaggctggagtgcagtggtgcaatctcagctcactgcaagctccaccccccgggttcatgccattctcctcccttagcctgccgagtaggtgggattacaggcacccgccaccacgtccggctaactttttgtatttttagtagagatggggttttacagtgttagccaggatggtcttgatctcctgacctcgtgatcctcccacctcggcctcccaaagttctgggattacaggcatgagccactgcgcccagccaatttctttagtttttctacttttcatcttagctcattaaacatatgtgagttcagtgtaaggatttaaaactatgatatcgatttacctggaatagaggccaagattcactactcaccaattagttgccactcaccaattggttgactttgaccaagttacttagcctctcagtaacttagtttcctaatttatacagtgggttttatcattttagcaactaagtataattgttgtgaagaataaatgagaaactacatgttaaatgctaaaataatgctcaacacatagttaaattttagctataattgctttgttaatcagtgaattatttgaatttgcacacatttttcaagactaatataaatgtttccattgttttttcaaaaattatttttgaatcctggtcaaagattccagtttgctaatgagtacttaaaactttaagagtgcaaagttcagctacagcaaatccacagacaaggatctctttataactttttgaaaaataaaaataaaagctttagagagaggcttcctgggctggtgcccattttaattctgagaaggaaattaagcatttcctactataaaggctatcttgaagaagaataaaaagggattacattcatagggcatgattcataattctttaacctaaaatataatcatgtaccccctaattatttgtgtctttattcttgctgttttatttcctgatcatcatctatttctagaaaaagtatttattatggtttaaaaaaaagactcaagctagagatatagcctgttgtttatagcctcttcttaccttggttcaggagagtaaaaagggaccattcgtataattacccatgccgatttctcaatgtttcaatgcctatggttctcatggcgaatggagcagctataaataaggatcaggtattcatcagtatttagcagtattcatcaccataagtcctttgctaaatttggtgagactaaaatttttgtcaccagaaatttagaaatgggtttttaaaatcttgttcttgttacttaaaggcaaacttgttataaatttgtaacaaataggtgaaatctataaaatctttaattcatattctccttcctatcagtataacattcaggcttatccaacaacagtggtattcaaccagtccaacattcatgagtatgaaggacatcactctgctgaacaaatcttggagttcatagaggtatttcagattatagactatgtgactagaaatttgtctgtttctatgtaaaccctgtatgaatgtttcatattgtttaataggatttactcttttcatgcccaaactattttcttacaaaatgatttttaaagaatttttctaatgttttactcttcttatatacttgtctgtaaactcaaagtaaatctgtgttttatttgttacctggtatgtacagtgccttataaacaatggacacaattatttattgaacatatgcaatgtattttcaccttgtcacccctttgcactgttttctctgaaaacaagtgtctggcatctacagcatctttttttttttttttctcagtaacactcttgatagaaatacttacaggggactcctagaaaaaaaaaaagaaaatttctagtttattattatccatttgatgaccctccaaccctgtcctactcacctgttcctcctcctctgacgtaatgttttgtcttgttttcccagtgaagctagcctcttcatcagtattacctgactgttgtaggctgaagctttgttaaaatatcatttggaacaaagaatctgtagaaaggtgtagtatctccagtcagaatgtcagaaaaatgagatagtaggctttccactagtaattaaagaatcatttccaaaccagtcattcttggttctagaacagaactttatggcctctgtagacatccaggcagcccttgaaactcttttattatccatgcagaaacttaaagttgcctctttgcctgttatgattttagtgatacatagagataaaggataaatagaccttgattttttacaaaactaatgagcaaaatccaaacttaaaaatctaagttaggtttattttcatattttaagataattcacattggatttcttttagctatccttaagcatcttttggtttctcaaaaatgggaactttctaaaggacatacacagattgagcacccctaatccaaaaatcttaaatctgaaatgctccaaagtctgaatttcatgtttagacttgggtttcattcccaagatatatgcaaatattccaaaattcaaaattctcaatacttccaagtattttggataagagatactcaacctgtaccaacaatttgccaggaatatatgaacagctatgctttatatatatgttataatggaagctatattctcttcaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccgggtatagtaaaaatagtttattttaaatcttaacatttactaagaatgtttatttaacagaattattttgaaacggatgtgaatgaacccacaactaaattattacttaataacagtactgatcataccactttgattccagctctgtttctgtctggtgtgtgaatggtatagcctaccatttttgtgtgtatagcatctggtacactttttttttttggtcgggtagcagggggcagagtctcgctctggagtgcagtggcgcaatctcggctcaccgcaacctcaaccaccctagtagctgggattacaggcatgtgccaccacgcctagctaatttttgtatttttagtagaaacagggttttgccatgttggccaggctggtcttgaacccctggcctcaagtaatctgcccacttctgcctttcaaagtgctgggattacaaacatgagcctccgtgcccagtatatccagtacttttgactaaactgttgccaacaacaacccaaaaatttacctcatatttgtttcaattttttctaatttttttcctgctttatttttagagtttaaaaatatcatttcctgacatactgtaggacttaaaagtaagaaaaaaaagctttcagcatgtgtatttagaaaatttcctgaaaataggcaccatgttttaagttgtagaagattggaaacaaatcacttaaataccagaatggaaaatgcaattactacttcacatttgtttacaagataaaacactaaatctgagttaaagtgatttctagtatcttaacatttaggattacatatttttgtgctcttttcaataaaatttttaagttcaggtgtgagtcagtataacacattagacacctacaaagcttgttttcattggaaagaatactttgaaatattgcaaagactttcattagtttctagcactttgaattttagaagtatatagttttttctcatgtaacagttaaatgaaataaattgtttaatctgcaataattttagtaagtacttaattacaaaattagattacaaattcattagtataaatggtctattatatgttaaacccttatccatttttattgggtaaaagtcactgataaataatataataactgtttcaccataataatacaatgcttatttctttattgcaaacatatgtaaaaagttatggaggtaatctgttttttcttttacagacattaactggactgatcaacgtgggcagtatagattgccaacagtatcattctttttgtgcccaggaaaacgttcaaagataccctgagataagattttttcccccaaaatcaaataaagcttatcattatcagtaagtattctctcatatttgaagacatttattataattatttaattatacacttaacagttaagttacctgaacaaaataaaagttaacccaacaaatatttattgggagcccactacgtaaagatagtttgttaatgaacatttcagaagatgaaaagggagtattgaacagtctcactgtgcataaagcttatagtctagacaaaaagataaggaaaggaagagctaacatttattaagtccttaaacaccttatttggtttcaggtactatattagatactttactcaccttatttccaataatcctcacatatgctctgtgaactaggaattactacccttcctactattacagagaagtaaactgtgattctcagaccttagaatccaaggtctaggagttatctaaggcttagataacttccccaagtcacacagctgctaagttgaagttgaggtttgaacccaagtctgtctcagcacccatgctgtttccacaacaccacgtggtatttcaggtagaaaactcaaatgtaaggtacatatgatgaatgttattaaacaagtaaaaatgaaccatggatttcaagagaggaaagggtcacaactatgaggaaattatgaaaggctgcattttgtaggtagtttttgacatgtgtctttaaaaatgggtaggaatttgacagacagtaataacttgaataaagattcagaaactaaaacccttggacattctgagtttcgcaattcccataggtctacaggagatgtccagtagacagctagacattctgggctgtctggggcacaaagataccaagactagagaaaaatacatttgtgaggccttataaccagaatttgtagctaggtatatttgagaagagagataccagatgaaatcaatcaatataacttattttttaaattgctacaataagattgttttctgaatacatccaataatagagaatcctatttacaactaacattttttcttctctcagcagttacaatggttggaatagggatgcttattccctgagaatctggggtctagggtgagtaattaaaatatatatcattgtataaaatagattcaaagccatttaccccccttttatatcaatagttaaatttactgtgggttaaggttctagcattttaaattacttagtaaagtattatattaaccaagatagtactgtactttattacattgcccttccttgacatcatttttaacttagaaagtattacaatattattgcatttcatatgtttgctttggttttatataatgaaaaatgattttgatcatttgccacagatttttacctcaagtatccacagatctaacacctcagactttcagtgaaaaagttctacaagggaaaaatcattgggtgattgatttctatgctccttggtgtggaccttgccagaattttgctccagaatttgagctcttggctagggtaagtcatacctgtcttaaataagttgtagccacattcatgttttagtaattagataaaacattgtaagtatgtaatttttaggtttttttcttaaatgtttcctctgaatttaaaaatagctattatatttctatgactgtaatggttgtagtagatttcctctttctttgttaaagcttttagctaacatcttctctatcttggtagacatcatcatctactagccataaaagccagaaacgtctctttcttctccctcttgtctactttctcctccccaccccagtactctgttgccctccaggcagttactagattgtgtcagttttatcccctaaatgtctttcaaatgtcatttcttattcatctctactgctaacctgtttcttcaaccctttatcatctcttgtctagacttaaccatatttgccttttaagtgcagtcttcccttgatatactcaggggattggttccaggaacccccattccataccaaaatctgtgcagctcaggcctcacagtgggccctctgtatgcagggtttcacatcctatgactattctgttttccatctgcaattgcttaaaaaaaaaaattcccagttcaagcagttcaacacagttcaagcctttgttgttcaagagtcatctatggtattatactgtctacctttgtcagtgctgccctggtgatcttctaaaatatttccctctctgacttactaagtttcttaatatgcatacattgacttcaggtgtctgatatgagctctatctctattgtccacctcacaccttagattccagtgtaacagagtactccaggttctctgaacatgtgtccttatttacatgccgctccctctctctaaaatgctctgtccttaccttggtcatctgtattttttctcctcttactgcaaaactcagctccgatggcactgctctattctctgcccttctcagttaatcagtgtcacctggatatgttatcaagtgtactgatacagtgcatattaattctttatttattattacttgaaagatatttaatttgaccagaaataaaaggagctggataccaatggaaataattagttgtagcaattttgggttttgttcggttggttggttttatttttcggtatagcattgtccatcttcctttgtaaatggctgtctcttcctgagggcaaagtccatgttttatttatttttatatcctcagggcctaactcagtaaatgcttatataaaattaaactgaatacataccctcaatgcagtctgagcttttggtgtttctttctgtcgtaacagtcttattagtgacctaatccagattgatagctttcttgcctccataactcgaggaactcttgccactagtgttggtataaaacactcaactggaatgagaaagtcagctccagttccaccagttcacactaaagcttagcatcccaggccatgggaattttttagcagagggattttaaaggtcttactagctataaaagattatttttgttattagctggtgcatcagataagaggtttattctttccattctaatcttcttatgcttccttctgtaataattctgctttactccatttctcatgtactaaaaactttagttataaactttgtaatgcaactctatattgtatctagtagaaaattattaaacatgaaaaagaccatttattcaacaaattttaagtaccaaatgaaaagccattatgctaagtagtagggccacgtaactccacatgaaagaaaaggaagatgaaaagaaagaaattccatgtctttaaggagattttaatctagtggaaagagaaaatggaaataaatataagtaatacaagataattgctacagtaaaattagaatgaagctggaacaggggtagaagggtgtcagtgatgccagagaaggatgtttagagcaccagaaacagtatggtgccatctcataagtaattggaaatacaagtaagcaaatatacaaacattttgtaaatgacatagacacttacgaaattaacatttctacatttttcttactttcggtatgcaagtgtgtgtgtctgcctacatgcttgtgccctaacacaagttagtctgcattttagtaaacccctgccttggggacgaaactagaggcagcaaagatattttaagtgtcctgaagtgagaggtgataactttaatcaggattagggcattggtgatagaaagaaggggacaaatacaaaagacagataagaataaataggattgaatgtgatagatgaaggatagagaggagtctggatgagcctaatttctggcttgaactgaatgaatagaacgaggaaaagtgggttcaggggacatgctgtgtttggatgcttatgcggcattcacccaaagcaggccaatgcgtggttagatatgaaatcgaagagaatgattggggtacatcagcatatagatatgtaaaaccaccttgggcacctgttcacagtgaaaagattgttgatcaaagatggaactctgattggatattataacttgaggggcaggtaaaggagatcctcatgctggaaaaaggaagaacagtcagaggggtaagaaagccaagagagagtagtgataaatgctaaaaaagaaagaaaggagtggtcagcagtaaacatcagttgcgcaataagaagaccaaaaagtgcccagtttggtcaagcggtcactggtgaacttacagcagtttcagcagagggagcagtaagcacagaagacgactaaaatgttgccaaataagcagacaatgggaagcagtgaaacagtagactgctgctcaggaaaaaaaaaaaagagagagagcgtgagaagcactatgacagaggaaccataatccaggaaggaatcctttcatgattatatacatcttcactggagaatatgtgttctgacagggagggactggagaatacaggtggagtaagtcagccttcacgagacaaagagtgcccaaagagtcctaccacagcacacccccagtgaaaggagaaaaagatagaaacagaaacatgtttatggtatgatgtgccagtagtgggtggcaggaagaagttgagacattgcaggataaagctgctcagttttcttgatgaggcaaaggagggtttatttgctgttggagaggtggtgctaggtgaataggggcttaaagggataatgtggaaataatcttgtttgagtaggaagaattaaagttttttaaataaattcttagattcaaaatgttttatatcctattgctttgttgttgccaaaatagtttatgccaaacagaaaatggcaaactgtatttttctttttcagatgattaaaggaaaagtgaaagctggaaaagtagactgtcaggcttatgctcagacatgccagaaagctgggatcagggcctatccaactgttaaattttatttctacgaaagagcaaaggtatgtccagactttcctctgttccttcccttagtaggccaagctcaaaagatgtgtttcagtctgagtaatgttttttttctgttttctcatccttgtcatttttttatattattacatattactgatacaagtttttaaaatttacatgtataccaagcgatcttaaaaggttttttgtcttgtggttgatacagactcaattgccttaacatttttatactaatgaataggaaaactactagaaagagacaaaaaaagtattattcgtgataatctttgagtgctggaattcaaggtaattttctacttttctgtgaaaggttatggtgactgttgaggtcactaagaatactctataatacacactgctgcttggaataatatttccttagtatatttctattcagtatactttttactgaataagtttcaaagtaatgagcttcctttgtggggaggaaagaacaatgataaagtatttgccatgtactcatgttttctggtaaaacattaaaaatagataatttcaaatatttttatactttttgtccagagcttatagcttgcagtgaatgccaagaatgagttctcagacaattccagctgaacgggggcaagatagctcttctaagagagtccaccccagcattcatccgcacagtatttattgaaagggcttgttaaaccacaaacatccactagatggcttgaggtccagtcgtgagacacctgtggccttgtaaaagcactcaaactgcattctcaggaggctgtttttagcgttccttatcacaccacacactccactcctgtcctgttttcgggatcaaggaatttcattctcatgcacaaataacatacacacagtgcctcagtatttttccatgccccgacctcaaatgccacgtacataaggttgaatatattgccatgctcccccgatgtctccctcttctttaattcttagcacatgctggtcatccaatgcaaggtaaacttctattgttcttccttggtcatagatacgttgggtggcagcacagagccgtctgcaaatgcctagcaaacagataaaaaaaagaataagtacaacggccatcacctaaatgcatatgtttaacccagacaaccaagtgttggggtttaaccaatgaaaactttcttgtaattgctgaagggtacttgtttgtagttgctgtgactattcttcaagttgttcaatttacactcaagagtggaaatttgagaagacaaatagtcgtgataagccccttgcagatgtgctttcactctctcccaagcatattgggagctattatatggcagaggtgtgacacagaattatattgccaatcacaatgtaaattttgacgggtaatgaatgcctgctgctgatcccctagccattcaaaagtggcttcaagggtctctaagtgagacaaaatagttttatcaatatttacctattcctgaaattcatgggttacattatataccatgtggcttatcactgaggctgtgtgaatagattctgtcagagaagcagttgcagtagcggcagttgctaatataataatagctgagagtaaaaaggcaactgaagtggccagaaatcttatttttcaagtatgagacaatgcttttctaaataggtgcagggtggaatcctcttcctagctccaagttaaatttacaggcagccaccattctgcatgccattttaagatcatgacacaggttatatttaattatgtaacgttttgatgagagaagcatgtagcataccaactactggaagagactttaatactataaaaggattgattctgctctatgttaggaacaccttgccgaaacaaaagtatataagggtgcatagtacaaatcaagactatgtcggtaacattattatgcagagagagggtatagttgccaccgctagtaatatactcaccatgggaaagaacccattcaaaaaaaggaagtcctaatctccaaatctgggtatgagcatggcttaaagcttgtttcccttttacttgtaatattggtcctaaaagcccatactctgaccagatgatagaactattggagggactcctaaatccaatagtctgatctgcagacataagattaccatggggaccctaatcaagtaaggtgtcattatcaaacagaggctcttgatgcagcgcaggctgtttgcatggcgaccactggatggcctcacacttatatcgccagtccgtactcagacagcatataggaagatcaggcacttgtgtagcttcattagagacctcagtaagattagtgctaacagcagacataaaggtcaagtttgcaaacttagtatccctttggggctggtaataaagatactcctgaagaatgagagtaacacacttatcatgtgctattatggggaaaaaaagggggattactagacaataaaatcaagtagtaattaagtttaatccatcccaaattttcagttaaggggtaagacaggggcatctatcaacctcctgtcccaaaagtatcattggatgacaaaggcaggtcagcatcccaccatgtaataacattaaaaacggggatttaaaacatgactccaataaacatgttcttgagctgatcccacttggcaaaggacaagaattgccagccaccccaacatccatgtttgtcttactttctcagaagtttccccagttaccaccagatacttaagaaaccgattccatgcggttgcgagggcttccacagctgcaagccaaatagatgcctgttgattcaatttctttagctgtccccaggtagtgttaggtgccttccaagtcatcaccttcattgttgtggtcgattctctaacaacaggtcctgttctcgaaaagagagccccatattccccgttttttgtttaagatatatattaagagtttgataagcttgtttaacaatggcttgactagttgaggtataaggaatactagttttgtgttgtatgtgctaaagttgcaatgcatatgcaaatcgagcactaagctagcaaggtctattatcaggttttatagtttgtggaaggtttaaagttataatggattcaaataaatgaccaattgcatctttagttttttttctggtctgggggtagcatgtattaggcctgtgtaagtgtacacggtaacgtggagaaatttaaaacgtttaaagggtggatactgagtaacatcagtttgccaaatagcattaggcaccagaccttgtaggttggcaccaagccttaaggaaaaaggggaaagagaatgctgttggcaatcaggacaagttttaataatcatgcgagcttgagcaagtgtcaaatgaaactgttgtttaagaatccaggcgttctgatgaaaaaaatcatgatcagctggactcgcaaaaaagcaggagaatctgcagaccacatctatggtcatactagagcatcaccttgagcattcttttctgataagggaccaggtagcttagaatgagagcgaatatgtatgatgtaaagagggtgatgatgggaccgaggagctcttgtgctggaagaaacaaagctagtaggggttcattagtaatgcccttcacatgtgcaagatttaaatgagtaatactatacaccatgtaagcagaatcactaactatatttatgtcttggtgaggaaaagttggttgcatgctgccttctaggttttatctcagatagctctggctttcttgctacccacagaggcctggggcaggagagttgctaagatgcaactaacttttccttatactccagggaagcagaaaaaagacacggccagaaaggctgatgctggaaataggaaatgagaacttgcatattaggaagactgtcataatcagccactttccttccctcctgtaggcacccctccagcagggaagtttgttgaggagacgcagccacctaatcatacaaatgttcgctgaccgggggtataatctaagaactgtcacttgggcggcctctaatctacttaagggggatgggaggtgctgttgcctgaacggggccaacagatgcaggtccctttaaggttggaggaaagaaaggcaatggcttttctgtagggggaggaaaaggctccagtctgtccttatcctcactagaaaaaatatactccttatgccctacagaagggaatcaagtagagagaggagcacccccgtgctgttctggttcctgtttttcctcactagaaaaaatctcttccttattccccatagaagggaatgaagcgtagagtggaatctctccctttaaatcttccaaattcctttcaggtggagataatgggcgatctggtgggtaaagaggataccacgcagagcgtaccggtgcccaggtggccaaaatagtagcgttaataaaatgaccttgctcatttcctcttttcaggcagtgacctacctgcttccataaccctaaatctaaggttccgtgatcaggaaaccaagggcatttctgccaaattaaaagcataagcttgtgtagagctccaggatctacagtgcactggatagccttaagtagctgttgcactgttttaaaaaatactttctgttctttggtcatttcctgacccatgataacccaacccctggtattttatgcatgggtcccatcctcctgatgggagtcaggactgtcccttactgggattcctcgaaaattgatgagctctcctccttcacacataacttcaaggtgatcacgtcgagggcaccacttgcagagcttatagcttgcagtgaatgccaagaatgagttctcagacaattacagctgagcagggccggtgagggggtggggggcagctcttctaagagagtccaccccagcatcatccgtccaccaagtatttattgaaagagcttgttaaaccacagatatccactagatggcttttttgaggtctggtcatgagacacctgtggccttgtaaaaatgctcaaactgcgtttcaggaggctgttttcagcattccttatcatactacacactacactccgtatcctgtttttagggtcaaggagttacattctcatgcacaaataacatacacacagtgcctcggtatttttccatgccccaacctcaaatgccatgtacatacgtatgaatatgttgccgtgtgccccccacattttgaaggagaattaggttaagatctgatgttatttattggtggttacattttgtgatgaatagggctaaattaagaaattggatgatgaatttcagaaatctagaattgccacacatctagatttttcagtgaaggtttttgatttgtcaagaatctgtcttaagaacaatctagagcaagcagaacttgatggaggtgagaggcagcttatatcagagcctgagtcttcatttctttgaatcaacagctctatttctcagttttcagaatagctgagagatgggtgacataaatagggatcttcttcagataatatcagagaagtatcaatttaatgagcagttacaagagttaaccataccatagacagagctgtttgaaaagatgttgccatgtgtccagaggagtccaggggacaaagttaggaaccaaacatccctgtccaaattgaaagacaagggtagcattcagccattgaggccagacaggaaggccaaagcagaataatggttggagtaaggagaaacacaaaccaggtgggcagttacacacaaaacaaaattctagcacatagttggggattagagttcacaccaagattaagacaacaggtggccccagatccaaataagcaggtcaggatatgctgacctgttccttcccctgcttttcagccaccttcctgctgtgcgcagatgaaaactaggagatacatgttgctttccattactgttgttggtcatggttgggcagtgctaatgattgtattagagtggaatgagttcggtcctctgggaacatctttttgtttgtttgttttaattatactctaagttctagtgtacatgcgcacaatgtgcaggtttgatacataggtatacatgtgtcgtgttggtttgctgcacccatcaactcatcatttacattaggtatttctcctaatgctatccctcccccagccctgaactccccaacaggccccagtatgtgatgttccccccactgtgtccaagtgatctcattgttcaattcccacctgtgagtgagaacatgagatgtttggttttctgtccttgtgatagtttgctgagaatgatggtttccagctacattcatgtccctgcaaaggacatgaacgcatccttttttatggctgcatagtattccatggtgtatatgtgccacattttcttaatccagtctatcattgatgtacttttgcggtggttccaggtctttgctattgtgaatagtgctgcagtaaacatatgtgtgcatgtgtctttatagtagcatgatttataatcctctgggtctatacccagtagtgggattgctgggtaaaatggtaattctaattctagatccttgaggaatcgccacactgtcttacacaatggttgaactaattaacactcccaccaacagtgtaaaagtgttcctgtttctccacatcctctccagcatctgttgtttcctgactttttaatgatcgccattctaactggtgtgagatggtatctcattgtggttttgatttgcatttctttgatgaccagtgatgatgagcattttttcatgcatctgttggctgcatagatgtcttcttttgagaagtgtctgttcatatcctttgcccactttttgatgggtttttttttattgtaaatttgtttgagttctttgtagattctggatattagccctttgtcagatgggtagattgccaacattttctcccattctgtaggttgcctttcactctgatgatagtttcttttgctgtgcagaagctctttagtttaattagatcccatttgtctattttggcttttgttgccattgcttttggtgttttcgtcatgaagtccttgcccatgcctatgtcctgaatggtattgcctaggttttcttctagggtttttatggttttagatcttacgtttaggtctttaatccatcttgaattaatttttgtataaggtgtaaggaagggatccagtttcacctttctacatatggctagccagttttctcagcaccatttattaaatagggtatccccattgcttgtttttgtcaggtttgtcaaagatcagatggttgtagatgtgtggtgttatttctgagggctctgttctgttccattggtctatatatctgttttggtaccagtaccatgctgttttggttactgtagccttgtagtatagtttgaagaaaggtactgtgatgcctccacctttgttctttttgcttaggattgtcttggcaatacgggctcttttttggttccatatgaaatttaaagtagtttttttcaattctgtaaggaaagtcattggtagcttgatggggatggaattgaatctataaattactttgggcagtatggccattttcacattattgattcttcctatccattagcatggaatattcttccatttgtttgtgtcctcttttatttccttgagtagtggtttgtagttctccttgaagaggtccttcacatcccttgtaagttggattcctaggtattttattctctttgtagcaattgtaaatgggagttcactcatgatttggctctctgttgatggtgtataggagtgcttgtgatttttgcacattgattttgtatcctgagactttgctgaagttccttatcagcttaaggagattttgggctgagatgatggggttttctaaataaacaatcatgtcatctgcatacagggacaatttgacttcctcatttcctaattgaataccctttatttctttttcttgcctaattgccctggccagaacttccaatactatgttgaataggagtggtgagagagggcgtccttgtattgtgctggttttcaaagggaatgcttccagtctttgcccattcagtataatattggctgtgggtttgtcatgaatagctcttattattttgagatacattccatcagtacctagtttattgagtttttagcatgaagggctgttgaattttgtcaaaggccttttctgcatctattgagataatcatgtagtttttgtctttggttctgtttatgtgaaggattacatttattgatttgcatatgttgaaccagccttgcatcccagggatgaagctgacttgatcttggtggataagctttttgatgtgctgctggattcagtttgccagtattttattgaggattttcacatcaatatttaggattttcacatcgatgttcatcagggatattggtctaaaattccctttttttgttgtgtctctgccaggctttggtatcaggatgatgttggcctcataaaatgagttagggaggattccctctgtttctattgattggaatagtttcagcaggaatggtaccagctcctctttgtagctctggtagaattcagctgtgaatccttctggtcctggactttttttggttgataggctattaattattgcctcaatttcagagcctgctattggtctattcagaaattcatcttcttcctggtttagtcttgggagggtgtttgtgtccaggaatttatccatttcttctagcttttctagtttatttgtgtagaggtgtttatagtattctctgatggtagtttgtatttctgtgggattggtggtgatatcccctttatcattttttattgcgtccatttgattcttctctcttttcctattagtcttgttagcagcctatcaattttgttgatcttttcaaaaaaccagctcctagattcattgattttttgaagggttttttatgtctctctttcagttctgctctgatcttagttatttcttgtcttctgctagcttttgaatttgtttgctcttgcttctccagttcttttaattgtgatgttagggtgtcaattttagatctttcctcatttctcctgtgggcatttagtgctataaatttccctctaaacactgctttagctgtgtcccagagattctggtatgttgtgtctttgttgccattggtttcaaagaacatctttatttctgccttcatttcgttatttacccagtagtcattcaggagtaggttgttcagtttccactagttgtgtggttttgagtgagtttcttaatcctgagttctaatttgattgcactgtggtctgagagacaatttgttgtgatttctgttgttttacatttgctgaggagtgttttgcttccaattatgttgtcaattttagaataagtgcagtgtagttctgagaagaatgtatattctgttgatttggggtggagagttctgtggttgtctattaggtctgctttttgcagagctgagtgcaagtcctggatatccttcttaaccttgtgtctcattgatctaatattaacagtgtggtgttaaagtctcccattattattgtgtgggagtctaagtgtctttgtaggtttctaaggacttactttatgaatctgggtgctcctgtattgggtccatatatatttaggatcgttagctcttcttgtggaattgatctctttaccattatgtaatagccttctttgtctctttgatctttgttggtttaaaatctgttttatcagagactaggattgcaacccatggtgttttgttttgttttgttttgttttgttttttggtttccatttgcttggtagatcttcctccatccctttattttgagcctgtgtgcatctttgcacatgagatgggtctcctgaatacagcacactgatgggtcttgactctttatcaaatttgccagcctgtgtcttttaattggggcatttagcccatttacatttaaggttaatattgttatgtgtgaatttgatcctgtcattatgatgttagctggttattttgcctgttaattgatgtagtttcttcatagcatcaatggtctttaccatttggcatgtttttgcaatggctggttccagttgtttcttcccaagtttagtgcttccttcaggagctcttgtaaggaaggcctggtggtgacaaaatcagcatttgcttgtctgtaaaggattttatttctccttcacttatgaagcttagtttggctggatatgaaattctgggttgaaaattcttttaagaatgttgaatattggcccccactatctcctggcttgtagggtttctgccgagagatctgctgttagtctgatgggcttccctttgagggtaactcgacctttctctctgcctgcccttaacattttttccttcatatcaaccttggtggatctgacaattatgtgtcttggggttgcttgtcttgaggagtatctttgtggtgttctctgtatttcctgaatttgaatgttggcctgccttgataggttgaggaagttctggataatatcctgaagagtgttttccaacttggttccattctccccatcactttcaagtacaccaatcaaacagatttggtctttccacagagtcccatatttcttggaggttttgttcatttctttttactctttttttctctaactttgtcttctcgctttatttcattaatttgatcttcaatcactgataccctttcttccacttgatcaaattggctattgaagcttgtgcatgtgtcaccaagttcttgtgccatggttttcaactccatcaggtcctttaaggtcttctctacactgtttattctagttagccattcgtctaatcttttttcaaggtttttagcttccttgcaatgggttcaaacatccttctttagctcagagaagtttgttattaccgaccttctgaagtctacttctgtcaactcatcaaagtcattctccgtccagctttgttccattgctggcgaggagctgcaatcctttggaggagaagaggcgctctgatttttagaatttttagcttttctgctctggtttctccccatctttgtggttttatctatctttggtctttgatgttggtgacctacagatggggttttggtgtagatgacctttttgttgatgctgatgctattcctttctgtttgttagttttccttctgacaggtccctcagctgcaggtctgttggagtttgctggaggtccactccagaccctgtttgcctgggtatcaccagcagaggctgcagaacagcaaatattgcagaacagcaaatattgctgcctgatgcttcctctggaagctttgtcccagaagggcagccgcctatatgaggtgtctgtcggcccctactggaaggtgtctcccagtcgggctacatggggatcagggactcacttgaagaggcagtctgtcccttctcagagctcaaatgccgttctgggagaaccaccactgtcttcagagctgtcagacaggaacgtttaagtctgcagaagttgtctgctgccttttgttcagctatgccctgccaacagaggtggattctagaggctgaaggccttgttgagctgtggtgggctccacccagtttgagcatccctttccactttgtttaccttctcaagcctccacaatggcagacacccctcccccagccaggctaccacctcacagttcaatcttagactgctgcactagcagtgagcaaggctccatgggtgtgggaccctctgagccaggcccaggagagaatctccttgtctgcagattgctaagaccttgggaaaagtgcagtatttgggcgagagtgtcccgttttttcaggtagtctgtcacggtttcccttggctaggaaagggaagtcccctaaccctttgcacttcccgggtgagacaacaccccccccaatccccgccctggcgtcttctcgccctctgtgggctgcacccactgtccaaccagtcccaatgagaagaaccagatacctcagttggaagtgcagaaatcacctgtcttctgtgttgatcacactaggagctgcagactggagctattcctactcagccatcttggaatgccctctcaaactttatccaggaacatctgttcttgcacagtttcgatgttttgaggcttttggagtcagtgatgcttttttttttttttttttaacaattgtttcatgtttccgtgacactattattagtatttattttaggtacattatgggttaactgcttttgcagcattatttccttgaagagaataaatttgaatttcaaacacttcaagttttggaacaaaagaacttgaaagcatatttaatcaagtttcttaggtggaaatgttatgtttttattaaatacttaaaagataacaagtgtttttaattttagagaaattttcaagaagagcagataaataccagagatgcaaaagcaatcgctgccttaataagtgaaaaattggaaactctccgaaatcaaggcaagaggaataaggtatggactaagcctagagttgactttggcaaaagttggcaaaagttagcaaaatctatttttcctatacattacatgcatccagagacaacaaaatgaggcatcaaaaaatagtaagatagctgaaaattctactttgggaaataggacaatcaaaatgtagcctagacactgaaatgcttttaaaaatttggacaagtaaaaccacttaacaaaaaatagtgactgtggtccatgcaaaaacatgtatacaaatatttatagctgtatcattcataatagcaaaaaaaagaaatgtctgtcaactgacagataaatgaaatgtggtgtatccattgaatagaatattttcagccataaaaggaatgaagtactgacctatgctacaacatgtttgaactctggaaaatgtttagtgaatgaagccagtcacaaaggccaaatattatataatactattgatgttaaatatctagaataatccatagggacagaacgtaggttaatggttgcctggggccgaagtggagtgggatagaaaagagcaaaaatggggtaactgctaatgggtagtaaggagtttattttgggaatatggaaaaatgttttaaaattagattgtaatgacagttggacaactctgaatataccaaaaaccactaaactcctttaaatgtgggaattttatggtatgtgaaatatatctcaacaaagccattaaaaaaaaaatagtgactgtggccataaattatttaaattttgttcaaatgtaaataaagcattgaattgttaggaataaatatactggagcctcataacacgttttgaatagcaaattttcttttgttcttggtgtaatcagaatgtattgaaacccatatttgtgttggcccctctttgaatctttaatctgtcaagaagcagcacaacctttttcctgttactcttcagaaggcagttcagttttacctttttcaaatcggtgttactgtagatcatacttaaaaacagaacaaagagtctatgaatgttgtagtgcttttaaaatggaatttaatacaatcacatgaggtatctcggattctttccctatgaggcgaaaggaggacaaaatagctcagcctctggaaagggctagagaagactggctttatagcaccatattagacaataggttctactgtaatccagttcaaactgcagaccccaatagacaaagccttacaacctacctcaagaatattttttacgaatctgaaaggtaggaaagagttatgagtctgtattttcttggttccactgaacaaacatgtttttctagtgtttcgctatattagttttctcaagatattttattttgaaaggtgtaacttttatctcattaaatatttgaaatttaaaaattgtcataatctaaaatatcatacctgaaattaagttaaagagaatacccaatatgcttgaaattatgtaaacctatatagttagtaatatctgctgtgagcaggtaagaactaggatattcttttcttttttattgttatattttggcaaagtatatttcatgtcatgatccattaaataagaatattgagtatttctgaaaaagtaaaatgttggtttgtggtatttcaccttatttttaacattaccaactcatactttctcctttctctatcgcctttacattattattataggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgccgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcgtagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgctttattgtgttttgaggagttttcctttttttcttttcaatatcactttatcctgctcaccagtatttcctcataagggttattatagccataattaatgttaaaatagactttgttcttcatattctcccatctttttcgctactatatactctgtctggattctgctgtatgcctgttggcatatatggaacagtcaccacttgtcacacttaacaccagctttttgaattat

SEQ ID NO: 38710 - DNA, 62494 bp, Homo sapiens; identical to SEQ ID NO: 38709

SEQ ID NO: 38711 - DNA, 4145 bp, Homo sapiens
ggatgtataaagcgcggccccctgcggggagtggtggtgagtccgagggtgccacagcggccctgcccctgcccctgcccctgccctgagtgggcgccgcgctacgggggaggggttaacccacccctcctccccggggcctcacgcgggtgggaagggacagtcccagcgacagaccaggcgcctggacgcgccgtggacccgcgtgcggacggcggggacaggctccggtgctgagcgcctccggtgtccccagcagcactgacccacttgcaggccccggagctgagccgccagccatggccgctccccgcgggagggccgcgccctggacgacggccctgctgctgctcctagcctcgcaggtcctgtctccgggaagctgcgcggacgaggaggaggtccccgaggagtgggtgctcctgcacgtcgtccagggccagataggcgccgggaactacagctacctgcggctgaaccacgagggcaagatagtcctcaggatgcgcagcctcaagggagatgcggatctgtacgtctccgccagcagcctgcaccccagcttcgacgactacgagctgcaatcggccacctgcggcccggacgccgtgtccatccccgcgcacttccggcgcccagtgggcatcggcgtctatggacacccctcccacctggagagcgagttcgagatgaaggtgtactacgacggcacggtcgagcagcacccgttcggcgaggccgcctaccccgccgacggcgcagatgccggccagaagcacgctggtgccccggaagacgcctcgcaagaggaggaatctgttctctggacgatattaattagcattttgaaactggtacttgaaattctcttttgagtcgttgaccacactctgggatataaaaccctccatctgtgaagctgattgcagtttgctgtgaaccttgctacttgtacttggttgaagttctaggtacctttagtcaagggatggaaaaataaagccatacgcagttttgttacctcagttaccccaaaaataggaaaagcagcaagcacagtattttaaagatcataattcctataaaaggactgtgcacaaagtgtttagactccattttcattaggcaggttgactaaaaatgattgcagtaacaggtttatataaaatagagcaacctttcatgctgtgacacaaatcaaaaggttgataactttgtaattttactctggagattctaaccgaagttggtgtaagttttcaagagttactaaaatcaagttggaaatgatttacgtacacttccctgagcctggactaaagcctcatgcctgtaccccaagtaggtgatggtacttttctatacaaaaaggatttcctggcaggcaggtatttacaaagtttgttcctgtaccagtccaataatgacaactctaaatccagctgcaccaaatcttagtgggccatttgtcatacctatgaaaattcttcagttattaaataactttgtcagtgctacctatggtaggccggaaacaatgtagattaggaagtttcatgaaaattaacttttggggctatggagaaacagttaagtatcttaagttactaaacatttccactgaatttttggagtgagccaaggttactataaaatactttggaagatgaattctctacctggagttagtttcgagagtaagcgtagcttttaacagaaataactgcagattttaagctcataatttgcaaaaaaaatcttttattggcatgaaaataatgttgtaaatggcaccaaatattccacttaaatgcatatacagtattagagtcaaaaactattttatccctctttgctgtttttcccccttctgcccactttcctgggtgttgggggggcccgctgacaacagtcacaaatccagcgacctaggaaaaaaattgttaatatagaatgaaaaattatctttacaggactgaattttaagcccatctaaactcttctgccttagctatcactaatgatattcctctctggattttgtggtgagaagggcactatgagttccttaatttaaggaaaaaatgtaaacttaatcaatgtaatcaatgccatgcaaaattcattgcaagtcaagggggatgggagagatgcaatgccatacggtgatacggacctttaagaaagtacaatctttcctgaaattcaaacactatcatacttcaaaaggtcaaaacccattccggaatttggcttttttaagactttttctctcctgctcactggcagctgtgtgtcttaacagcattctttcaagtcctggtgtactctgctgacagcactttaaaactttaacagcacaatgataacttgtactacatacttgatctgaattactacagaaaaataattatgttgcttgcttaatgattcccaggaaacttcgttgtaggcatatattttataagagtattatacagtgttaactatgcaagtaagttctaaaattacacaattatctgtgtaatgttttagtccaattactgtgatttattcaactctgttctaaagttatctggaattgtcatgctgcctcaatttacagaaatctataatagatttctatagaaatgtataaagacgtagcagtcattttgttgtttctaaatagataacatataaaaataaaggctttgttactttagtatttcagtagaaaaacaccagctcattctatagaactatacttccaaaacttagcaggggcattctggcctttcacttatcctttagttggaattgtctagggatgaaaagctggtggacatgacctgtataatcacagctttggtcatatttgcacataagagtccacaagctcttcatgtcatgatagcgtttatgcagccttttggagtgctgggagagtctcatcacccaaagataatgtttgctctttttttaatctttacctgatggaatagcaccaaggcccacacaaaaagtatgataacctctgtcacacatatcacagaacatcatttcttcttcatggtggggttgtccacatataatgcatgttttacattccatacactgccatgggtaggtcttaatcatagaaacaagctccattgtcatatccaggcaagaaggatggcctaaatcaaaaccagtattagtggtatctcacataagaaattttaacttaatatggcacataaaatactagtttgctttaggacttccagagaatggctataatgtcaaatcgccaaagagaaatgaatatacaatgtagaggaaaacacatgggctgtgtctatgcctcacaagctaccctgtgtatttaatttggtgactctttggttgaaatctgcctgaaactataaattctagtttttgaaccaataaatacggtggttaaaattttaaaaagacatttcaatacttaccactattctcacattgggagcagtgtataagtgattcagcctttcctttcttgttggactccttacccttcagacaaattccacatatagcatttggaatgacctttggctggaagggtagaagagggctataaattcatgccagaagagcttactatgggtttaaaaggaattctgttactttattgccctatttttacttttggtaacttgctaatgaggaccattttgaaagacaaaacttgacaggagtctgcctacaatgtaagactgcctactgaagaaagcattaatttcatcataaaatttggtaaacagcatgatctcgtaagattaaatgtagcattctatactccctacatgcacagtaagatttgtttaatgaatggaaggaaagactaaatacaatgtcaaatgtcactattaattggacaagaaaatccaagtagcaaatgaccattatgtgtaagacttactctaaaaagaccattttaaatagctcatatattaattttgtttaaaacctgctattttccaaaactgcaaaactagagctataaaatctaagttaaaaaatcagcttatcctcattggtatagtggtatttaaaaaaaaatcagtttaaacatttttaattgaaagatgtctcatgcatacattggcgtgtacataaacgtttgtggaaaactt

SEQ ID NO: 38712 - DNA, 24344 bp, Homo sapiens; identical to SEQ ID NO: 37363

SEQ ID NO: 38713 - DNA, 6321 bp, Homo sapiens
aggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggtgagagcaacatgtgtgcatagtccccagacactggccctgttttgggctggtgtaaatccttgcctctgcctttccattggcaatcggcgtcgggcgacttggagcaattctggcttattttccatcatggtttctttctgttttttccctccttctcaggtcttagaaagtctcacattcattggtgttaaattagggttcgatgttttttgtttgtttttgttttgttttgagacggagtcttgctctcgtcgcccaggctggagtgcaatggtgcgatattggctcactgcaatctctgcctcccaggttcaagtgattttcctgcctcagccttgcgagtagctggtattacaggtgcacaccaccacgcccagctaattttgtatttttagtagacatgaggtttcttcatgttggtcaggctggtcttgaactcctgacctcaggtgatccacctgcctcggcctcccaaagtgctgggattacaggcgtgagctaccgtgcccagccagggttcgatgttcttgaacagaggaggaattgcatctaacctacctaatctatccttggtagactccctcccctcccaaatcaattcgtgtcagctacttagtggatactcagttcagtacctaattaatattgacaaggaaggaagtttctcccttctcagccccaactcactcctagagggggatgtatattctgaacaagctgggttcctaaagattagggagttgacctctggcacactggtctttccacaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggtgacagctctttcaagtcagtcccagtccctgataagctagtgggggatgagtgattggccttcctcccagcagcaccttagaggccattgttcccccttcctggccactggccgctctgtgggccctccgttgctcacctttggcaatctgagaacctggggctatcaaaagtagtatcttgttaggaacccctaagcaagaccaaagggtgctcctactcagcagtccttctcccctgcccccctgccctccacacctcccccgacatccacacttcagttatggcagtgtgggcatgtcttagagatggctagtctccagagaagtgaggtgatcacttttccagcccagagagctgccctgtttcttgtgctggagaagagtggaagaacccagaggtggctcatcctctcaaaccaaagtattgggaggattttctggcttgtgtcattcattcccttgaagaacaatgggaatctttgggggaagaaagtatcattattattatttttaatatgttatttctgtgatggctccttgcagagcagggctagcctgtaagcaatgcactgagagtagccgagagtgtccttagttgcctacttgctttctactttccaaaatgtgggcagtgaaagaactggggttaagcgaggtgctggaaagggtgcctcttctgtcctctgttctaacgcagcagtgctaacagatgtgaacactgagtatggttaagggcggtttgggactggcagctcttgtgtgtgtcattgattggtctgattgtccctctaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcaggtgagctgaagaggagcaggtgggcagaggaccgcagtcagagggtcagagagagcctgagatgtccaggcgtgcaatgaacgagcagctggcagtggggctgggctaggccctgtataatggcagggcaggaagaggccgaccatacttaaatttaaagcaactacagggacaaaggtctttgggggtccaaagcaatcataaggtaagctcccagcacaacttgaatgcagctaaaggggtttgcaagtagactctgaggatcaggaagctccgcacagtgttcagacagaatagttttagctcctcctcaatagtgcctgtccactgaggaggcaaaaactctgaagtttctttacttctagaactgtcccaagaaagcccaagggtagaagggagaattctcaagttgaacgtcaggcttggcagaggtggagtgtagatgaaaacaaaggtgtgattatgaagaggatgtgagtcctttgggtgtaggagagaaaggctgttgagcttctatttcaagatacttttacctgtgcaaaaagcacattttccacctccttctcatggcatttgtgtaaggtgagtatgattcctattccatctgcattttagaggtgaagaataacgtacaagggattcagtgattagcaagggacccctcactaagtgttgatggagttaggacagagctcagctgtttgaatctcagagcccaggcagctggagctgggtaggatcctggagctggcactaatgtgaggtgcattccctccaacccaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgcc

SEQ ID NO: 38714 - DNA, 33015 bp, Homo sapiens
gatctcgctatccggccgccacccgcagctgcagcacagtcatggcccaggcgtcgccgccccggcccgagagggtgctcggcgccagcagcccggaggcccggcccgcgcaggaggcgctcctccttcccaccggtgtgtaccgcgggggcgggcgggcgggcgggcggggctgggcagcgacgggcccggtcaaggggcctgccttccggtcgtggccgcatgggggcccgacctgcccctactccgggccggggccctagacgccggggcggcgctggacgaacttggctcaccactcgcgtgcctgttggtgggggagggggccagaggacagggcgcggcccaggccagttccacaggtggctctgactgcccatggtttcgcgcgagtggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctcacgttcacggaggacgtgactggaacccgtctccccttctccagtcgttccagtcctccccggccctctacttgagtgggtgggtcttctgatgggttcctgcccttgcgtgtgtgtatagctccaaacggtgtgccaggctcagggcaaggtcctgagcatacaaagatgagttaggcagaccctgccctagagactctactaggcaactttaatgaggaggtcagaaccacagaggtacagatgagagactcctgactcccagtcttcagggaaagctttttgaggagaggatggctgggcttaccctttttttttttttttttttttgagaggagtttcactcttgttgcccaggctggagtgcaaaggcgctatctcggcccactgcaacctctgcctcccgggttcaagcgattctcctgcctcagcctcccgagtggatgggattacaggcatgtgccaccacgcccagctaattttgtatttttagtagagagggtttctccatgtttcatgggcttacctttaaagggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtaagtcacgggagatgcgcttccatcctgacctcttcctcaaactccagactggtataaccaacttcttccatttctgaaatgatctcaaactgagtatgtcccaaagagaattcttgtttcctccactgtattcaggtactccaaacctgctcaaccaccagcccattccattcgcccaggtgctccttgcaaaaaccttagtggctcctcagggcctctctttcctccggacaccccttctaatgcatcagtcgggccagccagttctgtgttcagcctgactgtatctggagcctgactgcttctcaccacttccattactgccacccaagcctacgccatcatgatcttctgtctggactattgctttcctggcttctattctagcctttaatacaggcaggcctgcagagcggccaaaatgctttttgaaaaacaaaaagcaaatgtgattctcctactcaaaacccaccaatagtctcccatgactctcagaacaatctatgagcctggcctgcagtttaccccatgtccttatctgatttgactcctgcccatcttaatgactctgctaccctgctaccttgtaggtcctctaagccaccaaagctgtccctgcctcaggatctttccatttgctattctctgcaaggaaaactcattgccacattatcccattttcagttccccatcatattcaggtgtctgctcatatacatcttccctcaaccttgcctgcccatcctgtctaaaagagcaccccttgcccctgctcctgtcactctctacctccttctgctctattctttctctatagtacttatcactacctggaaaacaaaacaaaacttgtttaatgcctgtctctaccactggccactggcatgtaaattcgtcttactctcttctatccttagtgcctagactggttggcctagtagtagtagtaggacatagtaggtactcattaaatattaaataatagtaagtcctcattaaatatttgttgaaggaatgaatgtacttgtatataacactacggagcttgacttctgtaggtgatggggaaatatgagcagatgtccatttcaggtagatcattctgacagtaacatagtacatttccggtagatcattctgacagtaacctagcacatttctggtaaatcattctgacagtaacctagtacatttccggtagatcattctgacagtaacctagtacatttccagtagatcattctgacagtaacctagtacatttcagatagatcattctgactgtaacctagtacatttccgttagatcattctgacagtgacctggtacatttcaggtagatcattctgacagtaacctagtacatttcaggtagatcattctgacagtagcatagtgcatttcaggtagatcattctgacagtaacgtaatacatttcagatagatcattctgacagtaatataaagaatgcagtgggatcatgacagggaaaatagagacaaggacaagagatcactggaatagactaggtgaaagaccctgagggtaaggcagtccaccttccacaccgctgccagcactgtctttctcttaaacacacatgggcacacacacatataaacatgtgagtgcacacacacagatcaagtaagtcatggtccttccagtgttaataagcacgtactggctgcaagtactacaaaaacaatttgatgtaatttaagcatgagggatgcttagtagtagtaagcaggaaaaccagactcacagacccccagagcatggatactttagcatcttacagaaagggctgaggactaggacctgagaagccattataaactttgacaacactctcctttatctcttatttctgcatctctcagtgtatctgctttgttcttctctttctctggtccagttttcctggtgatggtatagaagatggctgcccttgcagcctctcagtttttacatcttctttaagaaaccagcccaatctgaactgaaatcttctatcctgaattctgtatatctgagagatgagcaggtcctctgggactatcagctatgtctagaggaatgaagtacaaacatgcctgctgggggtcattgtgtacgcatcattgtgagctgaacagataccctaaaggagtccattgaatatcctatccttaggctccccatggtccctcctctataacacacacatccttattcctatttatacattctaaagatattcccagtgatgcattctgttcccagtaatgaattctagctataccaaaaccaaattcagtcacacttaacttctgccaaagtcatatctagccacttcatcctgagataatgtgatggaaccattcattctccaaggccattaccaagttccttgccaagcctctaggtaatgtctactgttttggtctgtatccagttcaggtaggcattcactggaccagtgataaaattggcttctacacatccagcaaacagtggaagaactaaaatagtaaattgcaataaacactaatgataaaaggagaagaaaggaggaaatctccaaaccagcaccataaattagttacctaccagtccagaacaaatctatactggaaggggattctaaatgaaatgataggattagtgaatcccattccaactgtttcacccatttctttagtggcagaatgtgttccttgaccacgcttcctggctaccccagattctgtgccctgggtggattacccttggctggagggctttaagagtagaagctagagcctcggcaatccatttccacattgaagagggcctgcagattgccggagagattaagaatcactgtgttgtttgaattagtcatagttcttatattccaggcttgtgatctttctgtggtttcattctgtataaactttcttggctctcagtttcatttgtgagaattctaaaattctgcaatcttgtcgggtcaggctctgtgagtcctcagggttgctaaacccccctagaaaggagcctggaaagccctgctgactattcttggtcccagctactgatgaaaaccaatgggctcttccctaaaatacctcagccttcatgacacacctttaggtatccctccctctctgaatctgtacagttcctgagttcagatggtgagggataccaaactgtccaaatgtatgtggtccatgagtttcggataacacatagcaagagttcagatagtgagagatgcctgtctgtgtaaaagtcctcagtgtgactcccatagtgagagatgcctgtgtaaaagtcctcagtgtgactcctccaactgcagagaattacacacttcctccagtctagaagatcaaaagagctagaagagccgaaatccattaagacactgtgatatggggggatttagcaggaaaaagccactagggagaacctgtgggtcccaccccatgtttttaatccatctgcactgaagacaaactctgggtctagcacagcagtgttgtcagcatatctgtcttgtctgtcttgttcttctctgtattccccgttgtcagagaatacaaaccacctctgtattcccagatgccaagactcttggaacccaagtacttgggagctcagctcaggtatcagtgacttgacagctctgcccagtgcacagaaacaagcaatgttgtacaaaaatgttcagcccttatacaacaagaggcagctgcatatcctgtcagatagtatcgcttttaatttgggagtcaccaacttttgtttttttttttttttggtttttttttttctgaaatggagttttgttctcatcgcctaggctggagtgcaatggtgcgatctcggctcaccgcaacctccacctcccagattcaagcgattctcctgcctcagcctcccgagtagcggggattacaggcatgcaccaccacgcctggctaattttgtatttttagtagagacggggtttctccatgtttgtcaggctgctcttgaactcccgacctcaggtgatccgcctgcctcggcctcccaaagtgctgggattataggtgtgagccactacgcccagccccactggctttttttaagcctgtactttacaagttttaatgtctgttttgagtgtcctttaataagaacacagtattctatcaaagtagattttgggtctgaggtaattagaatattgggatgtttttcccccagtttcatcctagggcaggggactttgtgttgtcaaatattaacatatattctaaaacattgaaaattttaagtgtagcattgttcaatggaataaaacagaagcacaggaggaacagatccaactatatgaaaaggagattttaaattagtggctaaccattatgaatataagttagattcccatctcatacattacaaaacaatttattctatgttcatgaatagtttaattctttttttgtttcattttgttttgtttttttgaggagtttcgcccttgtcgcccaggctagcatgcagtggtgcaatctcagctcactgcaacctcctcctcccaggttcaagtgattctcttgcctcagcctcccgagtagctgggattataggtgtccgccaccatgcccggctaatttttgtaattttagtagagacagggtttcaccatgttggtcaggctggtctcgaactcctgacctcaggtgatccacccgcctcggcctcccaaagtgctgggattacaggtgtgagccaccgcgcccggccaatattttaattctaaaattaaattaaggcaggacatggtgcctcatgcctgtaatcccagcactttgggaggctcaggagggaggatcacttgagcctaggagttcgaaaccatcctggacaacatggcaagatccctcctctacacaaaaatttaaaaattagctagatgtggttgcatgcacctgtaatcccagctactttggaggctgaggtgagaggatcacttgagctggggaggttgaggctgcagtgagccatgatcatgccactgcactccaagcttgggtgacagggcaagaccctgtctcaaaataaataaattgattaattaaaataaattaaaattctagaagaaaacagaggtaagtgttttctatgtccatctcacccaagagcagaaatcataaaataaatgattgttgtaatttcatcaagtaaaacatttaaatattctgtatatcaaagaatattataaacaaagttaaaagaccacatatatgactaacaaagggttaataccctgactgttataaaccaataagaaaataataattcaacagaaaaatgggctaaggacatgagtgccttagagaagaaatgggattgtgaccttactgcatgttacattcgtaagtccagattatgatccacttctctctgcatttcgtgttctttcctttgacttcatcatctaaccttctgtcctaactgtaccttgataatacgtttatttgtttgtttgttttgagacggagtttcactcttgttgcccaggccacagtgcagtggcacattcttggctcactgcaacctctgcctcccaggtccaagggattctcctgcctcagcctcccgagtagctgggataacaggcatgcaccaccacgcctagctaatttttttttttaatgtagtagagatggggtttcaccatgttagccaggatggtctcgatctcctgatcttgtgatccacccacctcggcctcccaaagtgcagggattacaggcgtgagcaccgtgcccgaccaagattgaccttcttaaacaactttgtcatcatgtgcttctcctgctcagacatcctccttggcagcctttcaacacgtttctcaaatcctttcccagcttcctgtgcagcctttcctcctcagcctggctgccttactgtctcagctccgatctctgggccttttcccatatggctgcttccctctacagtgttcctcctagcccataccccaacccaccccacctttccctcctctccaggttgtaccagttccaggcccctgcccttgacaatactccttcccacgaggagcacttcctcggctacctccttagcgtgtattggaattcccactcacttggcagttgcactttgtgacacttaattctgccattttattttcctaactgctatttagtctccctgtttatttcgtaagcttcttgcagacaccagttctatctcaccacatttctttacgtcctctgctctactattcactagaggagcccctcaccacagatagctgttgagcacgtacaatgtgactggtcctattgagacatgctttaagcacagaatacacactggacttcaaagactctgtacaaaagaatgaataacttttatattgactaaatgttgaaaggatgtaagttctttgacatatttggttgcataaagcacattattagcttcacctgtttcttttttgggttttttgtttgtttgtttgtgtcgtttttgagacagagcctcattctgttgcccaggctggagtgcagtggcacaatttcagctcactgcagcctctgcctcctgggtgcaagcaattctcgtgcctcagcctcccaagtagctggaattacaggtgtgtgccaccatactgggctaatttttttgtatttttagtagtgacatgttggccaagctggtcttgaactcctgacctcaggtgatccacccacctcagcctcccgaagttctgggattataggcgtgagccactaggcccagcctcctttttgatttttttaatgaggctcctagaaagttttcagtgatatctgtggctcacatttgtgtcttgttatatgtttcttgttggacagcatcggtctagagtgcacaacatagtgactcaaacacaagaaatgctctcaggctgggtgcagtggctcacacttgtaatctcagcactttgggaggccaagcaggctgatcttgagcctaggagtttgagaccagcctgggcaacataatgggacccctgtctctaaaaaaaaaaataacaaaaattagccagacatggtggcctatatctgtggtcccagctactgaggtgggagactgaggtgggaggatcacttgagccctggaggcagaggttgcagtgagccatcattgcgccactgcactccaacctgagtgacagagcgagactctgtctaaaaaaaaagatactccccagccccccgcccggccagccgccccgtccgggaggtgaggggcgcctctgcctggccgcccctactgggaagtgaggagcccctctgcccggccagccgccccgtccgggagggaggtggggggtcagccccccgcccggccagccgccccgtccgggaggtgagaggcgcctctgcccggccgcccctactaggaagtgaggagcccctctgcccggccaccaccccgtctgggaggtgtacccaacagctcattgagaacgggccaggatgacaatcgcggctttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccccaatctcaagtacccagggacacaaacactgtgagaaacacccaagaatgataaataaaaaataaataaaaaaataataaaaaaataaataaataaaaatgaaaaaaaaaaaaaagatactcccaaatttttggttgttagacatgaatgaaaaaaacagctagctcattccgtctgagcagttttcactctatcttacccttttttcttgcttggtgggaagctggggactgttaatttgtgtccccggtaggtgggacccaaatccaagaaacagaaattaaagaagaaactgatcagaatgtgaaataaacgctagctccaaatgcagccttctgacttggtgaaatgaaagacctaacttaaagagacagagaagagatctggataacagaagagacttagggatcacttaagcagttaacctcatctaaattgaaaacttttcccattaaatggtaaaataaatctttctttcaaaactaaaatttgaaaattataaataaaagctgttttctactacagaaaatcaaaggaagtaagaggatgaacattgcaatgggcaaaaaaatcttaaacgaattcttgtggccaaatagcaaataaccagttcaaaaactttgcctcttactgacacatgggtggagatctcaacagctggctttcttctccctctctctgcctcttgccttttcttcctacctcttcttcccttagatttctttccttttttccattcttcgccttaaaaaaaaaatctacttcctaccttcatgtatctttcctaatcatgatattgaattaaagcacacttaaagtacattgctcatttatgtctttaattctcatagaatttatttttgaatacagtatggcattaggattctaactttttaaatagataattaaccagagcactatttcttaatatgccattgttttcttcttcatttgtagtgacaataatgattattattgagagcttgctatgggcaaagcagtgttttgagaggtttgcctgtatttaaattcctggttgtgtttcttgaataaaggtcttcctcattttggccaggcacagtagctcgtgcctgtaatcccagcactttgaaaatgccaaggcagaaggatcacttgaggccaggagcttgagaacagccttggcaaggtagcaagaccccggtctctaaaaaaaaaaaaaaaaaaattagctggctttggtggcatgcacctatagtcccagtgacttgagaggaccacttgaggttgggagttcaaggctgcagtgagccactgcactccagcctggtcaactgaacaagcctcttgtctctacattttaaaaagaagaagttatcctcattattaggcatttagaagtgaactcattaattcttttcttctattagcatagtaaaaaataaaaaataaatagctttttcacttgggtccccaatattttgtctctctgggaattaagactctctcataaaaacaagtgccctgccttccacttgaagactggaagaggagttagtgagaccaagaaattccacttttccatttctcaccagggatattacttataggtgtctttcaggttgcagaaaagatggaaaaaaggacatgtgcactctgccccaaagatgtcgaatataatgtcctatactttgcacaatcagagaatatagctgctcatgagaattgtttggtaagttacttgaaaacatacttcaaagtacatgagtacttttagtgtaggacacataagaatagataaacaacactttggacacaaagaataacaagttggccatggtttgagcttttaggtgaagattggggagcatttctttttttttttttttttttttttgagacggagtttcactctgtcacccaggctggagtgtggtggcgcaatcttgaatcactgcaagctccgcttcccgggttcacgccattctcctgcctcagcctcccgagtagctgggactacaggtgcccgccaccatgccaggctaattttttttgtatttttagtagagatggggtttcaccgtgttagccaggatgatctcgatctcctgacctcgtgatctgcccacctcggcctcccaaagtgctgggattacaggtgtgagccaccacgcccgggcctggggagcatatttttctgactttgaactgtttcagatttaaaatataacagacactgatagaccttctacccaggtataatttctatcaaagtctacagaattctgagatttatccatgttggtaaacatagctctaagtccttcattttaaatatgatgttcgatttcatgactatattaccattaactgttctgtgaatgggcatttagtttttccagtattgttttctatgactaacaagtcgtcatgaacattcttgtctaggtctccttctcatgtgagaatttccctagtctaggctatacagctaagagcagaattgttaggcacaggaatggggtgttttgtacttgactaaatacaccaaattgttcttcaaagagattgtaccatttaatacacctaacttaccaaacatcatagcttagtctagctcaccttaaacatgttcaggacacttacgttagcccacagttgggcacatcatctaatgcaatgcctgttttataacaaagtcttgaatatctcataaaatttattgaatactgtatagaaagtgaaaaacagaatggtttatgggtactatacaggaggatgtgtgtaggttatatgaaaatgctatgccttttagataagggaactgagcattcacggattttggtagccttgggggttcctggaaccaatcccctgcagacactgagggacgactgcactatggctttattactagccttggcttttattttggcactttgaatttgtggatcagcttttcatgtttgaccaaaataccttttggaattttgattggaattgcattgcatttatagatgaatttgggaaaaaaatagacacattcatatattataatatattataaataattaatataaataattagagagacaaaacctgttaatggatgggaaaaagatgcattcatatattatatgtattaatatattattaatgcagtatgtattaatatattattaatgtgttatgtattaatatattattgtgttatgtattaatatattattaatgtgttatgtattaatatattaattatatattatataaatataaataatatgcattttatataatatattactatattcatatattactatattcatatattcatatataatatattactatattatatattataatatatgaatgtgtcttttttttcccatccattaacagagtctgtctctccaattatttaggtcttttataaatttcaaaactgttaaataatttttatctgtagtcatatagaacttggggttgggcatattcctgggcaagttttttgttttgttttgttttgttacttttttctaaaagctttttaaatgaactattatcagtatatataaacactatttatttttatttattgatctcatccagcaaccttaccaaagtcttattagttctaaaacttctctagatttacctggatatattgtatgtggacaatcctcatctttaaataagaacaattttatttacttacctttaattcgggggactcttaatctctttttcttgtgtttttccagaacattcaattatagcggtgattacaagcaattaaatttggaagccctgtcttgcttctgatattaatgggatgctccaaaaatcttatcattaaatttgtgtatgttttacattcttaatgatttcatttaattaaaataaggaagttacctttatctctaatttgctaaaaattatagcgtattgaatattactaaatgcttgttctgcatctattgaaatgatccgggttctttttctctctctggccacaaacagtgctaaatgctttattttatttcacttttttatatacataatttgatgtttattttaaattacaaatttatggaaaagttgcatatacagtacaaagaactttttttggtcagaaccattttaaattaaatgatatgcaatctatcctgaatactttagtatgatttttttttttttttgagacagagtcttgctctgtcgccccaggctggagtgcaatggtgtgatcttggctcactgcaacctccacttcccaggttcaagcgattctcctgcctcagcctcccaagtagctgggattacaggcacatgccaccacgcccagctaattttttgtatttgtggtagagatggggtttcacgtgttagccaagatggtcttgatctcttgacctcgtgatccacccacctcagcctcccaaagttctgggattacaggcatgagtcactgtgcccagcctttagtatgtattttctacaaataaggtgatatgctttggctgtgtccccacccaaatctcaccttgaattgtaataatccccacgtgtcaagggtggagccaggtggagataagtgaatcatgggagcaggtttttcccaggccattcacatgatagtgatagtgaataaatctcatgaaatctgatggttttataaagaggagttccccaaaaatctctcttgcctgctgccatgtaaaacatgactttgctcccccttaccttcttccgtgattgtgaggcctctccagccatgtggaattgtgagtccattaaacctctttttctttataaattacccagtcttgcgtatgtctttattagcagtgtgagaactgactaatacacaaggacattctctctcacactataacaatataaacgtcaaaatcaggaaattttgttatactactaccgtctattcctcaaaccactgaggtttcacctgttgtactaataacgtgtgtgtgtgtgtgtgtgctttttttttgagacaaggtctcactctgttgcccagggctagagtgcagtggcaccatcatgcctcactgcaactttgacctcctgggctcaagtgattctcccatctcagcctccagagtagctgggactataggcatgtgccactgtgcccagctaatgttttgtactttttgtagagatggggttttgccatgttgcccaggttggtatccaacccctgggctcaagcaatcctcccacctcagcctcccaaatgctggaattacaggtgtgagccaccatacctggcctaataacattttttataacaaaagattttagctcatgggttgcatttggttatcatgtcttaagttttttcattttattctgttagtaatgtgtgttttacttatatattttttctgctgtgaaaccattcttagattaacaccatttaatggtgatgttttatttttacttatttatttgagacaaggtctccccaggctggaatggagtggcataatcatagctcactgcagccttgaactcctgggcttaagcaattctcccacctcagcttggactacaagcacgtaccaccatacccagctaattttttatttatctttttgtagaaatgggggtcccactatgttgctcaggctcatctcgaactcctggcctcaagtgattctcctgtctcagcctcccaaagtgttgggattagaggcgtgagctaccgctcccagcccaatcgtgatgtttttattctaatatactgttgatgttgatttgctactattttttagttaactttattggcataatttacataaaatcaaatgtacccattttaagtgtccaattcagaaagttttgagacatgttgagacccatgcaaccactaccaccatcaagatataaacatttccattaccccaaagggtttcctcaatgttctgtgcaatcaattccttcctaccccaagtccctgtagatttgtcttatcttttctcagatttcatatgaaaggaatcctatagttgtcctcctttgtgtcacttcctttgctcagcatactgttttagatgcatctatgttgcatgtatctgtatcttgttcctttatcattcttcacagtacttaattggtatgcatgtatcacaatttgcttattcattcatctgttggtagacatgtgttatttccagtttggagctcttatgataaaaatcagctataagcatctgtatatgagtctttgtgtctttatttaggcctttcataatttcaaaattgttcaatggcttttttttttttttttgagacggagtttcgctttttttgcccaggctggagtgtgatggcgcgatctcggctcactgcaccctccgcctcacaggttcaagcagttctcctgcctcagcctcgcgagtagctgggattacaggcacctgccaccatgcccagctaattttttgtatttttagtagggatggggtttcaccatgttggcctgactggtctcgatctcctgacctcaggtgatccacctgccttggtctcccaaagtgttgggattacaggcgtgagccaccgcacccggctattcagtaatttttatctgtagaggtatagaacttggggttaggcatattctgggcttgttttttgttttgttttgttacttttttctaaagtatttttaaatgagctattatcagtatatatgaacactattgatttttatttattggtctcatccagcaaccttaccaaactcttatcagttctaaaaagtctctagatttacctggatatattgtatgtggacaatcctcatctttaaataaggacaattttaatttggggcactcagtctccttttcttgtttggttatgtttgtcttgggtaaatagctagaagtagaattactgagtcataaagttagtgtatgtttaaccttaaaagtgattgcattattttacatttctaccaataatatgtaagaatttcatttgctccacatcctcatcaacactgggtcttgttattttaggcagtctagtagatatatattgcatctcactatggctttaatatgcctaagggttaatgatattgagcatcttctcatgtgctcatttgccattcataaaccttctttcatgaagtgtctattcaaattttgtgcccacttttaattgaattgtcttattattgagttgtaagtgttttctaaaatctggatacaagtcttttgtcagagatatgtattgtgaatattttctcccagtctctggcttgcctctttgttttcttagcaatgtctttcaaagacaatttttattttgatggaatccaacttactttttctttatgctttctgatttttataagaaatcttcgcctatgccaatgtcaccaaaatttactcttatgtttctcatgcccttttgttatttgagtgtaatatgtgaaacattgatcttcaattcagatttggagtcttctggtttcaagtagcacatagagacttgagccagcctaaacataaaagagggtttatgataaggttttgggggcatttcatgtttcctaaaggcaggcatgcaggtgggtgtaagaaacagctagaaagccattgggaacctagaatgtcctctttctagcccttgtttttctttctttgcagactgacttgctctaaccacgtggcttcagctattgctcaaagcccattccacacttttaggataggggatcagactgacccagcttggcatcagggttccacccaggtcaatgagttattagaggtcaggattacaaagtataaaacatgcccggaaaccagggtcattcccagagaaatgggatggcttatggtctgctcatccacccccaaagttgccactgttttacccccagtccatttcccactcctggtttgattttccacttttggtatgattttctgacatgtagctttcaatattactttgtgcatactctggatttttttttccaatctgcagctgtattcttcaggacttgtggaatgtgaggatcaggatccacttaatcctgatagaagttttgatgtggaatcagtaaagaaagaaatccagagaggaaggaagttggtaagtgtaaatgatgttatttcttatactggatgaacagaccctcaaggaatgcattccaaaggagtctatttgactgatacaccagggatagagaagcatcttggagagctggaagaagtaggaactgtattggaaacctcaattcaacttaacatttaatttttttttttttttttttgagacggagttttgctcttgttgcccaggctagagtgcagtgacacggtctcagctcactgcaacctccgcctcctgggttcaagcgattctcctgcctcagcctcccgagtagctaggattacaggcacgggccaccatgctcggcaaatttttgtatttttagtagagacagggtttcaccatgttggccaggctggtcgcgaactcctgacctcaggtgatctgcctgccttggcttcccaaagtgctgggattacaggtgtgagccaccacgcccggccaacatttaatattttaaaataaactaccatatacttcaccagtaaagtgatctgagttagaatgcttttgctgtaagtagaagaaagctcaagtcaaacagacttttacaaagaggatacttactttttcacttgatcagagaaaacacctgctttccaagttggttgattgagtggcttgataatgtcatcaggggcccaggttcttcctctctggcctcctgtccccaacatcagctggtcccattgtggtcatagggtggccgcaggcagcaactgaagcatcaggctttcttgttcatacccagtgaaagacaaaggtcatccatacacatggaataagcccccttctgaaagtttcattaggttgcacccctctttctgcaccaactgctgggggtggccataactaatcaggggtcagctcctcatgggtcataagggggctattcaaggaggaagaaatgctgagaagtcattccactgggcttattgcagcgacatcctctcaaggacccttcacatcttagcaagcaggacagcaagtgtgagcacctcacattctgactacaaccacagggttaataaccagggacaaatgtatagttagtctttgcaaggcatcagcatcagcagcatcctgtggtaggtgtgttacatacattgctctaggtaaactcccagctataggtaaaatgatgcccattttaatcgaagaaatggaaagtgcagggtgaaaggcaacagtccagatggaattctgcaaattatgctatcttaggcagtgtacacaatactgtagtaggtcctgaagcaagccataaaaatggactgtgtgtggcccgggcatggtgctgcatgcctctaatcccagcactttgggaagccaaggcagttgaggactgcttgagcccaggaatttgagaccaacctgggcaatatagtgggaccctgtctttaccaaaaaagaaaaaaaaattagcccgacacagtggcatatacctgtagtcccagctacttgggaggctgaggtaggaggattgggtgagcctggaaagtcgaggctgcagtgagctgtgatcacaccactgtactccagcctgggcaacagagtgagactctgtctcaaattaaaaaaaaaaaaaaagagtgtgtggatcctgctctcaatgtctatgctattactaattaatacttggcaagactggctgctgacatcattagtgctgacaatgccacatccctaggattttgggtgtgatgagatgggtgaactgattagaaagtagcagacagacctcaactggaatatttttttgctcttcactaattggatttgagtggggagacacagagttaaagaaatctctgtgaaattctagtagccatccagttatgaagagacccaggctgagaaatgagggcagttgattggaggcataatatttgggggaaagcaggtacctgagggtttctgcggaccttgggatgcagacttccctactgggaaggctttgggatgggttggaagtggaggataaaggagagaagagaggaaagtcacctgaggtaatagttaccctctcacagcatttatggaactcttggactatgtgggcagatacatggcacacacccagggtggggacaggccagtgctgtggtattttcagtaagctgggcaagtaccttgagggtgagcagcaggggccctcagcaagcaggctcctccctaggattcagactaccaatctgacagagccacatggacatccaatagcatttcagagtaaagtggccaaaaaagtacagttccatctcctatacacacacacacacacacacacacacacacacacacacacacacacacattctccatctaaatctgctcataaaaacagcactatcattatccatttgcccaagccagaagtctaaggactctcttttcctcgtcaacctcccagcccaacaccaagcccatgggcacgaactcctaggtgcatcttgcattcatccacccacttctctcagcgtcagtaatccaccatagcggagtcacccatcttgttctctaaagcgagtactgacactcgcccgactgtctctcctgccatccctaccccagcccgtagttctccacccagcagcagcccagcagcctgagtgatctttcaataatgttaatcagtttatgttccccgtgcagaaagataaaacccaactccttactctggcatgtaagtcctacgtgacccagcccttacttacccctttgatcatcctgagacttccctgtgcccacttcgctgctccaacagcactggccatctgtcttgtcctcgctgtagcttgccaatggggaagctcattcttgcggccaagacccaaggccctctgcttagaatgtctttcctcctcctttttgcatctgggagctcttactattattcagatctcagcttccatatcacctccttagaggtgacccattttactaactgcccagtctgaagtagggacccagtgacactgtcacttcaccctattttaattcgatataatgtgtatataactttgtgagacgttttaaactttgctttatttgatcattgtaccttgtctccaatagaatgtaagcttcacgtggacaggcatcttttctgctttgtccactactgttttcccttatcctaaaaccatgcctgccacatcatagctactgcatgctaaataaatactatatactcatgtatttttaaatgaataaatgtttattagccatttgtattttttcttctgtaatttgccagttaccatttttctgcaggttatcagaatcttaaaactttatctagtatgctacaaacattcttctttcaatcttttccttgtcttttaaatattttgaatgccctcactataaaatggaagtttaaaatttttgtatagtaggttctgtcagtttttgtttttgaaacagattctccgtctgtcgcccaggctggagtgcaatcacagctcaccgcagccttgatttcctggccccaagccatcttctggcttcagcctcccaaatagctgggactacaggagtgtgccactatgccccgctgatttttaaagttttttgtagagatgaggtctcactgtgttgctcaagctggtctcgaactcctgggctcaagcaatcctcctgcctcagcctcccaaagtactaggattacaggcatgggccaccatgcccagcctgtcagagttttcatttgtggcttctgggttttcttcctgccttagacagccttccttgcctccatactacgctttttttctttctcctatatttcctaatctttaagagttttttgtttaacattgttatctggttcgagctttaatccatgtacaacttattcaggagtatattgtgaggtagggatctaactttatttttttcctatatacatagccagttaccctcctcccaaattaaatgatcgttcttgtatgctctgatttgaatttccaccgttatcataaccttatttcttgcctatatttgaatttcctttaactgtttctatgcttgcttgtgccgaccctgggctatggtgtgagtgacctcctgttctgcaaggcaatttcactgtgcccccacgtcattcagccagagtatcatgctgatcagccttggtcctggctggattcccctaaaccagttaggctgctgtggccacacactgcctagccatcatgacaccactgtcacatataaaataccagatagataaatacaagccagggatcaaataaattgaaccaagaaaaaactgttaatagagttgtagaatttttaaaaatttttggccctactacctagattcccttactttatctcacattatcctcaatggcaactctgtaagacagatattatcacccacagcaggttctgagtccgaaagagaaatcacaccactctccgtggcacagccagcgaccaatctcgcctgtctcaaagggccccctagtggggccccttgcctggagctggacaagtttgcccactctgctttttagaaaattctttttaaaagacagagactgtttttttgaaacaaaaagcatttttctgcttttaatcagatcattacaaaactgtctgtccaagcattccggttagctgaggtttcgctgaaattcccaaatgagcagccaaatataagtactgtaccctaatgtttgtaacgggatggaatcttgctgatgatgcccaggataaaatgcagggcttctggaacttaaataacatttaatgatatctttgaattttaacaaataacaacaaacaggtacttactcagtaaaatctattcttctgtagaaatgcaaattttgtcataaaagaggagccaccgtgggatgtgatttaaaaaactgtaacaagaattaccactttttctgtgccaagaaggacgacgcagttccacagtctgatggagttcgaggaatttataagtatttaataaaacatttttaaaaccacatttgggggattgggataaggaatggttggattaagacaaggagactttgaagactaattttatgtaaatggttttcaaatgagaacaaagccagtttgggggatgcacaggggttatgtgaattttgaatttcagtgaaaaatctatatatatatatatattattttagtcacaatatcttgaataatgagatcaatgttaggacagcatgtttttttaaatatgatttttgtgagctatgttacattcgtaagatgatttttaaaaattccattcagaggctgatgtttttcctgccagtgggcatatattcctaattttcccatagtgttccaggcactattttatttatttatttaataaccacttgctttatgccaggcatagttctaagtgctttacaaatgttaactcatttaatcctcataatagtcaactgaggtagatactattatctccattttccagaggaggaaactggggccttgagacactcagtgacttgtccccaggttacacagctggtcagtggcagagctgggctgcaggacttccaagtcctcgctctttgccaccttgttgtcttcaggtatggggactatatattctaaaacaagagggcaagcctaccattgaaagaagcttgctaaataatttttttttttttttttttgagacagagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcaatctcctgacctcgtgatccgcccgcctcggcctcccaaagtgctgggattacaggcgtgagccaccgcgcccgggctaaataattttaaatctgatttcgagcaagttccgtaagtattttgttgctaatcagacatgaaatgtgtaaatatgtaaatttcgtactgcacttctttttatatttgattcactaagaaactcacaggttgttatagtctcagagtttcatttttattatttaccttaccaaagagctcgttttagtatgacctttacaatgaccttaaacacaagatcaaatgaaaaggaatgtccctgctatagcttaaagtttgaaaaaatatactgatcacacccattagaagaactaacaaatagggactcaataaaacagtcttcttgcattgttttatcaaggaacaggtgaatttttacgcatttttaaactgaatttaaaccttcatgcctatcatacatgaggcaccttgctaggtgctacgagatacaaagaataaaatatagattgaacctcagagaagttatcacctggtgggaaggccagaagaagggtcaatgcaaacagaagcacatgggataacgagagcaggaggggttacatgaaaggagcttggccttgagaattgttgacactgtggaatggatggggacatgggggttcatcctgatattttcaacactgttttatatgtttgaaaaaatttaagtacttgggaagtgaaagtgctcagagataccagaatcaaagtgggatgagattaactttgtttgggtgttgctgggaagactgcatggaggaggtgggaactggtataagatgggaagaaacggtattcccctaggcaaggaggccactgcttcctgagagtcagcgccatctgaagaggaagggagatgaagctgggtgccgaggaggaggaaaggttagaaagtggcctgagcagctctataaaacgattcacttcatttcttttgttttgttttgttttaagacagagtcttgctctgtggcccaggctggactgcaatggtgcgatctcagctcactgcaacttccagcctcctgggttcaagcgattctcctgcctcagcctcctgagtagctgggtctacaggcacgtgccaccatgcccagctaatttttgtatttttagtagaggcggggtttcaccatgttggccaggagggtctccatctcttgacctcgtgatctgcccgcctcggcctcccaaaatgctgggattacaggcatgagccaccgtgcccggcctcacttcatttcttcatcatagcctgctatgctgctgctttctcttggaagatactaatcagttctaggccctttgtaggtcaaatctaagatctggggcaaatacctgttttcatcgaaaatgactttttccttaaattaatgcttgcaattttgtgctatttattgttgaaaaccagcagaatcttgtacagtcagatggaaatctgcatgtcttagattgtggatctttaggtatctttatacagtaaaatctcactgaccactgtatatgaactagtattgttcataatacttcatcagtactcattccttgaaagaacataatcatcttcctaagtccctgagggcataaaagacatctaactgagtctccatctgcactcagtgtgggtcactaattttacacagggcttcaaaaaaaaaaactttagtgtgacgccgtcatgaaaagtaggttggtacgtttttaatcacaaaaatagacataatatttgaaacctgtaaataaaaatattttacaattctttgaaattaaatatttcagactgctttgccagcaacatgctcaattcccgatcatcgctcaaagtggtaagtttctaaaatttagcactgtgggttttaaagaaaggtaaacatttatgtaacataaggaatagtctaattttctagcctcgttgaattaaaatacaaatgtttgagttaaaattttacacatctagaaaattgacaacttctttgtgtactatgtgatatgactgactaattttttcttctttatgaacaagacctattctctttgaaccattccctggtatctttcattctccctacgctcacagaaccaaactaagacatgggaaaaagccttgacttttgggactgcttctcttccataagaattttcagtagataaaattttaaaagtgctgcaccttccctgagtgaaaattccctaaggatgcatggttagcatttcagttctaattaaggcagactggatcctggctaactggagtcatggggtatactttcattcatgagtggaacagcagtgtcttagcagcactacatctgcaatgttcattgtgaagtggagtcaggacctcgttggaagacttcgttctgcgtcatgccaactgcattttatggtgataacattctccaaatagcacctctacaatcatttttcagtcgttacccttttaactcagcaggaaaggctattacagatacttctttaaatcagtgtttattgacagggaaaagcaccagcaatacacacttaaccaaatccttgcaaatgtcatctattaaatatcttcatccttattagtctgttttactttgaatatcttctgagtgaaattgagtgcattcccatatcttttcaccaattatatttgttttcctatgacccaatttgttcatttttctattcaatgaaccctctccccagagagttccccatgtgccaatttttctactcaattatttacctgttttgcattaaacttataatatcttttttaaaaattaaccctttatcataagtgctgcaaacacttagttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacaggtaatttgacttagtttttatagctttgcatttcttcatacagagtccttatttaaaccagtctgaatgtcaggtgaaaggtactttccaaatcgtccaaacagagagcctttgaagaacattcttcatttgtgttctcagctaaggctgctcctgaggttgcctttttaggaagaatcccatagtcgggaagctcttagataattcctagatgatagaatcatgatgagatgagcatgaaaatgaagctggaagttccaagcacataaccttcaggaggtgacattctccgagctcctataaattccctggcaccaaactagtgagagcatctgaccccacaggtgcttacagttaaaacgggcagagggtgcagtcaaacatccttatggagccaagtatttcccagctgcatgacccacacctgaccaaatctgtagctcttataaatttctggattatgtataaaatgtatgaaaatattttggggatttgagtttttacacatcagcacatataagctaaattcatatgcgccagcaaccttcacctcctcctgtttatacaaggggtgcttgtcaaacacctcttaatgttttataatacaaaacaaaaatatatttgatgtttacatctaaatatgaatatggggtttttttgtttttttttttttttgagacagagtctctctctgtcacccaggatggagtgcaatggtgtgatctaagctcactgcaacctctgcctcctggattcaagtgattctcctgccccagcctcctgagtagctgggattacaggcatgcaccaccacgcctggctaatttttgtatttttagtagcaacaaggtttcaccctgttgtccaggctggtctcgaactcctgaccttgtgatctgcccatcttgccctcccaaagtgctgagattacaggcgtgagacaccgcgcccagccagggcatgatttttactgtaggcatatcatttagttatgcacagcaaaagactggttttcattttatgcaatattaaaatcaatgtaatgcaatcttgattttctctcctagccacccgaaacaatgaaatgtaatacattcataagacaagtgaaagaagagcatggcagacacacaggtttgcgctaagtgttgtctgtaacaaatatggcctacaatacttataaaaatgtcaacccacctgtttcaaacttggtatcccgcctaaatctttattcttctaggcttgtggtaattaatgagtataaatctttatcgcaactgtccactctattgtaatcccagcatatcaagataacttaggttggaatggtccattgcattcagtattaagaaaagatagacttctattaataaagacacagacaggcttgcctgagctcagaatccagcaatgtgtcacccctcacactgtgacccctgtaactgtagttctctgttctttaaagaaatagacattccactaacaacacatacaaactgtgacaagaagtgacaggggctgttatgtcaaagacttaagggtaatttttaaaaatcctcttaattcaactacatatcgggtacagtgtacactgctcaggtgacaggtgcaccaacatctcagaaatcaccactgaagaacttatccatgtaacctgaaaccacctgttccccaaaaggtattgaaatttaaaaagttacagttttatatgtttaaaaaagcctcttaattcatatagttattgtaagcagagaaattttcatttttactttttgtaacattttattcattgtttcagctggccaaaaaaaatgaggtatgatgaaattataattaataaaaagggtgaaggtgctgtattattttactaagtatgtgcatccaccactaggcaaggtctgaagaaataagcataaagtaatttatgattagctgccctaagactatttccttctcaaatgtttgtcttattcttagatgcaactgtgaaagttccttttcttaagaaatgcaaggaagcaggacttcttaattacttacttgaagaaatattagacaaagttcattcaattccagaaaaactcatggatgagactacttcagaatcaggtactgatgaagagcaatatttcgaagtatagagacttctcccagatctagatttaaaacaaaacaaacccaagaaaaaaaaaaaggcccattttcttcctatactacttttttcttctatcagcttttggaaatgcttactatttatttcactttttggttttgccctatagaaaataatcccattcaaataaacattttttatattgttgcctacaatataagctgtccagcttgtcattctttacctttacctcattcttttttttttttttaagacggagtttcgcccttgttgcccaggctagagtgcagtggtgcgatcttgcctcactgcagcctctgcctcccaagttcaagcgattttcctgtctcagcctcctgagtagctgggatttcaggcacacgccactacgcctggctaattttctgtatttttagtagagacaaggtttcaccatgttggccaggctggtcttgaactcctgacctcaggtgatccgtccacctcggcctcccaaagtgcttggattacaggcatgagccaccatgcctggccctttacctcattctttaataaaataattggaccagatctactatccttcataaatcaacaggatgtgggtaatttacaaactcagtaatttagtcaaaagtaacctcatgccctgagagttgtggtacattttccagaggtgtctaacaggttggccactaagagaatgtgccattcagagattgattcggtcacatatgctcccctgccaccgccctgcattcctgttgctaagatctgagaacagtgttatgttacagttttgattttggaatccaattctattccttaataagccaagtgtccttttttaaataaggttaactcaaactttaaagtatagaagaaggaattttaatgttttgactgatgtttggtttaaagatgtactttgttaaagaagtttctttcttaagggctctttgggaagtcaaagttccatttgtatgtgcaggtatatagctacttagctttttgtttgtttgtttttgaggcagagtctcgctctctctcccaggctgaagtgcagtggcatgatctcagctcattgcaacctctgcctccagggtttaagtgattctcttgccttagtctccagagtagctaagattacagacatgtgccaacacactcggctaatttttgtatttttagtagagatggagtttcaccatgttggccaggctggtcttgaactcctgatctcatgtgatctgcccgccttggcctcccaaagtgcggggattacaggtgtgagtcactgtgcccagccttacttagctttcttataacttatatcccatgagtttaaaacctttattataaatatagttattttacaaggacaagctggacagcttatattgtaggcaacaatataaaaaatgtttatttgaatgggattattttctatagggcaaaaccaaaaagtgaaataaatagtaagcatttccaaaagctcatttattatactattttattcatttatttcctctagaccaagcacttcccaaacagtgtgcctgagaaccacctgtagggctggtgaggacacagatagctgggcctatcccacagagattctgattcagtacaaataccaagaattgggggccaggcgcggtggctcacgcctgtaatcccagcactttgggagcccgaggtgagtggatcatctgtggtcagcagttcgagaccagcctggccaacatggcaaaaccctgtctctactaaaaatacaaaaattagccgggcgtggcggtgcgcgcctgcaatcccaactacttgggaggctgagacatgagaatcgcttgaacccaggaggcagaggttgcagtgagccaagatcgcaccactgcactccagtctgggcaacagggtgagattctgtctcaaaaaaaaaaaaaaaaaaaaaagaaaaaagagaaatgccaagaattacatttctgacagcttccctgtagtgctgctgctgctgttgccatctaacattaaagttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatactgtacaggtgataaaaatattttagaagaatgttcattgttttcttaaatgagaaaagccaattacaaaaacagtatgaccccgcccacctgcccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttcctgcggcttctctgctcttgggtggcgaggctatgataaaccatccctccgcttgcctccctctcgcttggtgagataggtcaaaattttaattctcccactattaatcctcaaatctaatttaatttcttatcagggagggttacgactgatttaaagttcatcagaaaaaaaaaaaacaaaaacaaacaaacaaaaaatgagcaagtaagaatagccaagaaatgtttgcagtagaaaatctcgtttggtttggaggagggagatttaaccttcctattaaatatcaaccatttattgagtgagtcctcctttcagcattaagatgccctcaagacaggctacacctccacttgtttatgagtctggtctgacttctctatcaaggctgccacacacagctgggcaggccgggcacagagtcaaacagcattggtggatggctccccctgaagttgcacaacagagtgagtgccctccacactctgcatttccacagatgcatctgtctctccagcatatggtaggaagacaataagatttccctgtgaagaaatcattagttcatatccctgtctcaacatacacaacctttctcattttggcttctatattatacatttctatttgaattttttactacatttataaccagcaggaaaaatactttgaaaaatctaccaaaaagagtgtctgtcttaatagtcttttgaggatgtctgctaatatatagcagtatccatatttttttaaagcagccttaaaaatttttttctaaaaagagttattttgtaggggacttccatgtgtgtttttctttcatgtaagggaacatgtcacacatcactacttggatggattaggtgggagtacatatattatagtgtagtatggcgggggtgccactacttagaactgcatgagattcaacttaaaaggcttaagttgggtttcactaccctggttgataaaaacttgcttaatttagccttactcatattttaagttaactatacgtatgcagttattctgaataaagtttgtatatgtgtgtaactgttcgattttgaggcttttaaaaattacattgccattgactactatttgttatttataaagcctaagtatcttcctcctaagcttttctaagtttccacaattaaaagccttcctatttctaaatgaaaccaaaagcctttatgtaacattaaaaattggacacatttttaggaaggatttgtccttaaccttggtattctagccacattctccaattatcatctctcaataaatggatatagtatagcatgaaggttatacagtcactgttttcaagttctcaaagatatacaaagggacttgttctgctataaatgtgcacaaaatcttaagggtttactgaacagctttgtgtatgataaatgttagaattctgtcctgaattagaaggaggaagtgaaggcataaagaaaccagctcctgcccataaggctctggatccttttcaccagaggcacgaggattgtgtatctgtacctgcaagtgaaaggggctagaaatggtacattatttctaataaaactactgaataagctgaaataattttatttcttcttttcatagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatact

SEQ ID NO: 38715 - DNA, 22917 bp, Homo sapiens
ccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaaggtgggcacaggctggaggtggctggggaacttccggtgggaagtgggccccgcaggacctggccttgcccctggccagaagggccttggagagggggctttagcctgccctccctctaccctcctccccatcagtttcctcctttggtacctgctggcttccagagccatcttggggccctgagaactccttgggctggctctgtgctgagatggggctaggggactcgcagaggacacagggcattgaacttggagacctcctgggctggtgggagacagacgtcagttgacctgagaagcaggggtacttgcctcttctcttgtcccctgcacctagggttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcaggtcttagcttcagtgttaccccctcccagaggcctcccctggtctccttaacctgtttatttccctgccagcaaggatcgcaatctgactttttttttttttcttgttaaacttgttcattgtctccccactgggcagggagatccataaggagaggggccctgtttataaatctctgtgggattccagttcctgggacagtgggtggcacacagtagaagctcaataactgcttgttggataaatgaatagaaatatgagggaccctgggaatgggaaggacaaacaaccaaatgagcctagtgtgaggaggagtggggaatattagagaacccctcccggagaaagggacttttagtctgggtgctgaaggatacgtaggagttcaccaggaagacagagaaagcagcacacacaaaggatcgcctcctttcctaccccattactctcagctcctgaaaataaaccctgtgctaactggctcctgctgtactggctttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggtgaggagtgcatggctggcctgaacccaagggacagcaggacaggatattcttgcctgtagaacagttcttcctaatggcacgttctggcttcaggaggcctggcttctaaccctagttatgtcattaatcaactgtgaaatacagagcaggtcacttcacctctcagtgtgtcctcattttaaaaatcagaccgtaacagtagctatctcatagggttgttaggaggtgtactgtattaggatgttaggccttatacaacagaagaaaacggaacagtgacgtaaacaaatttgatggcagggagtccagatagggaggttctgctcccgacagtcctcagaggctcatattgtttctctcaccattctgccattcattcccagattcctcatggtgcaaaatggccattccagctccatccagccatcacatcacaggaggaagggaagaaagacacccctccacactcttctaaagagcatagctcaaaaattgtacacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgttattttttgactgctttttcattactggatagtaaggcaatagttttatggtttctgatttttggttctcttggtgggtcccatttggtttttcttaaaacagttttatttatttatttatccttacagttcgaccatttaaagtatacagttcaatggcttttagtatattcaaggttgtgcaaccattgccacaatcaattttagaacattttcatcatcctgtaaagaaacctggtactcattagcagccagtcctcatctctctaccttttccctaactccccaaccttaggcaaccactaatctactttttatctctagggatctaccttctggaaattccatataagttgaatcatgcaatatgtggccttttgtatctggcttctttcacttaggatcgttttcgagattcatccatgttgtagcatgtctaacaacttcattcccctttttttttttgacatggggtctcttgtctaggttgaagtgcagtggtgccatcatcgctcactacagcctcaacttcctggattcaagcagtcctcctgccttggcctcccaggtagctgggactactggcatgtaccaccacacccggctaattttttttttctttgagatgggagtctcactctgtcccccaggctggagtgcagtggcgcgatctcagctcactgcaagctccacctcccaggttcacgccattctcctgcctcagcttcccgagtagctgggactacaggcgcccgccaccacgcccagctaattttttgtatttttagtagagacggggtttcgccgtgttaaccaggatggtctccatctcctgacctcgtgatccgcccgcctatgcctcccaatgtgctgggactacaggcgtgagccaccacacccagccacacctggctaatttttagaaagtctgtagagataaggtcttgctttgttgtctgggctggtcttgaacttctggcttaagcagtcttcccacctcagcctctcaaagtgctgggattacaggtgtgagccaccatgcccaaccagaactttattcctttttattgccaaataataatctattgtatagacatatctcattatctttactcattaaatcagttgatggacatttgggtgtttctattttttggctattataaacaatgctgccgtgaacatttgtgtccaactttttgtgtggacacgttttcatttctcttggatacacactagcagtggaattgctgggtcatacagtaactctatgttactttttgaagaaatgccagacagttttccaaagtggctgcaccattttacattcccaccagcatatatgagggttctagtttctccacatcatctctaatacttgttgttgtttatctttttgattatagccatcctagtaagtttgaagaggtatctcactgtggttttgatttgcaatttcctaaccatttgatgacaaatgatgttaagcatcttttcatgcacatattttctttggaggtttgcctattcaggtcttttgcccattttaaaattgggtttatctttttttttttttgagatggagtctcgctctgtcacccaagcaggagtgcaatggtgcaatctcggctcactgcaacctccgcctcccaggttcaagtgattctcctgccccagcctcctgagtagctggattacaggtgcccaccactacactggctaatttttgtatttttagtagagacgggtcttaccatgttggccaggctggtcttgaactcctgacctcaggtgatccacccaccttggcctttccaaagtgttgggattacaggcatgagccactgcacccggctgggtttatgtttttatattgagttgtaggagtactttattcattttagctagaagtactttattcattttagcttatcagctacatgatttgcaaaaattttctctcattctgtggattgtcttctcactttgttgatggtatcctttgaaccacaaaagttttaaattttgatgatgtccagttagtctatgttttattttgttgtttgtgcttttggtgtcatatctaagaaatcgttgcctcatccaaggtcatgaagatttacctctatattttcttctaaagattttatggttttagctcttacatttaggtctttggtccattttgatttaatttttatataaggtgtgaggtaagggtccagcttcattcttttgcacgtggatattgagttgtgccggcactatttgttaaggctgttttcctctgtttaatcatcttaaccctttttggaaattaattgaccataaatgtgagtgcttatttctggactctcatttctataccattgaactataatatatatctgcccttacgccagtaccacactaattactatagcttcatagtatttgaaatcaggaaatacaagttctccaacttttgttctttttcaatattgttttggttattgcaagtctcttgaatttccatataaattttacgatcagcttgtctgtttctgcaaaaaaaaaacaacaacaactgggaattttggtagggatttcattgaatctgtagatcattggccacttgattttaaacaaaatattgagatatctacttcttgaaatgattgcttgagacagtacctgtgtactccttgctatgaaaaatgaggaagttaacatactcatcttccacctttccttttccttactttttttgttgaagtatcattgtggacactttcccagttgacttccacttgatcccctgaattaactaactggcactggcgtttcctttgtaaaatgtacaatgtcagccaccatcttgctactaaagtgtggcctgtggaccacaacatggggggaatctcaggtctcacctcagacttgctgggtcagaacctgagttttgagaggctctgggcaaccggcacctctcagacctgctgttgggttctcatcgatggacccgatgcttcctagcaaatgatacctgttgtatgtgttattggtaataacatagtttacttagctattacattaattaataaaacatgagcgctgaaagagttgtttctgtgaaaataagctgattgctttaaaaagataagagacaaatcaccaaaaaaaaaaaaaaaaaagattaacacttttgggtgagacagtagtaaggaaatacagtaaaaatccagaagggctctgtgctctgatgcttcaggagtgtgtctaagttcttgctcgctttaaagaagctgctactagaaattatagatcatgattatcgatgtggttcatacaaaaaaaaaaaagaaaaatccctgggaaactccaatgagcaggtataaactcacgctgggcatggcggctcagcactttggaaggctcaggcaggagaatggcttgaactcgagtttaagaccagcctgggcaacatagtgagaccttgtctctgcaaaaaataaaaaaaattagccaggctgggtggcacacacctgtagtcccagctatttgagaggctgagatgagaggattattagaccctgggtggttgaggttgcagtgagccatgatcatgcctgagtgacaaggtgaaaccctgtctcaaagaaagaaagagagaaaagccattggctgtacacctagagactggccagtgaatatgcatttatagtatgtaagttaaaattaagtgtttaagctttgtctgcagctgtttttgtgattctctgctgttcaccagcgatcctgatgtcacattggatgagagagctccagctgtatttttttgttgatagtgttaagattatagctttaaaaaattttgttttctaacataattaaggcctttatgctttgcctctaggttgattctaaaagtgtaacactactagaaaggatttatagtattttgattatggaaatattattcactatagaataactagtgcagttgaaaccatatgcacttttatgtttcaaaacccttattgctggaagaacattttggggttaagatccagtccttttcattttttacttttcttctattctcctgtatcagactcatctatttttgtttttcaagaacttttcacgtggaaaatgtggtaaacttttagagtctttgcatgtttaaaaatttctatattttgctctgtcaattcattgatagttgactgggtattcaaattgtttacctgaagaattttgagagcattttctggactgcttttaaataaatttcagatattattttatccttaaatactttagtatgtgtcttcaaaaaattaggacttggcggggcacgatggatgatgcttgtaatcctagcactttgggaggctgaggcaggtggactgcttgaacccatgagttcaaaaccagcctgggcaacatagtgaaaccttgtctctacaaaacattagctaggcatggtggtgcgcccatctagtcccagctacccaggaggctgaggtgggagggtcacctcagtccaggagattgaagctgcagtgagccaagatcatgccactacactccatcctgggtgacagaagtgagaccctgtctcaaaaaaaacaaaaacaaacaaaacccctcaatactattatcacaccttagaaaaggaataagaattccttaaaatccgctaatgccctgtttatattcacattttcctatttcattagtgctttttacaattggtttcttcaaatcaggagccaaacaagatctacatgtagcatttcttactatgtcttaagtcccttttactctcctctatttttatgccactagttttttttttaagaaacctggtcttttgacctctagaattttccccatattctggatctatccattacctcttcatggtatgtattagaccactctagcattgctacaaagaaatatctgagactgggtaatttgtaaagaaaagaggtttaattgactcagttctgcaggtggtgtaggaagcatggtcctgacatttgcttggcttctggggaggcctcagtgaacttttactgaagcgggagcaggcacttcacatggtgagagagggagcaagagagagagttggtggggaggtgccacactttacaacagccagatctcacgaggactcactatggcgagaagtcactacagtgagcgcagcaccaggctgtgagggagctgcccctatgacccaaacacctcccaccaggcctcaccttcaacactgaggattacagttcaaggtaagatttgggcagggacaaatacccagactatcatggtgtcatttactatctcccgtttttcctgtaactggtagttagagataaagtttcaattagtcagcagtcactttttttttttttttttttgagacagagtttcactctgttgcccaggctggagtgcggtggcgcaatcttggctcactgcacggtccgcctcccgggttcacaccattctcctgcctcaatctcctgagtagctgggactacaggcgcccgccaccgtgcctggctaatttttttttttgtatttttagtagagacgggttttcaccgtgttagccaggatggtctcgatctcctgacctcgtgatccacccacctcggcctcccaaagtgctgggattcagcagtcacttttaatgtgcaggaactcttcctcattttttggttgcttcatgcctttccttgctttctgaatgcagtgttttcccaaatctctctgaaggtactagttagacttcactgttgcttattgttccataccctaaatgatctctgtttcctttggggtcggttctgttttttcatcttttcatgcttttgattttccaaacatgttggaggatcctcaagaaagttaaaaccactttctctggaataataccatgtagatttaaatcctgcctctggctgaacacagtggcttactcctgtaatcccacttcgggaggccaaggcaggaggatcacttgaggccaagagttcaagaccagctttggcaacatagtgagaccctgtctctacaaaaacttaaaaaattagccaggcatggtggcatgagcctgtggtcccagctacttgggaggctgagatgggaagagcccaggaggttgatactgcagtgagccaaggtagcactactgcactccagcctgggccacagaaagagagcctgtgtcttaaaattaaatcaagacatacaaatgaatcctgcctctaacagttattagttgcttagtttggcagagtcactggaacctatctgtgcctcacatttttatctgtaaaacagggatacagcagtacctgtctgatgggttggttgagaggattaaatgagttaatacacatgaagtgcattaaatagtcttagcacgtagttaacaacaacttctggtggtttcactaaggagcaggggagagaagacagaagaggttggagaggtcagggaggtgccagatcatggaggccctcgtgtgctgccacgagttgattctaagagtagcgtggagccattggaggggcctaactggtgggttctaataaaggaagaagcatgggtggggcctaccccagactggggtttgtgtgtgtgtgtgtgtgtgtgtgtgtgcatggccatgtgcctgtgtgcaaatatgtacatgtctgtagccggtggctgaggctggacccctggccagagcccatgctgagcccctgctgttctctgcaggctgtgggtgagcgtggaggatgctcagatgcacaccgtcaccatctggctcacagtgcgccctgatatgacagtggcgtctctcaaggacatggtgagtgaggaggcggagggcgacactggggtgaaggctctccctttcactcctgcttcctctctctcctctggccctcccttcccactctccctctctttgcccccaccaggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaaggtgaggctctgccctgagcaccgccggacccagcgggggccctggactcacttgagggcatagggcaagcaggggcagagcccctgggtttttagtcagggactcacccagaggaccctatccaagtggggaagagaggacctaagacacatgggagggagcatttcagggacccatcatgagaacagctggcacggggaggggtggactccgtccaggctccggcattcccagctgtgtgaccttgggcaaggttgctcctatctgctgcccagtttgctaaaatcataaattgggtatgacagtgatcgtgataactagtgtttattcttaatttttaacttctgaaatgtttcagacctacagaaaagttgctaaattttacaaagtagtacataaagaattcccatgtacctttcatgtgggttttaccacatgtgctttctttttttttttgagacggagtctcgctctgtcgcccaggctggagtgcagtggcacaatctcggctcactgcaagctccgactcccgggttcacgccattctcctgcctcagcctccggagtagctgggactacaggcgcccgccaccacgcccggctaattttttatatttttagtagagacggggtttcaccgtgttagccaggatggtctcgatctcctgactttgtgatccgcccgcctcggcctcccaaagtgctgggattacaggcgtgagccaccacgcccaacccacatttgctttcttttatcattctctttctatataaaattattttttttctgaaccattttgagagtaagttgcagacatgatgtctctttcccctaaataattcagtgtgcatttccttgaaaagaaaggtcattttcttacattactgggtataacaatccaactcaggaaactaacgctgatacagtactggtatccagtctacagatcttactcagattttaccagttgtcccactattgtcatttatagcaaaagacttggcattctgctgtcatgtctcagtccctttcaaagagtccaggccagtttcttttttttggcgggggttgggggctgatgtttcctccggagtggatcaagtcactgttttggcaggaccgcctcagcggtgctcttgggtccctcttggtgcatccttcaggaggcacggaagggctggtgttgtgctgggttttgaagctcaaaggacatagaagcatttatcggtggaatagggaccctgaccctgggggagccaggatgcccacttggccagatggaagctggaggtacccccagggaggagggagaggatagggggagggtctgcctggctggctcagggagacccacccccatgggtgtggaccaagtgggccgcgtggaaccaccaccctttaaccctcctccacagatctgggcttcaaggacctcacgctgcagccgcggggccctctggagccaggccccccaaagcccggggtcccccaggaacccggacgggggcagccagatgcagtgcctgagcccccaccggtaagctgtccttggcctcagtatcctcttctgtgcccctcccttgcctcaccctgcccagtcgggctcacagcaccctctgctcccaggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcaggtgggcgggaaagtccctggacagacacctgcagaccgcacgggggaggtgtaggccaggaagggagacacctgcgcactgccgcgcctctccgttactgccttgcccctcccaaccatgctgctggcagtgaccctgcacctggctgtgaccctgcacctggctgtgacctgccctctctcaaaggtcaccctgtggctgagacccgctccctggctgtggcgcacatccaggttcacatgccccactcccacgtgggctgtggctccatccccagctttgacacaccacacgagtatggctggccatgaccccagcaccctagccatgaccccagcaccctagccatgaccacacctcagctcggacctcacccccacccgtctgtgacctaagcctgctccacctcgccgtgacctcaccctggactctcctactcctgacctcttccctctcgggctgggcccacccctgacttcctgagagcctggcctggaccctcgctgcgccctagggggatgacccccgaccccggtcctacgccttagccctaccccgcccccatcgtgacacacgcactaatgacacagacattgatccccgagtgctccccattctgatctcacccctggccccacctgcattccccttggacccggtgctgcccctggccaccccactcctgttcccgtctcagctcctcggcttcgtcacttccccacccctgacgttgagtggctccaccagccctggcccgggccctgccctgctacctgactcaccactcagaccccggcccccttccttaccttgctgccattgctgtctcacctggcgccttccgtggctacctggccggcctcccctcccttggcttccccacctccacctggcctcactcccagccccgcccctcccaacctgcctgctcctgcccatcccccaccccccaccccccatcccccagccccacccccatcccccacccccgtcccccatcccccatccctactggctcccagctttgcctgtggctggtctgacccagccctgaccacgccccctggcccttcccccttcggggtctgacccgcccccgaggccctgacccgccccgtggccccgccccgtgtgcccagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcaggtgcggcccccagtcccacccccggcaatgcagcttaatcaaagccgccaattacgcagggctggacgtgggtggggccctgtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctgccagtttctgagtctcctgtcatggcccccccacccctgaatgtggggaacacagacccgctcaccacagcggacccttgtggagccgcccctgggtgacaggctccgtgcctgcctcctgcagcttacattccagcagagaggctgatgagaatcggataatcgctggttgatgtctttgtgaattgtgtcaaatgctacatacagtacattaagagacaacaggagtccttcccagagagggtggtctggaagcttccaaggaggtagccccagagcagggaccggaaggcctgctgtaggtgtggggtgtgggcctggcctgttggaggagactgaggaggtctcttggtggctggagcagagggatgaagggggtaatcagagcaggatagagaggtgttgggtacgtgagcagcagtgaggagttgggatttgttctgggtaggatgggagtcactggggagacatggctgctgttctgagatagactctaggggccagatggatgcagggagcccagcgaggaggctcctggagtcacccaggtgggggatgtggggcctggaccagagaatcagagcggcagtatggaggcagggtggaggccttggtgatgggttggtgagagggatgggaaggaaggagatattgaggagaagtccacctggggtgactgagtgaggcccctggggtcaggccttgccatgtgagggatggagtccccagtgaagggggttcctatgatcctaactcttttcccctcccctcccctagggagtgcctgcagggcaccatccgcaacagccaggaggcggaggtctcctgccccttcattgacaacacctactcgtgctcgggcaagctgctggagagggagatcaaggcggtaaggcctcagggtgggagacataccccaagtcccaactcctaaggaactgggccctgagcaggcagcagacatctttcttttctttcttttttttttttggagatggggtctcactatgttgtccaagctggtctcaaactcctgggcttaagcgatcattcatcctcagccccccagacatttttcaagagctttgtccatgtggggtgttgagaccccaagcagaaaaagaattgaggggagtagctagtcaagaaaccacatctatgaaggaaggacagcagagttgttaagaatcagggactcggctgggcgtggcagctcacacctgtaatcccagcactttgggaggatgaagtgggcagattgcttgaacccatgagttccagaccaacctgggcaacatggcaaaaaatattcaaaaaatagccaggcgcgggggcatgcgcctgtagtcctagctacttgggtggggtctgggatgagtgggctgaggtgggaggattgcttgagcctaggaagtaaggttgcagtgagctgtgattgtgccactgcactccagcctgggcaacagagtgagaccttgcctcaaaaaaagaaaaaaaaaattagtcagggaactctggagcctggtggcctgggtgtgtgaccacaagtcagatatttaacctctctatgcctctatctcatctctgttagagtcagagttacagcttctatttccaggattgcaaagattacagtagaggatatgtgtatagaattcatagtagtacatccaggcgcagtggctcattcctgtaatcccagcgctttgggaggccaaggcgggtggatcacctgaggtcgggaattcgagatcagcctgactaacatggagaaaccccatctctactaaaaatagaaaattagccgggtgtggtggcgcatgcctgtaatcccagctactcaggaggctgaggcaggggaatcgcttgaaccccggaggcggaggttgtggtgaactgagatcgcgccattgcactccagcctgggcaaccagagcgaaactccgtctgaaaatatatatatatatatttagagtagtgcttgtcacatagtaagcctttgttgttgttagcgcttactgtgtaacaaatcactgcaggctcaaaacaacagtcatttattcagctcataaatctgcaagttaggacagttggccctctgtatctgtgggtaccacactggagaattcagcaacggtggatagaacatattcttacaaaaaaaattacaataaaaaacaaatttaaaaaacaatacagcataaactatttgtataacatttatgttatattaggtattataaataatctacagatgatttaaagtgtatgggaggatgttggtaggttgtatgcaaatactgcactattttatataaggggtttgagcatccatggatttgggtatctgcaggggtcttggaaccaattctctggataccgagggatgactataatttgggctggacttacctggatggttcttctggtctgggcagggcctcgctgatttcacctgggcctggctggtgggtcagccgcggtggcctggtttataatggtctcatctgtgatgactgggatgactggggcctccttccacttcaatgtctcacccaccagcaggctgcccgggccttctcatgtcatggtggtctcaaggttccaagagcagccatggggagccccagtgcatgtgtactttctaagtctgctcatttctcacttgacactgtcccattggccaaagcaagtcccatgctcaagcacagagtccattgggaagggaccacccaaaagtgtggaatcggggagacagaaacaaattggagtcaccactccgccagtctgtcacagcgttatgtgtgtctgcatacgtgtgtgcttgccgctggcgctcttcatgaattcgttagcaggttctctgcctggctgctggtgatctcgagcaagttgtttcccttctgtgggactccatttccttatctgaaaagtggacagttgggcttgattcatggttttcaaactgctgggaaatgaccttcccagacttgggcactgtgggttcccaggccaaaacatggcagccgaggcccaaatgggagatccccacaaaacacatacacagacctcctctttatttctgtcccccctgcctctctcctatgcccctatttctcctgagaatgctcccaacttcaccaagtgtttatggagcccaagaggttctgcccctggggaaaagggggaggcagaagaggtagaactttgggagttcacagctctgatatcaggagcagccccatttttctctgttgtctctgggtggttgctgaggctccttcgctctggcctggagagacctcatgaccagtcattccatatgtccccagcacccatagccatttgcttagaggtttccctgtggagtccaccccagccaaggggcattatgctggggccaggttcatgccaaagggctgcatgaacttccctggagcccactggagttgatgtgagtctcagaaaatggtcaagtgtgacagagagaaggaggcagggatcagccaagtaatgtagtggaggttgtttttacaaaaacagaaaaatatgcctcaccacatagaaccagagcagaaatcagagagaaaatcacccacaaacccaggaaatcctccaattgcattttatcttatttccttcagtatctctgggcaaattttttttttttttcctttttgagatgaagtctcactctgtcatccaggctggagtgcaatggcgcgatctcagcccactgcaagctccgcctcccgggttcacgccattctcctgcctcagcctcccaagtagctgggactagaggcgcacaccgccatgcccagctaatttttgtattttcagtacagacgagttttcaccatgttggccaggctggtcttgaactcctgacctcaggtgatccacccacctcggcctcccaaagtgctaggattacaggcgtgagccaccgtgcccagccagatatgattttttaagtcaactttacttaagtatactttgcacacaataaaatgtactcattgtaagtatgcagtcaggtaaattttaacaaatgtaactctcgtaaccaccaaccactgttacatataacataggcatgatttctgcctcattgtaaccagcatggatacaatcgctttagcttttgttattttgctatagaatttttctaaagattattacaaatctcaatagcacatatactgtttatacctcttagttctagtttctcagtttgtaatactccttcaaggaatgttttgcatggtgtattcttttttttttttttttttgagacgaagtctcactctgttgcctaagctggagtacattggtgtgatcttggctcactgcaacctccacctcccgggttcaaacgattctcctgcctcagcctcccgagtagctgggactacaggcagatgccaccacacccagctaatttttgtatttttagtagagatggggtttcactatgttggccaagctagtcttaaactcctgacctcgtgatgcgcccgcctcggcctcccagagtgttcagattacaggcgtgatccatcattcctggctggtgcatcttatatattattttcttgggataaagttaaagaagtgggatgggtaccaaagggtcagaaaagtttgggatggttgaaacgttattgccacattgctttctcagtgctacgtactagcttactagtttgtttaatttttattttttatttttgcgggtacatagttggtgtatatatttctggggtacatgaaatactttgatacaggcatgcaatgcgtaataatcacatcatggagaatggggaatccatcccctcaagcatttatcctttgtgttacagacaatccagttaacctctcttagttattataaaatgtacaattaaattattggctacagtctgttgtgctatcaaatactaggtcttactctatttttttgtaccaatttgccatccccactcccctgccacgcctcactaccctttgcagcctctggtaagcatccttttactgtctgtcctcattagttcagttgtttcgatttttagcacctgcaaataagtgagaacatgtaatgtttgtttgtctgtgcctggcttatttcatttaacataatgacctccagttcttccatgttgctgtaaatggcaggattgcattcttttttgtggccgaatagtactccattgtatatatgtgccacgttttctttataggatactagtttaatcatgtctttcccaacattgcttattatttatgttcttttctttattgtgagaaaatagacataacatttaccattttaaccagtttttagtatacagttcagtggcattaagtacattcacactgttgtgcaaccatcaccaccatccacctccagaacttttagaaattccccccactttctttcactttctttttacttttcttttccttttttttttttttttttttttttttttagctaggatttcattctgtcacccaggttggagtgcagtgcatcagtcatggctcactgcatccttgaccttctgggctcaagcgatcctcacaacccagcctcccaagcagctgggactacaggtgtgagcaccacacctggttattttattttttaaaaaaattttttggtagagatgaggtctcactgtatttctcaggctggtctgaaactcttggcctcaaggaatcctcctgccttgactgacctcccaaagtgctgggattacaagtgtaagccaccacacctggcctaaaatccactctttgaatggagtttttcaacactatgaggattacatgaagaaaagagcctggggctgggttggagtttctgggctgggggctttctggagggtatttagtggtcaagggtcatatgtcaggtgttctgaatcctgagcagcaaggacatggtgtgttggcagctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggtggggcctgcagggactccccccacctagtcactgtcatcttgcctggagctcaccacactgcagtgcgtgttctcctgggaagggagctgtgacactggcctgctggtcatgacttagagctacatgtcagtgggagagtgtggcttgagcctgaactgagccctggccccacagacggagtcccagccccagccccagatggagcctcaaacctaggcagccctggttcacaatggagccccgaccctgggccagtctgaccccagtcacagactgaatcccagtcccacattgagccctgatcccatccaagtccatagacttggcctctgaccaaacctgaccctgcacttgtcacttaaggtggtcccatattcagctcagaccctgaaccgagctctgaccctggcttctgactgaatctgtgacagactaaggcctgaccctggccctataccacgtctccacccgtgtcctcaactgagtgctgaccccaaacctagacagccctacctgatccttcccccaggcctgtccccgccgcttcatctcaaaagttgaaggtgaggagccggtaaacaggtctggagcctggtctcagactcagcctgagcaagctcagtctggggtcattgggcctgtaaccccgggcaggcccttgttagggatgcagggtctcaccctaggggtataagggatttctgtgcccatcagaacttaaataagctgggtgtggcagcacatgtcagtggtcccagctactcaggaggctgaggtatattttgctgttagcatatgtgatgaccttgacttcacctccctggcgccaatatcctcttctgtaaaatggcttatgcattacaaagtgaggtcctgccagtgactacacctagaggcattaagtgcctttgtggactcctgccctgcacctcacctctcccagcttcttaaccccctgaggaaccttcttaccttgagtccctcacccgctacaggccatccatgagcagatgaactgcaaggagtatcaggaggacctggccctgcgggctcagaacgatgtggctgcccggcagacgacagagatgctgaaggtgaggctgggacagggccgaggcctagggattttaagttctgggatccaggtgggggctgggggcttcccagtaagggctgtgctcacacatccctggaggctctgacctcccttctggctgtcactcccatccggaggtgggacttaggccgaatggtcatgtcaggaagagcgtctgggtggagggtggagaccacaggaatgaagagggggttgctggatggagcctggcctggcagagccacacaggagagactccacagctctagagggtcaccaccttctccctgccatggggaggggccaggctgggtgactgccccagccccgccccagggccagcacctgccccactccaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctggggtgagtctttgctcgtggtggtgtggagagggtgcccttgtgggctttgccttagaggagggctgggaaaactacagcccatgggccatatccaacccagcacctgaatttgtacagctcccgaggtaagaatttttttttttttttttgaaacggagtttcactcttgttgcccaggctggagtgcaatagcacaatctcagctcactgcaacctctgccttccgggttcaagcaattctcctgcctcagcctcccaagtagctgggattacaggcatgcgccaccacgcccggctagttttgtatttttaggagagacggggtttctccatgttggtcagactggtctcaaattcccgaccgcaggtgatccacctgcctcggcctcccaaagtgctaggattacaggcgtgagccaccgggccgcaagaatgttctttacatctttaaatggttgaaaaaataccagaagatgactattttgtgacgtgaaaattacatgaaatccacgtttcagtgtccgtaggtaaagtgctttggagcacagccgtgttcattcattcacatgttggctgtggttgcttttacactacagaggcagaggccgtatggctgcccggcccaaaatgactggccctttgcagaaaaggtttgcccactcctgccctagaggacagcaagtaaaggttcgatctggagtcagaggtggattggcccctggctctggcacatactgactgtgtgattaggctgcctgccactcacctctgtcagccccatttcctctgtgaaatggagatgatagctgggcttatctcaggcttgttgtcagaatcaagtggaaaaattgcaagagaagtgcttagagagcctgtcacttggtgagcacccttgcagatggtagctgtcgttattaggggtgtgctctggaattgggggcctgttgctacgttcaggtagactttcagacaggtggaggcagaggaaactgccctctcgcatgctgacatgtctagaatatgcagagtggtcagatcctctccctggcctgttcccggatctaggcgtgggtagactgagtgctgtgggagcccagaaaaggcctcagtgactctccatcaggtagctgaggctgaccaggccattcttgcaggaggacctgcagaggcaaaggcccggggtgggagagcgctcggctgtgggggcagtctctgcactgcgctgacattctcttctcttcctcccatcctctagggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 38716 - DNA, 15286 bp, Homo sapiens
gggaggggcgggatttcctgcgggaggcgccgagccggccttggaaaaggagaaggagaaaggggggcaggggggagtgggagccaccgtcctgagtgccagggaccgagcagggccagccggaccccggcgggcggccgggagaggtgaggctgcggggcccgcgctgggggtcagcgcccctgggggcgggcgcaaactaacttttcttgcggggtcggcgggcacctccatctccccgctccttccgtcctcctcgcgcccctttttccatcctccgcgtttatacctcgggcgcttggcccgcccggcttctcccgccgctttgttccccggtgggcctgggctgggctgggctgggctggggggttgcgaggcgctggagggacattccggggggcgggggagccagcccgaccccaggcactgccaagggcgccctccgcccgtgtcggccgcgggctccgcgtgggagtgcccctgggttgggcttgggacgtttggggagtgaggggttcccggccagggccccaggcctgcgcggatctcatgccacaagactctggcagtaaattcgctgccaccgagaaactgacgtaagcttctctgcggtggagtccagggtctgggcttcaggttcaggcttggggggcttgggagccccgtttgtcagcagtgccccagctctctctgttctctgcccagctgctcctccacccgacacaaggggcgagggcgggtcagcaacaggtgctgtgcagcttccctctctagcaggcagagcccccagaaatggggggccagaagcacttcatgctctccgttcacaaagagtcctaggactagggcatccagccattaaagcgaagccttgaagcctccgtagggaggaatctgggggctggtgcctttgacagggagtgacccctgcccgcctgcctgtgcctgaccctcccggccccacctcctggcccgccagttgtctgtgggtgtcggagcctcgggctgtggagaacaggctgctggcccggcctgccccagtatgtcatgctgccagggcccctcctgcccaaggttgaggtactgccaggtgccctggggccccagtgactcagcctccccctcccagaatgccacctcccccccaccaatactcctctcatgcatagcagcttcctccccactttcagtggctcagcatcaccatcgactccgaggggagccagggtggcttgggggctccctggaggtcttgtcctgctcatcctctgcactccacttctgggacccttgcaggctgtggcccagcattcgacagaggccccgtgctttttccagagccctgagaccagtgcaccgctgctgcctgaggcccaagggaatgctggctgctctctgggtgggcactggtgttccacagccaagccgggaagattggtgtgcccagtcccagcccatcctggagctgtcggaagccacaagctgatatccatccagatttccatgtagccttcaccccctcaaagattagctttccttcgtgtggtggcagttcacggagcacctttgggagtatccctcagtacctgacgaggagcccactgcctgggacacctgacttgctcccccggaaccgggagccctccaaggggctgtggcatggcgccctgacgccccagcttggacccgttgcctgcctttgccctggactcctgagtgtagagctcagcccaggagccagtatgggtcgtgaacaggacctgatcctcgccgtcaagaatggagatgtgaccggtgtgcagaaactggtggcgaaggtcaaggccacaaagacaagtgagtaccgggtgggacgagcatcccgctgaggccgagcgctcagttcacagaggcttggtgggtgggggtgggtcactgtgatctgcatatttgaggagggtggactgtcttgttctcagtaagaagtgcctctgtgtgagagagccagagagaaagttgggtcccccttgctgtgtgtccttaggcaagtcacttaacctctctgggctgcagtttcctggcctgcaaaattagagggttgaagtacgttcattcacattgttattgagtgcctatagcttgtcacccaggctggagtacagtggcaggatctcggctcacgggaacctccgccttctgggttcaagccattctcctgcctcagcctccctagtagctgggattacaggtgtgtgccaccatgcccggctaatttttttttatatttttggtagagatgggggtttcaccatgttgaccagactggtctcgaactccagacctcaagtgatccacccacctaggtaggcctcctagtactaggattacaggcgtgagtcactgtgcctggctcaggctctgttctaagcactggatcatagtagtgaacaaaacagacccaaattcctgtcttcgtggagttgccttctagcagatggtctttctgatgtgttctttggagccatgagatttctgacagtgggttagagaagactgaatagatagaacttcatccctacccccaacctcaaacgcacacatttcaaccagagcacctctatgttcgtgtcttaagaggatatctataagatagctgttttttttttttgagacggagtcttgctttctcacccggcctggagtgcagtggcatgatctcagcgcactgcagcctctgcctcccgggttcaagctattcttctgcctcagcctcccgagtagctgggattacaggtgcctgacacaacgcctggctaatttttactagagacggggtttcaccatctaggtcaggctggtctcgaactcctgacctcaggtgatccacccgcttcagcctcccaaagtgctaggattgcaggcatgagccaccgcaccaggccacgagatagcttttaaaaagggaattctactgcttaaaaaaagttcaacactctctaacaagttgctaaagtttctcttcccctgacatgtgtgtcctggtggggtgtggccagagctcatttactggagattttcacctagcctcgagacctgaccgggctgtgggggatccatgcacaagcggccacacctgagccccatgtcttgggtacctctgtggtgcgaccccccacagggagaatagacctctgggcttcagggagggctctctgggctgtcccaggaggccgctggacttgtcaccttgagatcccagatcagcataggcaggaggtggttcctgccaccagactgaggcaggaggagttccctggatgggaaggtctcctctggagttcaggggctctagccccaagatacacctcggtcctgtgcacaggaaggagtcccccaggctacctgaacacctggggtatgggtgccagaggaagggccttaacctcatgcatccactagcacactggggcaggagacgcagggcctggagaggtggagctgtggggtggtctctgtgcctagggaagtggacacagggtgggtgccactggggaggtgctaaggaggtcccaggggagggccctaaggtccagcagtgcagccactcccctcttctgtcacctctgtgttgtttttggcaacctgcccagtggggccttggtcaagctgctgctggcctcaccgctctgggtcctcaaagtgaggccctcaggagggcaggcgggaggggtttggaggccagtggcgggaactgcagagctgggctcttaggctccgagaagttcccttgtgcccagtgggaagcgtctgtggggaaggaggtcccttccctcagtcccaaagtggagaattcaccctgcgcaggctgtaggctcaggcacagcatgactggggcctgggattccttatgaggccctggcactgtgcctcccctcccagtcctctgagaagctggagaggctggtgacaaaagtgagatcacaaggtgacatttgcaaaccttatagtgtatgaaatattataatttcctcacttgcctgtgagataggtatttcaatatccgttctgtagataaggaaagtgatgctcagagagggttagtgacttgcctaaagtcacacagccatagcatggcagagcagaggcaaagctgcaccctgtcccctgtgctctgcactcagctgcccatcagtattacctagggattgttctgttcttttctttttaaagagatagggtctcactttgggaggccgaggtgggcagatcacttgacgtcaggagttcgagaccagcctgggcaacgtggtgaagccccgtctctactaaaaatacaaaaattagctcagtgtggtggcaagtgcctgtagtcccagctactcaggaggatgaggcaggaggatcgcttgaacctgggaggcagaggttgcagtgagctgagattgtaccactgcactccagcctgggcaacagagcaagagtctgtctcaaaaaaaaaaaaaaaaaaaggacagggaaagagatggggtctcgctatgttgcccagccttgaactcctgggctctagtgatcctcctgcctcatcttcccacctcagcctcctgagtggctggtactacaggcaatgccaccatgctggcctagggattgtttcaaaagtgcagactgggccagccatgatggcacacacctatagtcctgttggccctgtgcacaggaaggagtcccccaggactcctagttagcctaggagtttgagactggcctgggcaacatagtaagatgccatctctacaaaaaaattaagaaatgatctgggcatggtggcacatgcctgtagtcccgcctattcaggaggctgaggtgggaggatcgcttgagtcggggaggtcaaggctgcagtgagccgagatcgtgccactacactccaacctgggcagcagagcaagaccctgtctcaaaaagtaataaataagtaaaaataaaagtgtagactccttggactcccctcaaaatcagactcatcacagagggcctgggactctgtgtatcagaaagttctccccatgattttactgcagttctcagaagtgaggctggggactcttgctccatatcgtaagaaggcaagggaaactgctaaaagggaggcgtcaggactccccttttttcttctggggtttagctggcgctttatagctatccagagagagaacagggaggtgggagatgctccctcagcctcctgcatttgatatcaggccaattccctgcccccacccgggtcctcttcagggagcaggtggctgagagaagaggggtacagttgccctggccctgctccccgcccctcgccgcaccactcccttttctgaacaatctccttctttggccagaggaaatggggtgtgctggggcggccggctgagctcacatcctctgcccgggagcctaaatcaggagccacccttccacccccagcgccaggcccgggaagaaggttgtaccgcaggggaagtgcctggagtcactgccaggaacctggaccctctgccctcctgccagggtccccagcccggtcactctgagcctcttccccaccgcctttccggctattgttctgaaaagaacggagccacccagcctggcccttgccctgttcctgtcctgcctgtcacattgtcctgctcctctcgggagggactgcatcccgccacccagctgcctcatcccaaactgtccaggctgttggaagaggagggctaatggaagagtgggcagcttgaagggtgctctgtgtctcttccctgctgaccgcattgtctccactggggctcagagaggtaccgtggcaggccagggtcacacagccagagtgagcatttgaactgtgcacttccgcttctagagcccctcttctttctactgcctcaaatggttctgtatgacaaggactttccaaggggactggaggaaaatggaggtctgtgtttcttcccagtggccacaacccctttagcgctttgtccctccctggctctgtctttacctttgtggcacagtgtccttcagtttggccctcaatgtagctgtcccctccctccctgtgccatgttccctactgccaggttggtccctcccctccctgttggaatgaagccctgtcttccccaggctactggggtattcaggggtccaccagagcctggggggcaggcctgggccagcacacttggcactctgcccagcctggccaagccaggcccactccttccctgcagggtgggttctagcaggaggcaggggccacccatgacaggccttccttccctccccagcacttcaagagccactcccaccagttccctggctctcgcagggagcacacctgcctgaaccctgccccgagagggggtggccccagctcctcttgccaccaacctgcagagtccttgtccagggcatggacatctcagccaagaccctggaggtgtggagtcagcagtagcagtgactccccgggcagtctgagcacccatggagatcccagtggggacagtatgggccctgtgccagctcttgttggaggaccatcgccctaacatcgggatggtatttgcccacatgtcaggagggctagatgttgagagctcctgtctttgcatatgacaaggtcaggcactgtactcacagcccccgtgagcaggttctgatcagctcattttacagttgaggacactgagcatgggaggttaaatgacttgtcacagtcacacagctggtgcctggcagagccagtgttgggtagaggtctgtctaatgtcaccttcctctgggatgccccaggactgggcatcgtggcctgcccttgaatacctagtgcctctttccttctctctccccacccctcggcccagtaggacaacatgactcgctgcctggcccattcaggcaggaatgctaaccatgcacaccgtgggcctgtccactgagggcacatcgtgccagtcccaccccccgccctctttggctctataaacaagcgggactggggcgaggggaagccagcccactgccgcagcagcatcctgccctcactgccctcatgctgctgggccggtgggccagggtggggagccacagggacgggacaggcggaaggccatggggcaggtgctttcctgcacgccaagaggtcagccgggctgtgacaggtggggggagggatgctgagtgagggcagtcatctgatggccctgacacctcctatcctgacccctagagctcctgggctccacaaagaggctcaacgtgaactaccaggatgctgatgggtgagtgggagcccctgtccctctgcagagctgctgggtgggggcagtagagccccaggggtggggctggagggaaagatcctgaggcccagggtccctttccctctcagacttggccctggaagtgtatttgctgcgagctgtgggccctgtccctgggctggagggagggggcacccgcccgcccgtggagttagccctgagtgaggggaggggccctggtgcctctccgcagggcctcctggggtcagattcctttggggcccccttttctccctggagggtaggagccctcaggctcctgctcccacggccccctcccctgggccagctgggaggcgggggggcgagacaaacgggcctctcagtgcagacactgagccctttcatgctgtggctcagccactgcgctcccacggcagggctgctggggttgggggggccagtaacccatccctgccagcccccaggataggttcgggtatggaagaccaggatttgggggtgggggctgcccaccaacacccctaactttgtgtcctcccacatcagattctctgccctccaccacgctgctttggggggcagcctggagctcatagccttgctgctagaggctcaggccactgttgacatcaaggacagcaatggtgagacccccatgtgcccccgacccccaccctgggcaggtaggggccctacccagaccctgggaccagagcttgctcctatgacaacgtagcaatgctaatagatgctagcacagcgtctctgggcttgcaagtggcttttccccgtttactcttcacagccttcttgcataggcgagtggtactaacatcccattattcagatgagtaggttgaggctcagcgaggtgttgttgctgtcctggggtcatcatgatccacagtgggcacagcaggactctggcttcagccctgtcgagccgaacctcttcctaagcacacctggatagagccagcattgcatccccgtgggctctctgccctcccagctgggctggctccgtactctgctcagttcctctccacccccaacgccgtcccaggacctccctcagaaaccctttcctcctgccaggcatgcgcccgctgcactacgcagcctggcagggccggctggagcctgtgaggctgctgctgcgcgcctctgcggctgtcaatgccgcctcgctggacggacagatccccctgcacctggctgcacagtatggacattatgaggtggtacgtgaggctgcccacaggggcgtggcgcagggcagggtggggtgccggacaggccaggccccctcactcggctcccccaaccccagtcagaaatgctcctccagcatcagtccaacccatgcctggtcaacaaggccaagaagacgcccctggacctggcctgtgaatttggccgactcaaggtgaggcctgcagccttggggtgctgggtcctggacatctacagggtctcaggaggaggctctaactgggcactgggtgctgcaggtggcccagctgcttctgaacagccacttatgtgtggcactgctggagggtgaggccaaagacccgtgtgaccccaactacaccacgcccctgcacttggctgccaagaatggccacagagaagtcatcaggtacccttggggtcccctcgcttcctcatcacctgcctgcgggaccatcggtgcccctcagtgctctcccccactgcccttttcacccgggctctccatctcccaggcccccagcagtcagcaccccctcctacgccacctcccccgtgactccccccgtccactgcaggcagctcctgagagctgggatcgagatcaaccgccagaccaagacgggtacggcgctccacgaggccgcactgtatggcaagaccgaggtggtgcggctgcttctggaggtgggtatgggcccctgctccctcgcaggtgtccatggagcctctgccctgtgcccctgactggctggggaggtacgggacggaggactccagcgtggtttttgcatgggcgtcaggaaagaggcctgacttccttctgaatggtgccgaggcggtgcagatggatcgggggcagaccaacctgattggcaccccagatctgcctcttactagctgagtgaacttgagcttgtccttgactgagtccctgagcctctatgtcctcatctgtaaaatcggaaaatggtaatagtacctatgtcccgggtagctgagagaatcgggtgaggggtgtcaaagtgcttagcgtgtgctcatgtgacactgtgcacccagggaggtgtggacgtgaacatccggaatacgtataaccagacggcgctggacatagtgaatcagttcaccacctcccaggccagccgggaaatcaagcagctactgcggggtgagtgcgggggaggataccctgcccagggggcctggggccgctcaagtggtaccaggatgtggagggggagtggacgtccctgggggagggttgtcaagggcatgaggggtgggaagatgccctaaggacccttagatgacacctgtcccccaccccgttttcttagaggcctcagggatcctgaaggtccgagcgctcaaggatttctggaacctccacgatcccactgctctcaatgtccgggcaggggatgtcatcacggtgagggaccccaagcaggcattcctttgcaaatacaaatgattgctgttacttatttgggcacctgctatgttaccacgttctgctctgaggtctctatatgcaccctcatttaattcttcttaaagccagggaaggcagtgctgttagcatttcttctttacagatgacaaaattgagaattaaacaaaataaaatcaagagaaattcaagtgacttgcccaaggtcacacagctagcaagtagtggagctgtgatttgaccacgggctgccactggggctcgccctggaggcacaggggagattgagctggctgctggcagcaggggcggaacttgggccagtgtgggcatcagaggccagctccttaggggtagggaaagagctggaccagggttgccggaccgcagctgcagggacaaccgtttgccacttgcctggtgctgggagtgaccgtccccgccccccacccctggccgcaggtgctagaacagcatcccgacggccgctggaagggccacatccacgagagccagaggggcacagaccgcataggctacttccccccgggcattgtcgaggtggtcagcaagcgggtgggcatccctgcagcccgcctcccctccgcacccacccccctgcgcccaggcttctcccggacaccgcagcctcctgccgaagaacccccgcaccctcttacctacagccagcttcctcgggtgggcctcagcccagacagcccaggtacatcctcccagggggcagtgctgggcactgtgtgggcgtgtggcctgggcaagctgccagacagctgtcagagcgacacttgggactctgaccccttggcttctgccccccacagcaggtgacaggaatagtgtgggcagtgagggcagcgtgggcagcatccgcagtgccggcagcgggcagagctctgagggcactaatggccatggccctggcctcctgattgagaacgcccaggtaggatgatggggtcacggaccaggtcagggctcactccccactgccagttccccaaatgctgagttggctcctgccctgtctcctccagccactgccctctgctggagaggaccaggtgctgccaggactccacccgccgtccctggcaggtaggaagggtcaggggacctgggttggctaggagaggtgcaagtaaggaggccgagggtgggcaccccttcctcctgccacctttccattccatttttctctctccttgaagacaacctgagccaccgccctctggccaactgccgctctggggagcagatcttcacccaggacgtgcggccagaacagctgctggaggggaaggtgtgacctccacggggtgcaccgtgggcctcgggggggaaggtgtgacctccacggggtgcaccgtgggcctcgggggggaaggtgtgacctccacggggtgcactgtgggcctcggggtgggtagggcagggtagaggcaagagcctctgtatggactgaagccccgctcaggcaggtcctgagcccctggtgggggctagggccttggtccagctcctgctaattctgcccccttcccccaccccgcaggacgcgcaggccattcataactggctaagcgagttccagctggagggctacactgcccactttctgcaggccggctatgatgtgcctaccatcagccgcatgacacctgaggtgggtgctgcagccgggaagcagcacccagcgggcgggggagggcccagcaggcgggggaggggcctgatggccagactttgtgtggcaggacctgacggccatcggggtgaccaagcctgggcacaggaagaagatcgcctcagagatcgctcagctcagcatcgccgagtggctgcccagctacatcccagtgagccatcaagggtggctggggagtggggcacgtgctgtcaccctcagctgtggctttgcggtgccttttctcctctggctgggggcggaggctggctgggagttgttctgaggacggtgctcttccagacggacctgctggagtggctgtgtgcactggggctgccacagtaccacaagcagctggtgagcagcggctacgactccatggggctggtggccgacctcacctgggaggagctgcaggagattggggtcaacaagctcggtaaggactgtcctgaggcctggctgggcccccacctgcctccggggtctccaagagaagacagtatggggcccagcggtgaccaggacaaccccagccccagctaaccttgccacttccgtcccccatctcagggcatcagaagaagctcatgctgggggtgaagcggctggcggagcttcggcggggcctgctgcagggggaggccctcagcgaaggcgggcgccggctggccaagggtccggagctgatggccatcgagggactggagaacggagaaggcccagctacagctggcccacggctcctcaccttccagggcagcgaactaagcccagagctacaggcggccatggcagggggtggccctgaaccactccccctcccacctgcccgctctcccagccaggagagcatcggggcacgctcacgggggtctggccactcacaggaacagcctgccccacagcccagcggtggagatcccagccccccccaggagaggaacctcccagagggcacagagcggccccctaagctttgttcttcacttcctggccaaggacccccaccctatgtttttatgtacccccagggctcaccctctagcccggccccagggccacctcctggcgcaccctgggccttctcctacttggccgggccccctgccactcccccagacccgcctcgacctaagcgccggtcccacagcctaagccgccctggccccacagagggggatgctgagggggaggccgaagggccagtgggcagcaccctaggcagttatgctacccttacccggcggccaggacgcagtgcccttgtccggaccagtcctagtgtgaccccaaccccagctcgggggactcctcgcagccagtcctttgccctgcgggcccggcgcaaaggccccccgcccccgccccccaagcgcctcagctccgtctctggccccagcccggagccacctccactagatgagagcccagggcccaaggaaggggccacagggccccgaaggcgaacactgagtgaacctgctggcccctcagagccccctggcccacctgccccggctgggcccgcgtcagacacggaggaggaggagccaggccctgaggggacgcccccatctcggggcagctctggggaagggctgccgtttgcagaggaagggaacctgaccatcaaacagcgcccgaagcccgctggccccccgccccgagagacacccgtgccccccggcctcgatttcaacctcacggaatcagacactgttaagcggaggcccaagtgccgggagagagagccactgcagaccgcactgctggccttcggagtggccagtgccacgcctggccccgctgccccactgccttccccaactcctggcgagtctcctccagcttctagccttccccagcccgagcccagcagccttccagcccaaggagttccaaccccccttgctcccagccccgccatgcagcctccagtgccgccctgcccagggccaggtctggaaagctcagcagctagtcggtggaatggggagacagaacccccggccgcccctgctgccctcctcaaggtgcccggagcaggtaagaggggaggcctgtgggagagtcactgctggcagggttgtgtctgacccagccaagtcccaagccaacctttttgtctctgcaggaacagcccccaagcctgtgtcggtggcctgcacccagctggcattttctggccctaagctagcgccccggctcggcccccgcccagtgcctcctccacggcctgagagcactgggactgtgggcccaggccaggcccagcagagactggagcagaccagctcgtccctggcagctgcactgagagccgcagagaagagcattggcaccaaggagcaagaggggtgaggggggccggatggggagggagagaaggctgcagagaaacagtgctccctgcatcctctgcccagggatcatggggatgttggagggggacattgcaggcactaacgggataagaggccaggtgttgaaatcacctagatcagggaatcctggtggctaccatttaagaggcacaggagcctggccggtcccttgcctccctgagcctctgggagctatgacagctccctgccccagggccagtggggtgcaggccactggctgatctgaccgcatccttccccttgctgcagcacccccagcgcctccaccaagcacattctggatgacatcagcaccatgttcgacgccctggctgaccagctggacgccatgctggactgagccctccagcagtgcccactgtgacctgccgaagtccactgcctttgccccagcacagaagaggcccctgccaccctagggacgggccaagggctggtcaggctgaagtgcccctcctagcagggccccttcccactcagcccgcggctgtgggcaccacagctcttgtggggcagcccaccttagaacctgactagcgagggacctccgctgcatctcagcaaagcccctcccagggtttgatcgattgagcaggacagccctgctcctggacagggaccctggtaagagctctctcctcagggaggaagtaggggtggggctttgggggtgctttctctgtaccccccagcccatgtcccaagttgtgccaagggaatgcctcttgccacccaccatcctgcccaggccctgagaggctggaggaggcgtgtgtctggccgggccccctctccgtaggtgtacagaggacatgtaaatacacagcggtggtgcccaggcagctcctgcccccgccttccctcactgaggcagggctagcaggggtgggaggcagtggggttaacagatcccacaagtcctaacttttcaattgtaaatgttattttctaagcagagagaaatgcatatattttaaatggaatttattctatcaactgcctgagaggacacaatgggggaggggcttcggaccacagcaggagccccgactgcccacctgagggcagggagagcctgaccccattggcccaggccctggctctgtaaccattaacctcttcccccaactaacaccaatgaaaacaccattccacgtga

SEQ ID NO: 38717 - DNA, 146389 bp, Homo sapiens
atgaatgcgggccccggctgtgaaccctgcaccaagcgaccccgctggggcgccgctacaacttcgccggctgcttcggacgcccggagctttccgagcaggcagaggcgcgtcctcgaccccaaggacgctcacgtgcagttcagggtcccaccgtcctcgccagcctgcgtcccagggcaggcgggacagcacagaggcagcgccacctcgcttggtacgtgggaaaataaaaatctttgtccttcgcctcggcccgaaccttctggtctcagggactccagtcactcctttctggtcttgtgtgcatcatcactctgaggtccacttgctgagctaccaaagccactagtgggtgaatggggccgcatttttcccagtgcgattgatgtgagaaactctgatgagcagtcactcacagggcggaaaatggcaggagactccaccacctgtttgcttcttcaggtttgattgagaaattgccttagtcgtcaaggagatctaattgtgtatgtaaaacagtagggcgcttcagcctctagataggaagaaaacaacttcacttgtgcagattctgggtcccagggtgcagagctattagtctaagctggcattgtacccgtccctggtatacagtgttgaatgagagaaacttggcctctgccttcataccttaaaatctatctggagagatagacgatagcaaaagttaatataataaaaggtaatggatgttctgatagatgaaagacagattgttttacctaactgaatttatggaatcgaaaatagtcctccagaagatgagatgcttattctgaggactgtagaatgagtaggagttagatgaagaggaagtaagaagtgtttcaggagtgcaatggaggccgggcgcggtggttttgcctgtaatccctgcgctttggaaggccggggcgggtggatcacctgaggtcaggagctcaagaccagccttaccaatatggtgaaaccccgtctctgctaaaaacacaaaaaattagcctagcgtggtggcgggcaactgtaatcccagctactccggaggctgaggcaggtgaggcaggagaatcactggcatccgggaggcggaggttgcagtgagccgagagggcaccattgcactccagcctgggcaacaagagcgaaactccgcctcaaacaaaacaaaacaaaacaaaacaaaaacaggagtgcaattgatatatagagtgaacgcaagagagtgtgagagatgaggctgcagggtggtacagaaaagtcagatcaaattggatatgtagacattgctaaggattttgaactctaagggcattgataagctactcaagggtttttagtaggggagtgacttgattagacttatttatttgttgaaaagtctgtgtggctggtgtgtggaaaataaagaatggattgaaaaggaactcaagtggagcatcaagactcagttaaggagttaatctaggttggaaataattgtagcttaggcctggatgctggcaatagggaaggggatggattcatgaaagaatgggatacttgagaagaaatatttctgtgctggagaagtagattggggagttcatggcataaacattataatggatgctatgggcatagataacataaacatgtagagaaagtaaaggtgacctagggcagaagccttaggaacaccaaagtttaagagtagactgaagagaagcggctgtagaggtgggaggaaagcctggctcgtgttgtgtcagacaaaggagagcatttcaaaaaggatgcattcattaacagtgtaagaggctgggcagagctcgggcagttctctggtgaagagtgtacacttagatgtcttcgaacttagggacagtaccaagtagacttgcactaggccttgaaggatgaggaagatttgctgtataaatcaagaggagaaagaattatacacgcagagggaataagacatgcaaaagttggtaagactggagcataagatgacagaggagtgtctgatgaggctgggtggcagacaggagcttatgaagaaactcaaattccattttaaggaatttcaaccttattctgtggttaatggagaaaccactaaaaagcttttaagcgtgggaataccatttggttaatattttagaaaagtggcttttggactttcctaactgcaacccacagcataaattttatccagtacacagagtaagaaatatatgtaacctggcaaataagccatatttataactgaaataaatgtttcatgaaataatacttaatctttctatgtgtgatgcattcttatattgtctgtgttatttcattgaaaaatgactggtcatttgtagtttgtagaacactggatagtcaaggctgtagacagggagactagttgcaagaaacaaatggcagttgtctagtaagcgatgtgtttaaagagtatgaggaagggatggatttaaaatttaggatgtagatttcagagaacttggtataggggagagggaactgaaggtgaacttcaggtatatgttcaggtgtacttcagcttctgtgactggatagtttgtggtttcattaaccttatttgcatgtaaaggaggaggagttagttgcaaataggggtgagggcagtcagtcctcactggttggatcttaattaagatttctgcagaagaggtaccaaatgaatacttggggctgtatttcgcatgtttaaatgttttctgtatacctggcacaggacaccaattaacagaatgttcaaagactatatttgtatcaaaagcccattgtttgaatttttgggattcctttaggaacttggtatttaaatttttatatataattatcttaggacaagtaggcggggtagcgaaatggatatttattcagtatctttaaattttatattctttatcttcctggacatatttcttgtattgactgaaatcgctaattttgctgggcatgcacctgtagtcccagctacttgggaggctaaggcaagaggatcacttgagcccgggagttcccgtccagcctgagcaacatagcgagaccccacttctgaaaaaagaaaaaaaaaatctgcaaacctgcatattggcagaactcagcatgttattcacattgtgatgacgcaggtttatccagatgtgttgctatagactttttgtgaaagtggaatgttcctttgacatgcaggtgaattttattgcattttgtgccttttggctgtatctatagctattaattgaatgacttgctgattaaaatatactgggtactgaataatgttgctgatgagagtaaatgtaaatggtgtgaagtcaaagttggagaattattgatctcagtggaaaaaaaaaagactgggtggaaatgtcgagagataacatattgagtgctttgtgaggctgaacacaatattttctctaatttttgctttgtaattgatccacataacccttagaagtaggtgttgttagcttcattttctgggtgaggaaataaaggcttaacgaagtgatattgcaaagagcagtaagcagtcctttctctgaggccctaagaaggactgatcaatgttttattagcagaagatactggttccttacctcttgcttttcctccttcatcccttccccaggcttcaggaagcctgaaactggagagagaacacattctcagggtcagggctacgggagagagctctcttcttctttgccatcactggaacactcctggtttttcatgaaatgatgtgtgcggtctttaggttctttagacttatcacgggagtacatgcttcgtgtgtgttataggaacctagtcattgcatcttaacattaatccttacatttatggaaaaaagatgttttaacttctaaaccaactcaaaaaatgaatgttttggcatattactggtttgtaatttgaggattttttttttagtttttgagacggagtctcacactgtcgcccaggctggagtgcagtggcgcgatctccgctcactgcaagctccacctcccgggttcacgccattctcctgcctcagcctcccgagtagctgggactacaggcgcccgccaccacgtctggctaattttttgtatctttagtagagacggggtttcaccgtgttagccaatctcctgaccttgtgatctgcctgcctcggcctcccaaagtgttgggattacaggcgtaagccactgtgcccggcccaatttgaggattttctaaactatacttgctgtatttgatataaagaaaataaatagagaatacagaactgtagaaaaaatttcagaatcaaatggtttatcctcttactccctctgactgaagctcattttttctctgaagcctgatctgctgcagaaatgctaaataaaatcgtggaagtaatggtgtttaacaataagaaatcactatgcgtgattacttttttgtgatagaaactatttttgaaacattaatcaaagatttttactagctggattataagtattttgtggaaggtaaagattatatagcaattgaatatttttctggtataaaattctccccatctgaaatgtatttcgattatgccattatttcaatgaaaaataaaccattgattttcgtatatttggcctgcatctgttttgctccatatggtgtttgaggagaggtaggtaaataagaaagatcctgtgacttaggatgctaagattcttacattgcaatttagtgagtatctcaaatcttaaacatttgcgaatgtttaagattttatttctgatactaaaatatgatgtacatttaatccctattcagtatgttaaattttgacagcatacttatttctaatgattatataaaatgtggcttgtatttatttatatttaatctccctctcctgagctatcaattctacttttgctactgtctgctggtgtgttgggaaggaaaccttaggaagccagaagtagtgatatggttttctatctagttacttctttggcatctcaaatttagtataggcagaattgacctaatcgtatttcttccctaaacacaattctcttgtattccatatttctacttaaggctgtcatcacttttcaagtctctcaagctcaaagcttaaagtcacttttaacttcccctattattgtgaagtctgtaatgactctcctcacttttactactctcacaaggactagtttatgttcttggcaagtaactgttcaatctagtggatcatcagaatcacttttggaaaaaaaaaaaatagattccagctcccctcatgccttcatcctactcacatatagattctgattcagaaggactggggtgtggctggcttcctgatgatccagatagtttgggaaccactgacctggactagtagcttcctccctagtttctggcaatacgctcttccctcttgcccctcaaatttatcctccaggctgtcatgcatgactgtgagcctcctagatgagaggaatcatgtctttcaacacgttttttgtgcttctctttgtgggtcattcaagatcctattgtatggtatgatcctggctgacttttcaaccctattttcttttgctttctttttaagttctttatatttccctgatattggtgcctttgcttataattttctctttatgtgactgcatgtttacttttcaaggcataagtcaagccttaccttttccgaagaaatcttaccgattatgcccatgttctcctgttcactgaagtagtgtcttcctcagaaataaccttaattcctttatcaggacctcttttaataatcatgataattaagaatcaacatttactaagcgtaaaccagataatgccctaaatgcgttacatgaactatttttacttaattaagccttatctcatgagagatagttattttgcatgtttacaaatgagggatctgagatacagagaaatgacccctcacagagtaacataggaagctaatgggagaatcaggatttgaatgcagatgttctgattccatagcctatgctcttatccattaggccataccaactcttttaggcaccagtcattttctaccctgtgtcatatgtattaacatttatgttcctgtcttacccatatacttgagggcaaatacttgagttattaatcttttgtttaacccgtagaacctagcatagttccttgcatgtacaatatgctgtatatgttttctattggaaggaatgtatgaatatacattttttttatagttttcaaacaaaaaactattaccagttggatggacactgaaggaatcaagacagcggaatcagacaggtatagaaacattcctatgtagagaaatgaataataatacatggatgttttatcttgttgctttaatattttctctctttgttcatgcttttctgttctcctttatctatgttaattcaaaatcaacttataagtaattttttagagagtcctgtgtgccagggactgtcctgtatacttgagataccgagatgagagaggaatagtccgtgtcttttttttttttttttttgagatggagtctcactctgttgcccaggctggagtgtagtggcgtgatcttggctaactgcaagctctgcctcctgggttcacgccattctcctgcctcagcctcccaagtagctgggactacaggcgcccaccaccacgcctggctaattttttgtatttttagtagagatggggtttcaccgggttagccaggatggtctcgatctcctgacctcgtgatctgcctgcctcgacctcccaaagtgctgggattacaggtgtgagccactgcgcccggccagtctgtgtctttaagatacttacagtgtagcagtggccacagacacaaaaacacataattactgcctggtgtgatagatgcaatagtaaaggtatgagcaaggcacagtggtggttagtgtgtagaagaaacaaatgttcaactttacctttggtccctaaaggaagactgcacagagaggtgagtgacatttatgacttgaaggaaaggcgggtgtttgccagacacacagctgcagggagggcattagggatcacatacaaagacatggagtcatggaagacatgctgtgtgctcagctgaccacagggagtttaattactgctgtgacactggaggtatgattggataagtgacttgtttgtattataagttgtttttagttccttctgttctcttgtagtttggatagtaaagaaaacaacaatacaataatagaatccatgatgagttctgtacaagaagataacttttaccaacataatgtagaaaaattagaaaatgtttctcagctaagtcttgataagtcactcactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacggaagatgaacacgccagagaagccaaaagccaccagaagtgcagcaagtcttgccatcctggggaagactgtgcaagttgtcagcaagatgagatagacgtggtgccaaagagtccattgtcagatgttggctctgaggatgttggtactgggtcaaaaaatgacaacaaattgattagacaagaaagttgcctaggaaattctcctccatttgagaaggaaagtgaacccgaatcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaattcaggaaacggtactctactaagggcggtgaagttagattacatttccaatttgaaggaggagagagtcacactggaatgaatgatttaaatgctaaactacctggaaatatttctagcctgaatgtagaatgcagaaattctaagcaacatggaaaaaaggattctaaaatcacagatcatttcatgagactgcccaaagcagaggacagaaggtaattttctgtcaggagtatctctccaatagcataatatgctttatagttttgtaagggagtttaacgaagctatgatttctagtaaagcaaagaaatggttttgtttcttgttaactacttatgctaaatttaaacctaggctccaaagtttaaactctaaaaaggctagaaacagaaaacaagaaataaaataaatattagaaatcagatttttagtttcatgagtttccttttggtatttatgggaattactagaacatgaaaatactaggttgatagtagctactgtttcttcagccagacattcttctagaccattgtatattacacttttttttttttaacactttgtttaatgccgtgacaggcagacagatggtattatactcactaaatgagataactgagatttgggtaagagaattcactggaatcatgtaccttctgagtggtaatgctgggatttaaatccaggtgtgtcctattacaaagcttatattttgccgttaccccatatggaatcttaaatcccatccatgatttctgtgatttgagtttcctgagatagtgcaatcagcatgcaatagtgagttcacttcattgaaaattactgtgtagatgatactgtgaaccatgactcatttctgttttgagaaggtgatttacatgtgtttggaactttcttccacagactgttgaaaataagctcttgagttttataagctttataggtttttcttttgattgtaaatataaaacataacgaagtgagtgaccaagtatggcatactttaaacaataacgtctgggtaagttttgtgcttgtgtatctaagggaattaaaacagtaaataatttgtgactaaatacatttgtcttgaccttagaaaagaacaatgggaaaccaaacatcaaagaacagaaaggaagatccctaaatacgttccgcctcacctttctccagataagaagtggcttggaactcccattgaggagatgagaagaatgcctcagtgtgggatccggctgcctctcttgagaccatctgccaatcacacagtaactgtttgggtaggtagcacctcttatctatgatgagagaagactggaagtccttatttattgtgatatttattaagtgagaaacagaccaaggcttagaaagttcttctgttttctgcatatataaaatactgagaattctacagaatggagcaatataatgataacttacttagtatagaacttaacaaattagcaatcattagcaatcattatcagctgatggtgaagataatttttttttttccagtatttttaagaaacctcattggattctttttttttctttttactcagttgatagtattgtgtactgactgcagaatcctgcattcgtccctaaatttcaaaattacgtatggtttagtgtccttaaatcattatccagttgtgccttttttttgtttttgtttttttttttttttgctggagaccagagttttcttattactcaaatcagtctcctcgagcattcggggatcagagtttttaaggataatttggtgggttggggaaggccagtgagtcgagagtgctgattggttgggtcagaagaagaaataatgggaagctgaagctgtcctcttgtgctgagtcagttcctgggtggggacaagatcagatgagccagtatatccatctgggtgatgccagctgatccatcaagtgcagggtctgcaaaatatcccaagcactgatcttagcagtttagggtgggtcagaatcttgtagcctccagctgcatgactcctaaaccattatttctaatcttgtggctattttgttagtcctacagtggcactctagtccccaggcaagaagggggtttcttttgggaaagggctgttaccatgtttgttttaacattatattataacattataacaacattgtaacaaaacataacaaaagactaacattataacaaaagactataacgagggctatgggagttacaagccaagaacctggacaaaaaccaatgtgaatatcataacactatactaacagaaactgtacatattaaacatattaaataattaaacctccttccctgcttcccctagttcttagtaacctcttttgtactttttgtgtgttcttgcttttaaaaaacaacttcattgaggtatataaaaattcacccattttaagtgctcgatttggtgatattgagtccattttttgagctatgtgaccatcaccataatccagttttagatttccatcacttgctgggtagttttaaacattcatctcatttattagtcaggttttatatagatttcacacgcagtactaaaaaaaattgacatgatcccttttaacatacaatttagtgtagatgtgattaactattttgaaattcagaattctttagcatatttagaggtgagagtaacattgagcagagttatggggtttgagctgagctctaaaagataagcataaatttctgaggtgcagttagtaagataggagacttccagacagatatataaggtttataagaaaaggctgtgtggttgaaaactatctgttttagaaatggaaaacagtgcctttgctggagtgtggaatttgggtggggaatgaggaagagacttgaaaattggattggcttcatatcacagggggcttcaagtgccaggaaccagacttaagtcatgtctgtgcagacagtatctgtgctgtagcaagattaatcagacagctgcatgtaaggaaaacagaagtgaggatacactgggagacaggagaggtaatgtaagagcccagataagagttaagtaaggtaacagtatgtaccgaattgtgccacatagaggtgcttcaggggttcttttgaagtttgatgcaaatttcatttctaaattatatttttaacagtgaaaaacttgttaaaaaagaactgcacaatcaaatttgaagatgcttaattccacatttgaaccagctgtttttgccaagataacccatttttgtgcagacgatagagccaaggttcccttgctaccatttatctgaagagttagcttaatatcaaaataaagtttgtaaaatgttaccatttgcaactgtatagatggatgaatcaggattttcttaataatgtgtaagagagataaatgtaaactaaatggtagattgatgtaagctttaactctcatccctaactcctactttcaaattttgtatttaaaactgtctcatcatcacttattgatattagagtaagtaaaagttactataaaaactgtatttctttttttttttttttttttttgatggagttttttgctcttgctgcccaggctggagtgcaacagcacgatctcggctcatggcaatctccacctcccgggttcaagcaattctcctgcctcagcctcccgagtagctgggattacaggcatgcaccaccacgcctggctaattttgtattttagtagagacggggtttctccatgttggtcaggctgatctcaaactcccgacctcaggtgatctgcccaccttgtccttccaaagtgctgggattacaggcgtgagccaccgcgcccggccaaaaactgtatttctaaaaatagctttggtgtgactttaaattactttatgtcaaatttcttagggaaaaaagggattctgctattttaaaaagcttgaaaatcactgagataataatcatggggataaaaaagaaaatagaaggttgcattattatgaggtaaaattgatagaatatggtgaattcctaaatatgggtgacaaataaaaaggagttgttgataatgcatgtaaaattaaggttcttagtctggattactgagatgatgttaatggtgaggaactggagaaaagatggacagagggtgttaagtgatattttagctttttctcttcctcctctctcccaccctcccacaaagaaaacccaaaccatcctgtaccgtcattatatctctctaatatctaccatctctaccatcaaataatctctatagttaatgtttctttcttagatacccaggacccttgagtttttaaaatcttctgttttattacaagagcaatgcaagactattgtaaaaaatatgcaactattatatgaaagcatgtaactcagaaaacccatctgtcagtcttattcccagagtttaacagtttgttgtattttcttctagattcttattcctgaatatgataataagatataaatgtaattaacagttacttaatagcagtgtttagttacattattaagattccagatattaatagttacagattttgaaatagtaaaatgaaagttgggcatgatagctcacacctgtaatcccagcactttaggacgccaaggcaggaggatcgcttgaggccaggagttcaagactagcctgggcaacataggcagagcccatctgtacaaaaagttaaaaaattagccaggcatggtggcacatgcctgtagtcctagctactcatgaggctaaggcagaaggattacttgagccctgcagtttagcctggatgacagagtaagaccctgtttcttaaaaataaaaccaacatttagctttagaaatgtaaggcaatctgaaattgcacttagtggtcgatttccaacaaacacatgcatacgtgcgtgcatgcaaacacagagccacacacaaagcatattacatgtatgttccccttttgtgaagctcaactggtacctatgctgttttatcagatgatatggaacgtccttataaaatcacctttgggaccttcttatgagggtgaaaatactttcagcataactgctgattctgtcacatctggctttttttttttttttttttttgagatggagtcttgctctgtcacccagactggagtgcagtggtgtgatctcggctcactgcaacctctgcctcccgggttcaagcgatcctcctacctcaccctcccaagtagccgggactacaggtgcataccaccaacctcggctgatgtttgtagttttaatagagacggggtttcgccatgttggctaggctagtcttaaactcctgacctcaggtgatcacccgcctgggcctcccaatgtgctgggattacaggtgggagccactgctcctggccttcttttgttttgtttttgtttttttttttaaagagacaggatctcactccgtcacccaggctggattgcagtagcagtggtgtgtgatcttggctcactgcagcctccaactcttaggttcaagcaatcctcccacctcagcctcctgagtagctggggttacaggcatgtgccaccacacgtggctaattttctaaatttgtagctatgttggcccaggctgattttgaactccaggcctcaagtgatcctccagcctcaacctcccaaagtgttgagattgcaggcgtgagcaactgtgcctggccacatttgactccatagacatttcttttctccttggaatatactcatcctttggctccgtgacacaatataatcctaaatttctttcttcctcctcagccaattcttattttccttttaggctgttcttctgtatgtgacaagtaagtgttgttggagttcctcaagcctttttcataggtccttttttcttctgtctctctctggttggtctcacccacccttgtggttttagtgatcacctatatagatgactcacaggtttatttttctttctttctttctttattttgagacagagtcttgctctgtcaccaggctggagtgcagtggcacaatctcagctcactgcaacctctgcctcacaggttcaagcgattcgcctgcctcagcctcctaagtagctgggactactgacgtgcgccacgatgcctaactaatttttgtattttcagtagagatgaggtttcaccatgttggccaggaaggtctcgatctcttaaccttgtgatccaccctcctcaacctcccaaagtgctgggattacaggcatgagccaccaccccctgcccaggtttatttttcttaagttgcagtgttactaaactgaacctgagtacactcacccagtgcagtaaagccaaacaccgacactgacgtctgtagcaagagaagtaagggtgtttgtttgcagggcaccaagcaagtagaataaggtagctattgcttaaaacctgacctccccaatggcttacaagcaagattttttaaaggcagagatatattctaggaaagcagaagttattggcaaaatcatacatcaatacgtgggggttatatattggtttggtcccaaaaggcaggatatcttgaagtggggttgcaggattcagagattctttgatttgcgattgtttaaggaagcaaggctttgtctagaaacttgggatcagtggaaaggaatgttaaggtttggcatgtgggtgtcactgtctccgggcccctcaggaagaaatttagaatgaagaacgtcagtcagagttcagtcttcagttcccccttatgtgatgatggtggttggcactttccatttggcgggggtctgagtttctgaaaaataactcagggacctatgtcaagatgttatctttattttctatagggagcaacacatcttgtggctctgacttccatgagtggctattggtttaagctgttattacctccttgcttatctggtggctcatttacttctcaaggctagataggtgcctggaatttcccttgaaggtttcagatatgatgaggtttctcttcaaataacctgatcagtcttttattctttaattcatagtgccccccttccttttttcctttttctcctttcttccattttgcctttgttagatgcccaggcacgtcacagtaccaagcgttatcaataccagctcacattcctttccttatttggaaagagaactaactttctagcttattacagacatgccttcccctttcctctccgctttctttcacatgcccaccttatctaaaagaatcaaatgtttagctaactggaattagtttagattgtacgacccaaccccagccaatggggaaagggtacaggggcaggacttgcgtcaggaataaaggctcttgtgcccctttgttcaggtgtgctctcatggcgactggccaaggaggcactcctctgtgcagaagtaaaattgctttgctaagaatcctttgttcgagtgttcaatttccttaggattttgagcgttattcctaacaaagggattcgagattttcttttatttccttgcttgagggccctcctggcaggcccctaagagggctccctgctctgtctcagcagatgtttttatgaagctgcctctttgacagtcttctttccatagttcttccctttttaaggaatgttggtgaatagagtcaaactctgtaaaatatttaaagaaatttattctgaaccaaatatgagtgaccaatggcctgtgacaccgccccaggagatctgagtacatgtgcccaaggtggtcaggctacaggttggttttatatgtgttagagaggtataagacgtcaatcaatacatgtaagatgcatattgatttggtccagcaggcaggacaactcgaaaggggcttccaggtcatagattctctgcttggcaattggttaaaagggttattatctaaagacctggaatcaatagaaaggaatgtctgggttaagaagggtttctaaagaccaaggttttatcatgcagttgatgcttgtaggtaacaggcttcagagctcttaccagatgcttcattacttctctcctggactggatcagggaagacctggaaagggaaggggattctctacagcagcagtccccaactttttggcaccggggaccagttttatggaagaccatttttccatgggttgggggatggtttcagaatgaaactgttccacctcagatcatcaggcatttgttagattctcataaggagtgtgcaacttagatccctcacatgcacagttcataatagggttcttcgtcttatgagaatctgatgttgccactgacctgacagaaggcagagctcagccttgctcacctcctgctatgcggcctggttcctaacaggccatagacccctagtccatgcctgtctggattccggggggttggggacccttgctctacagaatgtagattttacccacaagagacagtttagcagggccatttcaaaatatttcaaataaatacattttggggtaaaatacttccgtttctttcagagcttggtatctgtcatgttggtatcttaattgctataaagagtctgccttgtcagtcttaaagtacctgttttaatgttaatgctggtcagtcacatctaaatttcaaagggaggaaggtataatgaagcatgtccaaccacccgttcccatcatggcctgaactagtgtatggggtttgctttagaatgcccttggctgagggaggggcccattcagttggttggggggcttagaattttatttttgtttcacccttttccttgttaattttttagcctttagagttaagctcagttgccacttcctcaaggaagccttacctaagtttaccagataaactaaatctgagctggtctcataacacagtgttcctcatattcataacatattacaagtgaaattatatatttatgtgattatgctctgcggtgaagtactcatacatactaccacatggattaatcttgaaaacattatgctaagtgaaaaaggccagacacaaaaggccacatattatatgatttcttttatatgaaatatccagaataggcataatgttaaactttaaaccataatctctttctcttaccagtggcaaatctatatgggtctgcagcaatgttaatactcctccttagaagaaaggatttgattgagaggcataaggcagaatgagagaccaaggcaagttttagagcaggagtgaaagttcattaaaaagctttagagcaggaatgaaaggaagtaaagtacacttggaagagggccaagcgggcgacttgagagatcaagtacacagtttgacctttgacttgaggttttatatgttggcatgcttccagggggttgtgtccccttctcccctgattcttcccttgagatgggctgtctgcatgcgcggtgtgattactggagttgtacacatgcttgcttgaggtattcttcccttaccagttgagtgttcttataaggtcatataccagttaaactttgccattttgctccctagtacacatgctggagctgacttgcccaactcctaagatcttaacaggaagctgctgatcaccaatttcagatttttctatctattgggtgactcctttccctggcgccggctgcttccaattattttagagaggcagtttcacaactccctgtgcatcacttgagggttgtctgacattcctggtagtggtaggggccctgtcctgccctgctcatgtctgactggctacctactgtaccacttcctcaaacatttacttaatagttattatagtagcatatgtgtgtatatatatatttgcatgtatacacgtacacatgtacacataccaggttctatcttacatattcagaatacaaagttaatatggttattttcaggaagtttgggatctagtgagggagaggaagacaagtgtgctctagcatgataataatctaacaaaacaagataaatagctgcctactttgaagtttctaaagacttcataaagataatgaaaatctggcagagctatgaaggtgacaatagagatttaaccagatacagtgggggaggtggcaattggtagtagtggtattaaaaagagaggccacagtagtatgtatacaggcatataaatatgaaaatgaatttgctatgtttaaggaattttaagtgttgtttaagacttgtttggaatgaatggtgttctgataagaaagtatatgaaaatcaggatgacatttagaatcagagtataggcgttatagcattagaagcctgggagttctttagaaagggttttatgggggctagatgtgtctagcaacagctggagttagggagaaggataggaaacagtaaaagctgaggcaaggaaggattcctagggaatatggagctagaatatatactatatctggtgacttggaacctggttgaatggaggtgaggaatgggaagaactgaagggttctttggtgatttcttgcctgggagctggtctctattttatagcatttgctttggttacttaggattattttatagaagatacattttgtttttatgcactgacaattttgtttaccctcaatttcaggtagatcttttgcgagcaggagaagttcctaaaccttttccaacacattataaagatttgtgggataacaagcatgttaaaatgccttgttcagaacaaaatttgtacccagtggaagatgagggaagaacaaaaccgagattcttttagtctctgaaaaatggtttggtacttgcttgtttgacctttgattctgtgatgcaaaagaacttagaatagcttcctcatacgtttttcttttttccaaaagaatggtgagcgaactgcggggagccggtgggagctcattcagactgcacttctcaacaaatttacacgaccccaaaacttgaaggtatgttgtttttaccatgcttgcctctttatgggccctgtgtctcctctttcgaagactttttggtcttaatagactcaggtagcaacattctttagatgcagagtgcttgcttcctggcactaaggaaggctccttagagacattctactaggaaatgagaagaactgagagttgcaaatgccttgccaggagccacacagaataatttggagaaccaggaataatacctctgtttcttgattccccatccgatttccttcagttcaagcttctctttcttttttttgttttaaaattatcatgtttctgaaatatctttaaaagtaaatcaggaaagaattatgacttcagcaatatttgcccaaagggaagctgagtttcccaattctgcccttaatatagctcctagcagtttaataatttactcatcttatattttggcaataatttatttttgatatatttatatttcatttatgactgcaagggtaactagtagattgtttttctaatatctaaaatatgagtgagtgtgtgtgtgtgtgtgtgtgtgtgtgtgtatatatatatatatatatatatatatatatatatatatatatatatatttatattttggggacactatagccatgaaaacttttcatgtttttataaatataaacagtgacagaattttttgtacctctatgaaaatgagttttattttctttcagagacttaatttgttgtgtatagtttctcagctttcttaatattttctactgatacttgcaagttattgttaaactttctatacctttctgtagctcctgttttttttctttacatggaaaacattgatatgttataccataatgtattttgaaggctttattccttggggacagtgtttctcaatcttctaatgggctctttttttaaaaaaagaaaaaaaaagcaggctgtttatttttcttttttacagtacaaattgatttatttaaaacagttagaaaaaaacaaaacaaaatagagattatcattagaattattaatggtttgttaaaaatcaggtaggattacggggtaagaaatggtattaggtgggaggagcacctgactagttctaaggctgtagatacaatgcagttgattacgtattaattcagccattacatactggggatagtagatgggggatcagtgatttatctacagggaactcctacacagatccatgaagacctccccagtgccatccttttccactccttagaccctaaaaccacctgggtgacaacatttccgtccttctttctccaccccattccctatccatatattcttcccacacctaaggtgctgtgcaagctgagagcagtctgctctctgcagctggaacatatactgttttggctacagggatcctgtgtgactaagaaggttttaggggcagccttattttaatatatcaggttagccatgagtacagtcagtcccttccctaacacaatttagattatcttgaacgcaagtatcaggtgagggatcaaccctgcctccagcaataccagcaatacgctaaccactcaggctcacaactacagaaagcaaactctttaaatggaaacaatctcaagttctgctagagtttgcttagttttagtataatgttaattatgtgtatacaaacataaaactaaatataaactccatatgtgtgtgtgtgtgtgtgtgtgtgtgtgtgtgtgtgtgtatattttttttttttttttttttaatttgaagctgggtcttgctccatcacctagggtggagtgcagtggggtgatcacagctcactgcaacctctgcttcccagactcaagcaatcctcatctcagcctcctgagtagcggggactacaggtgtatgccaccatgcccagactaattttgtttattttagttttttgtagagacagggtttctctgtgttccctaggctggtctccaactcctgggctcaagtgatccacctggccttggcctcccaaggtgctggctgggattataggcatgagtcactgctcccagctaactccctatacctgtagtgcttatacagctatatcagtttgattttcttttttaatttcaggtataatgaaccatcatttgatttgtatttattatcacagtgaaaacaatttgtagtcattattcctttttttgcacagaaattttcaaaccgctgatccaaaccccaaaatagtatgctgagaaattctttaaaatactacataaagaagaaattattttgcaattattacttttcctactaatcatgaacagttgaggggtgttggtggatacaaagatgggatccttaaatagaacatcagatcgcagtggcacgatctcagctcactgcaacctacacctccctggctcaagcgattctcgtgcctcagcctcctgagtagctggaaaaaaatctcaagttctgctagagtttacttgattttagtataatgttacaggcatgtgccacaggtgcatgccaccacactgggctaattttttatattttttggctgagacactgggtcttgccatgttacccatgctggtctcaaactcctgagctcaagtgatccacctgccttggcctcccaaagtactgggattacaggcatgtaattaccacatctggatgaaggttcgttagaatttaacatacctgtactgtggtgtatagtaggacagctcaatcttttcactgtttttgtctattaatagtaccagccttcattcgtacagcgtgttgttatttggctgttgttttctaaaaacaaaattataaactcacatagaaacaggctgcccaggaatactacccggagtccatttgatgaacactatcttaggttctttatttttattcttctaaacagaggctgtttttaagaatttttatatttcttcaactgcaaatagaataattatagtgaggccaggtgcggtggctcaagcctgtaaccccagcactttgggaggccgaggcaggcaggtcgccagaggtcaggagtttgagaccatcctggccaacatggtgaaacctcatctctactaaaaatataaaaattagccgggcatggtggcgggtgcctgtaatccccgctactcaggaggctgagacaggagaatcgcttgaacccaggaggcagaggttgcagtgagccgagatcatgccactgcactctagcctgggcaacaaagagcgaaactccatatttgaaaaaaaggaaaagaataactatagtgttttaacttacacagtctgcttacctctctagcaattccttagtgcaccatgattatttcaggaaggggtaattgctttaatctgaatttcctttttgtgtttctcttatggtagattcaatagaacagagtaatccatcgagatatttttctgtctgcttatggtaattgtttcctttgctgaaagaatgctttgagagaggaagagggaaacattaaacccctctaattgaatataatgatttttttgctgttcatataccatttaatgttggatttagagggattagagacattcagaattttaaaaagtaatagtgtcctcaaaagttgatttacacagtagtacttatataaataatgtgtgtgataatttgcacagaaagaattttttgtgcttattgtgaattatgaactataaagaacttactcagtagttgataactcaagagtacagagtagtatccagtttttctaatgacaggcaacctcatggtggactacttttgagacttgaagactgaagtaaaaataaatacgagctaaagcttaatgctaattataaaacactaaaataattagagaattacagtgaagaattagaatgcaattgctacttaaaatttttttccttaccaactttgaggaataataacatatggataagaaagtttatccttttaaagtgtgtcatttgatgagttttgacatttacacataccatgaagctcccattataatcaagatacagaatgtttgtatcatccccaaagattcctctccccactttgcagtccattccactttctgctctggccccagacaactactaatctgttctttttcactatagtttacattctgcatgaattgaatcatagtgggtgtgtctggcttcattcactcaaaatgaagataattttgagattcatccatgttgttcaatgtattgatagtttgctccagtatatgcattgtttattccttcacctattgatacacatttctgtttaatactttatgaagttttgaaattagataccagtgattggaaaaaaaatccttaaaatcttttaattttttttttctttctttttttttttctgagacaggatcttgctctgtcacccaggctggagtgcagtggtccaatctcggctcactgcaacctcaacctcctttgctcaagcgatcctcccatctcagcaccctcatgtagctgagactacaggcatgcaccaaccatgcctggttaatttttgtatttttttctagggatcttgtcatgttgcccaggctagtctcgaactcctggactcaagcgattcacctgcctcggcctcccagagtgtgctatgattacaggcgcgagccaccatgcaggccaaaatctcttaattctttttttttttttttttttttttgagacggagtctcgctctgtcacccaggctggagtgcagtggcacgacctcggctcactgcaacatctgactccctggttcaagtgagtctcctgcctcagcctcccaagtagctgggattacaagcatatgccaccacacccagctaatttttgtatttttattagagacatggtttcaccatgttggccagaatgctctcgatctcctgacattgtgatccgcccgcctcagcctcccaaagtgctgggattacaggcgcgagccactgcgtcagcctaaaatctcttaattcttaatggaaaatgttatgtatgacttgtgagtgaaaaataaagactctttcactctttcttgctatcttattttacggaagatttttcttttcttttatcttctcttctcttctcttttcttttcttaaggaacttggatgtcccctgattccaagtgaataagacacattttgttggctcatcttttaacctagatacttagtatggcatgaagtactattcaggaagctttgacagagtattaattttttaaaaacttattcaatgataacgaaatttggaagatttatagtaataatctaacagtggttttcagacctgtgtgcctcagtaaaaaaattttgagtgtgtattaccaatataaatagtcatttataaattctacatatctattactttattaatgtaatatgtacagtataaaataaaaccaaagtagatatttaaaaggatgagataaaagataattataaataaatagttgtttctgcacatctagtggattgtcttatgcatacctgactctggaaaccagatgtatagtattgcctattcaaacagttaaaagctacaccagtagatggcataatattttgacttttcattctacataaatgtgtaatttatgtgaactgctggaggaagataataatttatatatagtataaaaatactttatagtaaaggaaaaaagacagtttttaaatacttttttcctaatctcctcgtccccatgaaatttttattttttattttttacaaaaaaatttatgcctcaaccctattaactgacccatgaaattttcatactacaaatctgctgtgtatgtctgtgtatatataatctgatgctttcaaggaccaccaacaattgtgataactaagtttattttttacccctcaagatacagtttttgtctatttggagtatatcaccttatttagaatgcatgctttagggtgtaattgtgttttttcacctattacttgaccgttctaatctcattttttaaagtgagtaataaattagtaatcattctgtttgtctgtagctactgatgtccatatcagtagcagggggaggtagtcggaagcttgtctaacattatgaaatatactggaggtaattcataagagacaggctcttcataggtcattcacttggccataccatgacgttttgtttctgcattttccacaggatgctattctgaaatacactgtggcatattctaagaaatgggactttacagctttgatcgatttctgggataaggtaaaagtatccctatttctttatgaaaatattattgacaactcaataagaaggtttgagaagaatacccataattctgccacgctaagataattatcttttagttttataaatttgctgttattttatatgtatgttttaggtaaatacaattaggagttaatattgaattttgttttcatctcttagaacacacattttctgttatattttcataccattatcagcattatcaaggaatgtataatagtccatgactagattttgagaatataatggttcttatattctcaaacatacaggttgcatccagttttaccttcagttacatagtggcaacatcattatatatgtatatatattttcccatatttgatattgtttctttaggtgatttccagaaattagatgactaagtcaaagggcacaaaacatttgtttaaaaatcttttaaaaacttttgccataaaatcatttttccacagattaattgtagcaatttactatgctgccagtagtggataagaatatcactttcatagtaccatcagcagagagagtcttttcatttgtctattggccatttctatatcttctttggaaaaatacctattcaaattttttgtctttattattgaattttaggcattctttgtatattttagatgcaggttccttaccagatatatgatttgcaaatattttctcccattttgtgttttttttttttctttttcttgatgttacactttgaagctcaaaaatttttaattttgacaaagtcagtttattattttttttcttttcttctgttttcgggatcatatttaagaagctaatctaagttcatgaagatttatgtttcttctaagaattttatagctttagctcttacactatgaccattacccattttgtgttaatttttgtatatgatgtaaattagaagtccaattttattattttccatgtgaatatccatttcgagttaattttcatatgtggtataaggtaggagttcaacttcattattttgcatgtggataacaagttgtcccagcaccatttgttgaaaagactcttctatcccgtgttgaattgtcttggcaccttttcaaaaccagttgacgtaaggattgtttctggcctctcagttctacgacactgatctgtatgtctgtccttgtgccagtaccacacagtcttggttccatagctttgtggtaagttttaaaatcaggaagtgtgtgtcctgtaactttggtctttttcaaatttgttttggctgtttttggattctttgcatttcactctgaattttaggattaatttgttaatttctgcaaaaaacctaggtgctaagggcaattcttacatcacgttaatagaatccaaactaattctgcatttcgaggtagtgccagtaatttcagaattatcttattgagcttttgacccatatggcttttacaaggcaggcataaataatggaagacttatccttgtgtctggaaattggatatctcagatatccttgaatctaaatgtctttcactgtaacagcaatgtaatatctgatatgatgaaaagtagatcaaaccgatataatcattatccttgtcacttaagttatcaggacataacatttgtattgtaagtttctgggcttaaattggatatgatggttaattggggtaagaagtaatgtataatttaataccttgagatggcagtaaaacatgccgttggttacaatacctctgtcaccttgctatgaagtagtcatttttttctctcttcttaatcagaatactcagacaggaccttgtttcccctttatctggtgaccttgcccagaagcatgcctgaaacgggtaacatatagcaagttttggtgtgtttagtgtagatcataaatatgagatgattactcaggtgctgatgatggttttacagttctttagggagaagagtccttgcgttttcgaccttctaatatttatttatttatttatttatgaaatggagtctcactctgtcacccaggctggagtgcagcggcacaatctcagctcactgcaatttctgcctcgcgggttcaagcgattctcttgcctcagccttccaagtagctgggattacaggtgcccgccacgttgcccggctaatttttgtatttttagtagagatggggttttgccatgttggccaggctggtcccaaattcctgaccttaagtgatccacccaactcggcctcccaaagtgctgggattacaggtgtgagccaccgcccccaaccagaccttctgatttgtatttactttgtaaacatatggagggttggagaagtccccacaactacactaagtatttatttcttgttgtattctttttaagtctttgcccatatatatgatgtcttatagctagatataaatgtatgtttaaaatttatgctgtattataaaatcttctgtgttatataactttataatgtttagccttaatggttgcaataatattccatcaaattgataaattgtctgttcatccattcctgtgtttgttggagatttgaggaaatttgtgtaaagcttatctagagatttgaaggtggttctccctgtgattgtttgctattctgtcattatgagtgtacttaacaaaataccttggatgtttaatacacttgtttatttttctatccatcaaatctccagatattattctagaactttagcaagtcatgacccacagggacaacattgcccacacttgcagtggttagtgagaattaagtgtcagacatacctatataggtgggattggtggaagaaaagatttttagcgcaagggaaacaattgtttggtttggttttaagttgaaaataaattatatttggtttgcattttcagtgtcttatgttctgtactaggaatgcttgtttataaagggttcttttatttttttatttaaagccaggctatagtgcagtggtgctgtcacagctcactgcagcctcaacctccggggctgtatacattctcccactttagcctcccgtttagctgggactacaggcatgtgctaccacacctggctagttttttgtatttttttgtagagacagggtttcaccattgttacccaggctggtcttgaactcttgggctcaagcaatcttcactcctcagcctcccaaagttctgggattataggcatgagccactgtgcctggcctataaagcgttctttattttcgagatggattctagctctgtcaccagactggaatgcagtggtgtaatctcggctcactgcaacttccacctcctgggttcaagccattcgcctgcctcagcttcccgagtagctgggactacagacgtgcgccaccacacccagctaatttttgtatttttattagagacggggtttcaccatgttggccatgttggtctcgatctcttgacctcgtgatccgcccgcctcggcctcccaaagtgctgggattacaggcatgagccaccgcgctcgaccttaaactaacggttcttaaacattgtttattagcagggtttggcaatattttcaatttttattttctaattttttgttgttttgagacagtatctcactctattggccaggctggagtgcagtggaatgatctcggctcattgtaacctccacctcccaggttcaagcaattcttgtgcctcagcctcctgagtagctgggactacaggcatgcaccaccacacctggctaatttttggatttttgatagagacagggtttcactatattggccaggctggtctcgaactcctgacctcaagtgatctgcacacctcggcctccaaaagtgttgggattacaggtgtgagcggctgctcccagccagaatttggaaattctttacttaaatgtcacattgaactctgagtggcttgttttattaaggaaaagaattaaatttgacatcgtattaagattaatattttgcagttacgtttattttgaagctgttgatatttatctccttaaaacctttctttgattaattctgtaagtaaaggattttgtaacccaaactaccttacaacaagaggagttcatgtcaacagtcattgtgaatccatggtaccataattatgtacattctggtctctagcacaggaggtaaggtgcccagaagcccaccctggtgtgtgagcacctctactggaatggaagtaaggagtattacctaagcttttattagtttttcagaaaccagcaaagatcacagagaccaatctgttaatttgttatttataattatatatttagatgctactgagtcgaaatggctgttatttagtgttttctgcaacttcagggctaatattggtcttcctcactgccagctgctggaagtgctacaaacacacaatctgtgttttatggccctcctgtgtggtgtttcacaaaattaaattcaaacacttctgtaatttatattctaaatgaatcaatgtacttactcctggcatttttcactggaaagttgaacaaaatgttctatatgttataaaagtcctctatcaatgcatcttggaggaatttttaaatacttctcttttttttttttttttttttgagacagagtctttctctgtcactcaggctggagtggagtggcacgatctcggcccactgcaacctctgcctcccaggttcaagtgattctcccgcctcagcctcctgagtagctggaattataggcacccaccaccacgccaggctaatttttgtatttttagtagagacagggtttcaccatcttggtcaggctagtctcgaactcctgacctcaggtgatccacccaccttggcctcccaaagtgctgggattacaggtatgagccaccgtgcccagccaaatactcctcttttacaacacctgtggcactgtttcatttcacttatagtgtgttaacttgtgaaatttacattaaagctgtagtaactgaagggcatgggggatgtatttttaagggggtttcttctgtttctgcaatgttggcttctatttctggacttggatatttgttttatatttattcattagactatacatatatatttttatgtactttttgaatattcacagtaagcataaaatgttattataaagagctttaaatctgcaattgatttatgtagcaaacttcttaagaaaatggattaattgttgaaaggaagcctaaggattttagtgactatttcatcttcctttccatgttgagttttatgtctggaattgaaaagatagaaatgtataagcctttcgtttcatccttccattggtttttccatgaaggctgtcataaataacaaaatgaagtggttttggttttgcttttgttttttgcatctgtggctggtaaaggtagagagtgagagataggagtacaggaaggagaggacatttaaaagtaaaaaatgaaaaacctagactttagaatgattatgttgctgtgatgaggctagtaatatgtttctctttgtaaaccacaatttaaatatagatgtatagcataaagtctttacttcaaatcatacatacaaaatagattattgcaacttagaaattgtgcatcttttgtcttcgctgtagttattaaaatatcgactacgcattctcctatcagctcttgtcctatgacttgtcagagaaagactgtttaaagcctctatcactgtaaataagagtgtgtaattctattagtattgaacttgcatttttatttatgtgctacttaatttaaaaggtaaatgggacatcatattgagttttgaatgatgcaaattaagttgatcatgttattacatctgtctttttcttcagaactgtttctgtcatttaaattttttttttacttttttttccaagagcacaaatccacttttatttatttacttttcattaatttaaatgcttgaggggtacagcatcacacagattctgtgtccagtggccttagcaggaagattgcttcagaatttggcgtgaaccatgccactatttccctgggaccgagttacctttccctagattactctgattttgtttggtttgccaccaggagtcactttgttgttctttgttttgtatatataagcacatcttatgcccgaatagaattctgtttcattttgggcataagcaccttctattttaaaaagagctgtgtgctgtctttggttctggagaccccacttatactcagcaaaaatggccttggaccacagccttccagacatacttccttttagtattcctgttcccagcaggcctccacaggctccaagttggcagaaagagaaaggccatttaaaattttaaaaacaggtacaacataattcattgtctccaaaattgaggcatgtattattatagctgtgtttagctaaaataacagtttttgaacttgtgattatggaaaactttaaaaatgataatgtattgacagagcatcagtagaaactcagaaaaaagaacataaacttgtattaaaatagattacaaaaagttatttcacatacacaaagtaatggctggaagaaattaagttttgatttatgcctttattatataataaaaagttaaaatatatgttgaaattattaggcaaaaatcacagcacaaatcagctatgattcaataacgtaaaacacaatagttgtatgtttatgcatcacttgagcatcaatgcattcaagcatatgtggtatactgtggacatcctggctttctgaggtgtggcatgctattatgagtagcttatctcatggtaattttaactgtatcaaatatactcagtatttttgtgtattaaaaattttagaacaaaaatattgttagaggatttttctttcttctctcttcattcctcctatccccacccctttatccccagactgtctataaacatttcatgtagggttagtgctttttagaatagtttgggaaaagctgacctaaggcggtaaattgttataactacctttttaaatcacaacagatttcgttattcagtaactgaaggaatgtggcctccttccatgatagccttttggtggtcattttttgttttgttttggtttggttttttgataacactgaagtaagtttctgaatgtatataaacacattattacttagcttgatttaacattcttcgtagataatctgttttctgggattttcttcaaagcttaaaaaatatcaagtgtctttgttatatttgtcacaaagagcctgtaccaaactcctaatcaaatgaaagcagccttgaatgtttcataagactaaagctaatgtctttatctctctagctttcgaacctctgatttggagttcagtggaaatttaacctttttggacctcttcccttggtgactcacagtctctggaatcataaggtctgcattactttacagctcaatttaattcatgagaactataggagccaaaagggagctaatcagaatcactaaaatattgaaacagatcaattgtgacttttagatttgtatggaatatgtggaatttctctccctggtttggttaatgagtgcttttgaatggggacatatgttgagggtctcatatttatgatttatgatttctaaatagtgcatatcccaaaggacagattactccaattggaactaggcactttgcttttataaacttgatgagttaccatggaatatcagtcttagttgagccctctatgcactagatcactgatgaagttggagttgttattttgtgtttgcaaaacactatctggattgtatttatttatgtggtggacaaagaggttagaagttatagatactcaaaagtgaaaattcattcagtagactttctcttatattctaataatgaaattaagctagtacttagtttgtcctataactctaacccttcatttgtgtcaaatagcagtagaagttattctttttaaatgttgctgtggtgttgatttcattatccaaaaatctactgttagaggagtgaaaataattctgtgttttaatcttgcccatgatttatatctctatcagctagctctgaagtgttttgggttttgttttgttttgtttgtattttattaacacagttaaacatgatgccttgatttataattcctgttaatttgcatttattcttcttatgttcctactcataaaaataaattctgtagtccttttgagtatgctttgaacacttatctacatgtaacattgcatatttaaccctggaaggactattgtagtatttttatctgaaggtaaaaataatgagtaaataaaaacagaacgttagatctgtttttcaaatttatatattgtttcagtgtgtagcctatctaaacaagcggtaaacttgctcatcaaagactaaataggtccattggtccttttatatgagggggtgctgttagtgctgtggtttaccaaagactaagccaatggtgtttctccttattttactattagtactagtagagaaaaatactcatcctcgatttattgtgatgataatgacaggtaatgatttactacaagagtctgtcagattctaagcaggctaaataatttttctttatagtgtgttaacaaagtttttagtacgctgagtgacatagtgccttgtcaccacaaatgctctttgattacatgaaaagtgttacaaaaagacattttctgcagcaagggccatttccagcataatgaaatatggaatattttcaaatgaactccaaagtgatatgtattgaggtcttgctcttggtctaatctgcctcagtcctgagaagcctagctctaagataaacaaagggcatcttccactgggagtgcaatgttggaactgctcactgccttaagtaaccatatgcatagcctctttcctgatagttggctcctgtctccctttgtaatcctttccttcttccatgcctgctgcttaagttgcagactattccagcctcacttctcttggacacttctatctgttgcaggcataggcctgtctcatcccagactcacctcttctacaagatcctccctgtacatatcttctttgtgtttgctggatcatcttatttggttatctttggcgatggaggtggtagtgcttattactgagagttttctatgtaccaactatagtgtcagcagtatgctttatctgatttaattctaacaaccacctcatgagttagatgctattaatatttctgttttacaaatgaagaatggaaaaccaaggtttagggagtttaagtaactgacatctcatttttatctatggactgtggcacatgctgtcagagtcggtctttgacatagcacctaggaaagaagctgaatcagattaaacatactacccaaacattaggtcaattgaaaatggctagggaaaagggaagattcatcataaaaactaattgagtaaaactagggaggcccaataagttcaaatatttgaattcaaggtagaaagaagaagaaaaccctctagcaaaagtcggccttaatggcccatagccttagatctggcatcatttagaaccacatggctgggcatgtggctcacgcctgtaatcccaatactttgggaggctgaggcggacagatcacttgaggtcaggagtttgagaccagcctgaccaacatggtgaaaccctgtttctactgggaaaaaaaaaaaaaaaaaagcagcagcatcacagcctcagggaaagtacctaccagcttccaacagtcttcgttcctttgaatcctttgccatctggttatattccctcttcccattcttgttatctgcccatctttgacacctcttttcctctctcctgttacttggcatcgccttgggcaacttcggttcagttgatattcatgttgatgaaccatttactagtcaaacccagtctgtgtgtgagaccttctactttattaacccatgtgaccacaaatgaccagagcttggacctgattatcccgtgggccagctccttctctaaagccatgagctcagaattcttctcccaccacagcctcctagttttctactcccttattcctactgtgctttctgttttttgagtctccactgcgttcatcccttttcttctggtccactgtgtcccaggttgtattacgcaaatattaacacttcgtaagtaaagggttaatagttaagttgggggaatgtactgggtattatatccttcttctgggaatagctctgaggagtcttaaagtaaagaaacatgcttagctttatttaattaaacctcttttttttcaaacttatttataaacagcttccatgtaacagcttttgacttcctttgtagcaagtattccatggagcacactttgcagagcacagttgtaatggggaaggaagggaaggaggaagaaataaagggcgagaggagagagggaaggagggagagagggaataacaaatcttactgataggccttgctaagagttcatgttattcaatcttaactaggcctttgtttcctgttgccatcttttatatatttccttattactctaggattccaaaccttttcattgttttgtaacatttactgacattccactatcagtctgctcctacttaatacctcttggagagatttgaggacatctaaaaggtaaattctttaagtttctttattttaaggttttcaacatacctcatgcttctctttcttgttatctcaaaggaaaagctcgtcttattccattcctcaagggcagcatgtccaaaacaattatactttaggatacatatgtcactgtttcttttctggccttgtccctctttccctgctgcctggttagtgcttccttgacttttagtgttcagcatgactatcacttctgcaattgactttatttatttatttatttatttttgagatgttctcttggtctgttgtgcaggttggagtacagtggcatgatcttggctcactgcaacctccgcctcctgggttcaagcgattctcctgcctcagcctcctgagtagctgggattataggcacgcaccaccttgccgggctaatttttatatttttagtagagatggggtttcaccatgttggccaggctggtctcaaatccctgacctcaggtgatccgcccacgttgggcctcccaaagtgctgggattacaggcatgagctatcgtgcctgacctagactttctttttttagagcagttttagattcatagcaaaatacactgatttctcatatatcccccactcccaggcatgcacaccctcccccattatcaacatcccccaccggagtggttcatttgctacaattgatgaacctaccttgacacatcattaccactcaaagttctgtaattgatgttttacagtcatcttctataagcttccttgtatgaggctgtgatttgttctttgttatgttcctagcacttaacatagtgagaactttcaataccacttaatgcaggttatatgcaaatcttttttcttttgctctttctctctgccatcttctaattgactattggatttattcacctggatatgccacaagtacctaaaactatccttgtcaccactcttccacattctgtcagtgaatgattccaccatttatctattcattcactcaagccagaacttgttaatcatcttagctgccctattctgcctcagccacctttttctgctcatctaccatttcctcatcttacagtatgatgtcataattttacttcctaaatacttcttgagtttcggctctatttctgttacacttgtctcctccataccatcgtcatgactcagctagtatattgtaacaatcacctagccgacccctgtgtgcagttgatcccttcaaatccatccttcatgctgcttacacacagtgaactatctgaagcatagatcttaaaaccttccatggcatttcatctcttttcaactctattggtgatatttatggcattccatgaccttgcctctgcccacctctctggcatcatttcatgccacttttcctgcttgaaacctgatggtctaatgactctaaattacttgtggttctctgtcatggtgtttgcctgcttcttaatccagccttcaagactcagctcagtttttatctcctctgagtatccttttttgtcctctcagccgctactaaaaactcctctgtgtgctcacagtagtacctgtgcacaactccatgtgcttgttacattaggcatcatatagccacgaaatgtctgaatattcatgaggcccaatttttccagggcatcttactattttctagcccatggctaatgcacagttaatgtttcttgaactgagttcaggatattcagggagagtagtccagcacacaaaaatgtgggccttgaaccacaatcacttaccgagagatttaggaattattttgtgtaaggtgatagttgaccatttgcgactggtgattggtagagagaaaaggtaaggccagtatgcataacctttactatagtcttttttgtttcttttttttccagagacagggctttgctctgtcctccaggctggagtgcagtgccataatcatggctcatcgcaacctcaaattcctaggcttaagcaagatcctcctacctcagcttccagggtagctgggactataggtctataccaccacacctacctaagtaaaattttttttggccgggcatggtggctctcatgcctgtaatcccagcacttcgggaggctgaggcaagcagatcacgaggtcaagagatcgagaccatcctgacgaacatggtgaaaccctgtctctactaaaaataaaaaattagctgggcgtggtggcgcgtaagttgcagcttctctggaggctgaggcaggagaatcacttgaacccgggaggcagaggttgcagtgagccgagatcgcgccattgcactccagtctggcgacagagtgagactccgtctcaaaaaaaaaaaaaattttttttttgtagagaccgagtctcactatgttgcccaagctggtcttaaactcttgcccttaagcaatcctcccgctttggcctcccagagtgctgagattacaggcatgaaccactgtgcccaggctttatagttgttgtgtagcatttttaccctaaaaagtagtaagtttctagaggacagacaccttgtattgtttgtcttggtgtttatttttcacagtgctcaatctaatgtcctggacaaagtgggtgttcaatatgtgtttggactaagtagcaatatgtgactagaattcagtaaaagggagaggctgttctatttcttgtatttctgagctccgtaagttcacgcttcaggggcccatttacctctttaattccctgcatgcaaaaggaggatgaatgccttagatgatagattgaacctgacctcttaatgttttatgtgatatagctatgtgccacatcagtcctcatatgccttcatttttatatgggctataaaaccaaaattacttcaagaggaatatttgaccattttcatccttcttttaaaatgaattggagttaccaaaagtagcctgatgcagttgaataaaattaagtgtattttaaaatctctaaacaaaaagctacagatttaatcatctgtagttgtatctacatatgtctgaaaacccctgaatcttctttcggttgccctggtgactgtttcattggagtagcgtatcaagaaagactacatctgtggagtccaaacactagctactatccacataggctatttaaataaaaattaattacaatgaaagaaaatttaaaattcagttcttcagtcacagtagccacatttcaaatgccacatgtggctgccggctgccatcctggacagcacagatatagaacattttcatcactgcagaaagttagactgaatagaaatgtactaggtcatccctaaggatccttctgcatctgatatccttctactgggaaacctgctcacagggacttctgagatttctcaacattgtttgactgcattttgaatttttttagattggatattacttcaaataattgagttgttgagtagaacttgtccatttttaataaagatcttttcattgtaatagcatttgttttaactacaaatgtatttgcatttttattctttctccaaagagtgcgcttccagagagtgtcctcaagccttttaggaaaattagttttgtttcatccttaataagagtgaagttcagactataatattattatttcatactggataatttaattaaattaagaattaagcactataatatgtatgtatgcacgttacttgatttgcatggcacattttataatagcgctgtgagtgtgctaagctgtcattgaactaccataaaaattacttaagtctgggtgtggtggttcgtgcttgtaattctagcactttgggaggctgaggtgggatgattgcttgagcccaggagttcaagaccagcccgggcaagatggtgagaccccatcgctacaaaaatttttttaaaaattagctgggtgtggtagcatgcatctgtagtcccagctacttgggaggccgaggcaggaggatcccttgagcccaagagttcgaggtggcagtgagctatgatcacaccagtgcactccagcctgggtgacaaagtgagacccccatctcttaaaaatatatattactgagaaataagtatttttcagggtacttcttagagttgaaaaaacctgctaattatttaaaagtataaactataataaaagattgaagttattgctcacctgtatttcttggacaaattacatccattttacttctagggctagaaaacttatatcaccattagctgtttctctgaaattttgtcatgttgagtttgattgcctgtctataaagatggataataatgtgactatgtggtattgaaagtatccattggcttggacataatagcaatgtggtttggtggtgtttacaaaagtgattgatggatatggccatgtagtcgtacagtaatagaagtgagaaataggaaagacatgtcagagcgtcttgtgccagtgtgggtttatttcctaaggaataatcatttaccataatagtactgagaagtaaattctttggcggcataggataataaggatgtattattatgttttgtcttttctaaagtaagaattctgctgtttattattagcatgaaaatcgatatgattgtgcaataaatactgtttaaagaagaacttccttcatgttttataaacctacacaattctattcttcatgtttaatgaagtttgtgtaggaaaatagtgtgactgtttttgattagaggcatattttgtttcaagaattggatgaagatcttcttcctaaactgattgtgttcccagactagttgttaattatttggaattaggagtcatgatggggaaatttccaccacatccagaaagtctgtgaattttaaacctctgatggcttgttttctgaagtgaaaaactaatgcagatttctgtcactagaaacacagcagtgcttaggagagattggaagtagggttgtggtgagaattggcaggaggactctttctcccttcattcctcctccttcgtcctgcactagctgataagagctgggccataggagtggagactaaaaatgaaaggaggtttcattgcttagcacttcttttcctcttttcccccttctgctggcaatccttgatggggaggaaacaaagtgtctgtatagcagcccgattatttcatattaagcaactgtcaaattaatataaggacaactgcaggttatttccagtgtgaattacagagtactttaaaaactcgttatatttcatttatctatcgttagggcaaatcatttcaaatgcttataatgagctgtgatttttatcagtatttcccagatttgagtcataaacactttgaaaattcatagggagactcttaatagctgtttaaagaggaaaaccaaatcaaaccaaaagaaagtagaggggcaaggtgatcctcagcacagccatttgtatgtgtcaccacagctgacccctggactcagcctttcacaccaccttgccctctgctaccacactgattttgtacctctccatgcacagtcttatttaggtccatgaactaaataagttagctgctaattggtgaaatatgccttcttaaatatgaccatgttagcctggctatttcctgaaaaccagttggagtttattaaaaatagagaccatttttattgaagccataattgtcatgggcgatacacatgagagatcaccctgtggctggcctgtcagactttcatgagccttcagaaattaaggggaatgagtgagtttgttttcttgtaagctgtcacattcttctcttcaaagtgtcagcctgagttgtgcacagataaatgttagaaactttcaccttctccagttgatttttttacccttacataatttagtagtatgattgtttttcctctaacatttaatgtttttgtacttttaatttttgaaatgtgagcttgtgctttagagttgggaaaacttagaggtagttccagtatagaaagcttagcctatagacagtttaatcaacttacacaaaagaaaactataatatttttgctaagtaatagagattctgaaaggcaatggagaggaggaggatgagctttgtaaaatcagctaatccagatagaaagtgtcagttaatttaacatatttttattgacagttttacatatgaacaccactgttgtaggaatggtgaatcaatcataaatcttgtcttaaaggagcttctagtaagggctagaaggcacgttcataaataacaacagaaagcagaaagtcttaagtgtcttgtgaaaaaaagttcaaataaattacaagagggagaattactttttagctggagagtaaatttggatagacttgaagcaaactattgtttgagcaagatcaaaaggttggataagttttggagttaagaaggaaagatattccaggatcgtatctgtagcagcacaaacagatgctatagaaaaatgaatttctgagtttctagtatgtaggctgcacagaaggtagagtttgtgagtgtgtgtatgttatatatatgtgctgaatgagactagataagaatctagggtaagggagcttgactgttagttcaagggatttgttctgtattgaaaaggcagcagaaagccattgaaagctttgaagtggagcagaagcacatcatagtctacttgggcagaaactgaaggtgggctatcagcagggcagcagttagattattgtagtaatcttgatgagactggatgagggctgagggtagtttagtagtgattaagatgaggtaataaatatgtgagatcctgctggatcaatcaatataggacttggcagttaattgatatgggggtgatcaaagaagaaggaggctccagaaagtttgtgaattactggcccattagacattaatactttttatatggagctttagaattcataaaacactattatatctgaaagctttcgtaactctgtaagttaaagttatagtagaattatccttactatggatgaggaaataaagaatttagggatttttctgtggttaatatgagagtaaatgccgatctaggcctataactagtcttccagtttcttggccagtatttcttttatatccttccttgtgaacctgggaagaaaaactctggcatctagtcccaatgtctttttgttttttttttttgttttttttgagacagagtcttgctctgtcacccaggccggaggtgcagtggcatgatctcagctcactgcaacctccacctcccgaactcaagcgattctcatgccttagccacccaaatagctgggactacaggtgtgggccacaatgctcagctaatttttgtatttttagtagagatggccaggctggtcttgaactcttgacctcaagtgatccacctgctttggcctcccaaaatactggggttataggtgtgagccactgcccccaaccaccactgggtttttgaatgtggacaaattgcttatttcttggagctttagtctctctagatgcccttatcctttctatcttgcaaggatactttgaagataaaatgcaatgtttttggttttatcaactctttattcagcaaataatgagcactaaatactatgcttagtactggggggccacaagatgtttaaatttgtgtgtttcacagatcagaggacaggaaatgcagataaataattgtaataaccgcagtaagtgttctaatacaagtatgtacatttggctctagagtcatagagtaaggggcagtcaggcaatcagcgaaggcttcccagggagatgggaactgagtcctgaagcataattcgtggtttaatggtagtaaaatgttaaacaaggcagagggtaaaataatgcatcatcatcatcataatactagctgttatttgttgaaaagcttataattctgaccacatctctgcaagatattttcattttataagtaagaaaataggttcaaaaggttgtgatttgatcatagtatttaatgaagtcagtatggtacattagggaggtgcaaatggttaagtatcactggacagtagcaaacaagcaacagaaaggataaagataaaactgaaaaaggggctcaagtatgctatattctagatattaaaaaataaaaataataaaactagtggtttcatgacagacaggggagactattttaacatatatgagacaaaggattaatacctagtaaaatatgcctaattaaacattggttactatgtggaccaagatgttttcactgatcagttctccgaaacatttaaggaagatataatactaagttcacagaaactcaaataagagaggaggagggagcactttccaactcatttataaagccatatatatatacctctcatactagtatgtgacaaagattttataaaatattagcaaatgaaatctagaaatatgtaaaaaggataatacatgattactaagcagagttcatctcagaaatgcaggattggatttatattttaaaagctgtatgattattgtgataaatgcagaataagcacctgacaaaatttagtaaccattcagagtgaaaaactgttagcaggccgggagtgatggctcatgcctgtaatcctaacactctgggaggccaaggcgggtggatcacctgaggttaggagttcaaggccagcctggccaacatagtagaactccatctctactaaaattacaaaaattagctgggcatggtagcatgcacctgtagtctcagctactcgggaggctgaggcaggagaattgcttgaatccaggaagcagaggttgcagtgagccaagatcgcaccactgcactccagcctaggtgacaaagcaagactgtctccagaaaaaaaaaacaaaaacaaaacaacaacaacaaaactattaacaactatgtcctcaatctgataaagcgtatctgtgaaaaacctactactaaaatcatgcttcatggtgaaatatgaaatactcttcccaaagattgggggaaaagcaagaacagccatgctcttcattcttattaacattgtactagaaatcctagccaatgcagtaaggcaagaaaaagaaataaaatgtttgaaaatcagaaaggaagaagtaaaactgtttctatttgtagttgacagtgtttgtttatgcagaaaaacccaagaaacctaaaaaataactattagaactaatttatttagcaagacataaggtcagtatacaaaaatcattatatttttatatacttaccataaatgaaattttaaaaatttcattaaaaatagtgttaaaaaaccataaaatacttagaaataaatttaacaaaaaatgtgtaagaccagtatcttgaagactgtaaaacattgctgggagaaattgaagaaaacctgaataaaagaatatctaccatgctcatggaccggatgactcagtgtggttaagatatcagttctcagccgggcgcggtggctcacacttgtaatcgagcactttgggaggctgaggtgggtggatcacttgaggacaggagttcaagaccagcctggctaacatggtgaaaccccatctctactaaaagtacaaaaaaattagccaggtgtggtggtgggtgcctataatcccagctagtcaggaggctgaggcaggagaattgctcgaacccaggaggcggaggttgcagcgagccgagatcatgccgttgcaatccagcctgggcaacaagagtgaaactccatctcaaaaaaataaaaagatatcagttctccctatatgcagttccaatcataataccaagcaggcattttgtagaaaatgcaaagctgattactaaaatttatatggaaacacaaaggacccttatttacaaagaaattgtaaataagaagggcagagtttgcagacttacgtgaattgctttggatacttacaataagactacagtaaacaagacagtatgtgtggtgagttgaataatgtccccccaaattaatgttcacctggactctcaggatgtggctttatctggaaatacagtctttgcagatgtaactagttaagatgaggccacactggattatggtgtatcctaaatcaatgactggtgtccttatgagagaaggaaaggacacagagacaaagacactgagggaaaatgcttatatgatgatggagttagagattggactgatgtatctgcatgccaaggaaccccaaggattgctagaagccaccagaagctaggaagaggccaggaagagccttagagccttcatagggagcgtgatactaccaacaactggttccagatttctagactccagaactgtgagataatacatttttgttgttttaagccgcctggtttgtggttctttgtcacagcagctcaaggaaatgaatacaatatgatactgacataacaatcaaattgatcagtggaaccaagtagtaaacccagaaacagacccatgtttatacagtcatttggttttcaacaaaagtgccaaagcaatacaacaagggaaaagaagtgtcttttcaacaaatggtgttggcgaaactggatttccatgtgggcttaaaaaaaaaaattgccccttcccacatactatacatagaaaataattctaaattctaactgaaaaagcaaaaactataaagcttctagaggaaaacatctttgtagcttaggagtcgacaaagatttcctaggacctacagcttttatagctaatgggaaaccttagctataaaagaaaaaaacttataaatacttgtgacgaaaacacattaggaaaataggcaagctaaagacagggatgccaggcgcattggctcatgcctgttatcccagcactttgggaggccaaggcagagggatcgctggagtacaggagttcaaggccagcctgggcaacatagggagaccttgtctctacaaaaaaaaaaaaaaaaaaaaaaattaattagctgggcatggtggcacatgcctgtggtcccagctccttgggaggctgaggtggaaggatcacttggaggccaggtgtggtggctcacacctgtaatctcagcagcttgggaggctgaggtagatgcattgcttgagcccaggagttcaataccagtctggacaacatggcaatggtctctattaaaaatccaaaaattaggccaggcatggtggctcacacctgtaatcccagcactctgggaggccaaggcgggtggatcacgaggtcaggagatcaagaccatcctggctaacactgtgaaaccccgtctttactaaaaatacaaaaaaaacattagctgggcgtggtggcgggtgcctgtagtcacagctactcgggagcctgaggcaggagaatggcgtgaacctgggaggcggagcttgcagtgagccaagatcgcgccactgcaccccatcctgggcgacacagggagactccatctcaaaaaaaaaggaaaaaaaaaaagtcaaaaattagccaggcatgttggcacacacctatagtcccagctacttgggaggctgagggtgacaggattgatgcctgggaggtcaagactgcagtgagatgtgattgcatcatgacactccagctttggcgacacagtgagaccctgtctcacataaataaatagaaataaataaattttaaaagacggagaaatatttgcaaaatgtttatctgacaagggacatgtatccagaatatataaagaactacaattgaaaaataaaaagacagccaacctcactagaaaatgagcaagagtttgaaaggatttcacaaaggaaggtatacaaattgccaataagcacattaaaaaatgcttgatattatttgtcactggagaaatgccagttataactagaaaagatattagcctgcaggcactagaaagactaaaagatcaaatgtaggtagcgatatggagcagttgcaactctcatactttgtttttgggagtttaaaatgtactacaatgttggaaaaaggtctggctgttttttagaaaactgaacatatacttaccctattacccattaatttcatttctttctatacctacctatgagatatgaaaatatatgcacacaaaaagatttgtagaagaatgtttatagcagttttacttataatagccaaaacctggggacagcccaggtatctatcaacaagagaatgaataaacaaattgtgggtgtattcatacaataaaataatttttgtatttttagtagagatggggtttcatcatcttgcccaggctggtcttgaactcctgacctcaagtgatccacttggcttggcctcctaaagtgctgggatcacaggggtgagccaccatgcctggcgtgaactctagttgctgatatgcaaactgaagtgatggggtggaatgcttgcaacttacctcaaaacgcattaaaaaatgcattgatatgtggtcagaagaatggactgatgacaacatgacaaaagcaaatataaaatgttaatcatagaaaccaaatagtatttgggtattcagtgtatagttattttaacttcaccatatttttgaaatttttaaaaacgttgggaaaaatggttctcaaaggggaatgattacaaaaattattgtacttctctactttggaatactgtgtagcatttgtcattgtataatacggaaagactttttaggctttctcttaaggcaaaaacaagttgtagaaaaatataatattttaaaaattaaggtaacacaaaactgtgtgtttatatgcacacacacctaagttctcagaagaagtttggggaggaaatacgcatctgtttatatctgagaagaggatatcttggcagtgggcttgtgggtaatatttcttttctttttgtttatattaattttcttcagtgaaaatacatgacattttaaaaaacattttgcctttagtgatgtaaaaaatgcctttttgtcatatttggtgagaaaaaatactaaattgagcaacataatttccactgataaatgcacctatgtaaaaggaaaaagaaacttaggtataaatattggttatgttactattaggaacatagttgatccacccacctcagcctcccaaagtgctgggattgcaggtgtgagccaccacgcccggccaggaaatttttttttaaagaagcatttcagacatacacaaaaataaaatggggtaatgaacctccctgtttccatcactcatcttcagtattacaggctcatgcctgtcatcccagcactttgggaggctgaggtaggtggatcacctgaggttaggagtttgagaccagcctggccaacatggcgcaaccccatctctaaaaatacaaaaattacctaggtgtggtgatgcgtgcctgtagtctcagctactcaggaggctgaggcaggagaatcgcttgaatctgggaggtggaggttgcagtgacctgagatcatgccactgcactccagcctgggtgacagagtgagattctatctcaaaaaaaaaaaaaaaaaaaaaaaaaaaaaaaaaatatatatatatatatatatatatatatatatatatatatatatatatatggaccataggattatgaggatatatcctctttgctatttagcttttggagtggtgtacttcttattgaaaaattgtctaaaatttcacatcctagacgtttcatatagatttcattttttttttattaaagaggattgttagtaacttttcacaatttttttaggatctaactaggtttagaccaatagagaaaacggagaagcttgtgctatttcttatattcattaatttgtgatttttttttattttttatttatttatttatttatttatttttgagacaaagtctcactctgtcgcccaggcggaagtgcagtggcacgatctcggctcactgcaacctctgcctcccaggttcaggcgattctcctgcttcagcctcccgagtaactgggaccacaggcatgtgccaccatgcctggctaattttttgtatttttagtaaagatagggtttcactatgttagacaggatggtcttgatctgctgacctggtgatttgcctgccttggcctcccaaagtgctgggattacaggcatgagccaccacgcccggcctgattacttttttaaagctgtttgccctaaactgtttgaaaaagatctatggaaatattttcttttattgaaataacactggtcttctcattttgcgagctacagatttcacttattaattcaaagttcagtagtcaatatttaatactttccatatgtcaggtatggtacttagtcatgtataaatatgtctttcataaatattagagcacatttaacagatgtatgtagttaatcagatattcaaagaaagaagaaataagtaaatatctcttttctgtttggaagtttgtagatatttaaatatttataacgttttgatgtttggcagatttagttcctttattttagtagcttgtttctatttgtggagagaagaaaaaaaaatagcctgtccacagtcactatgatgtggttgcagttattactgccctcctaggttagggctgatgtattgggggtcacagggagaggatagggctttgtgccatgagattcatgaggtcagtgaccacgtctgttaactgtttactcttctgtcatcttctggcacaattcctgagacataatagttcctcaggtatttgtttatcagccaatcgaatgaatgaacatatctataatctaaggaaaggagataggcaaaatagcagtataattttgaaatttattgtatcaattttgactgaaatatatgtataatatatattacatatatatacagccaatttgtgggactagaataaaaagttgctacacacacacgcgcacacgcacagatcaaaacacttgctgtatgtaattatctatgcagactatccagtagagggcagggttttacttgtgggagaatttaatacaactttctttttttaccatcatgtaaatgcttacctcccttataatcatcattatcatcataataagtaatgtatgtttatttttctttaattgttatagaagatttgaccaatggctcttgcttttcttgaagttaagaaatgatgtacatcttaaataacttttccctacttgcatcccagtttgcattgtacaggttataaggtcatggtgatattttagattatgcattccatctcaaacagtagttgagtcgcttatgttcttaaatgacatttttaggttccctttttgtgtttccaaagcagcattagacataggtctggagtgttgacagttgtgaagaagtacagtgcaataatgcttcatcagataaataagcaatattgtaaagcttgtcagcagagcactgcagcagccactcatgtcagttttaaaagacaaagatggatacccaaaggagacgtgtcagcttgttaagacacttaaggtttcatgtctttaggtttaacatggttgaataggcacttctgtttgtccttcccactaattacagtgaaaaacaggggaccttgtatgtaaaacaaacataagactctgaaaggtagaagaccactgaccagcagggactatgggaccctaggagagtacatggcaccaaagtggtatcagtaaagacctagtggggagctggaactctcaccccaacccagcactatcgagatacctctctcactttccactttgggtactaaaggctgactggggaacatgaatttttaccctcaattgctggtaatgaagtagctatcccattcccctgctggcacagtatcacagaaggcctgctctggctgaagatttaaataagatctaaagatttataataccccaaatatccaaatttcaacaaaatgtccctcatgaccagaaaagaatcaggaaaatctcaactgaaatgaaaaatgaacatcaatagacaccaggagaatacagatgtgaattgtctgacaattattttaaagtagccatcacaagaaggctgagcaattataaacatacttgaaacaaatgaaaaaaacagaaagtcccagcaaagaaaaagaaactatccagagaaaccaaatggaaattttagaactgaaaaatataataactgaatttttaaaatggaatagacaggtttaatggagaatggggatgatagaggaaagaatcagtgaacttggaagaaattaagagaaattactcagtctgaacagcagtgagaaaatagatgaaaaaacaaaacccagagtttagatataacatttgtgtctttgtgtggtcagaaagggaggggaaagagggtgggactgaaaaaatattcaaagaaataatggctgagaacttccaaaatttgacaaaagtcataaatctacagattcaagaagctgaccaaaacttaagtaggataaacccaaagaaattcataccaagacatactataattacatttcttaaaaccaaaggcaaagaaaaaatcttgaaagcagcaagagagaaatgacacaatgcctatacagaaaaacagtttgaatgacaacggatctctcagcagcaaacatggagaccagaaagaagtgacacaaaattttgaggactaaggaaagaattgtcaacccagaattccatatccagttaagatattcttcagaaaggaagaggaaaccacagtgttctcaggtgaaggaaaacagaacttgacatcagtggacctaacataaagtaatgtctaaagaaatttcctgaaacagaaaagaaattataaaaaaaaggaatcatggaacatcaggaaagaagaaagaacaacaaagagtaaaaatatagtaaatataatagactttttaaaaacttttttgagtgttgtaaattatgtttgacttttttcactgttttcaaatattgtaaaatagtatagttatcaatgtatgtagaggaaatattgaagattataaatggagaagggtaaaggaatttaaaggaaggtaaagtctacactttactggaactggtgaaatgttgacaccagtaaatgttggtaagttatatgtaatgcagtccttcagcagctactttaaaaaaaatctattcaaagagatgcagtcagaaacattttagataaacaaaaatggaattttaaactatgttcaagtaacccataaggaggaagggaaaagaaaacagataaaagaaataaaatgaaataacagatttaagtttcaacatatcaaagactacattaaacataaatgacctaaattcatctgttaaaagacagatgtgcagagtgaattttaaaaatgacacactgtgctgtttataggaagtgatttcagacaacaatatagataggttgagactaaagatagctttatttataatagtacaaaactgaaaacaaccaaagtgcctctcagtaggtgaaattgctaaacaaaccatggaatattatataatattatattcataccatggaattctacttagtaatgaggaggagtgaactattgatacttgcaataacttgaatgccttttaagggcattaagccatgtaaaaaatgtcaatttcaaaagacttgtatgtttccatgtaggtaacatggcaaaatttttcagctgaaaaacaaattagtgggtgttaggtgttaggaatagcgagaggaaggaagctgagtgtgactataaatgggtagcatgagatctttattgcagtggaatggttctgcatcttgattttggtggcgattacagaaatgtatgtgtgataaaatggcatagaatgatacacattgtacaggtattcctggtttttagtatgttatagtaatgtgaaatgtaaccattgagagaaactgggtgagaggtatactgtacctctgtagtatttttgtaacatcctgtaaatctataattatttcagaatacatagttttaaaaagcaaaaaggcctgtatagtcctagctgctcaggaggctgaggcaggaagagattttttgagcccaggagttcaaggttacagtgagctatggtcatgccacagcactccagcctgggcaacagagcaagaccctgtttctattaaaaaaaaaaaaagataaattataaacaggaagagtttgaatattttaaacaaatgcattaatatattttatatattttcaggtatagagaagccagtatctttagtgcatacctctaaaatagtagaatgtcatctatgaatatatgattttttaaaaatttagtttttttatttttaacagagttaaagaggcagattataaagaggcagtcatttgactactctaaagtctttttaaaacaagtcccactttagaagattaggatttagctcttattctcactttctccactaccataaatgcaaacctcatttctacctctgcattttctcactatagttttcatattcatttcaattacatcagtagtcttttttcagttggatagtataaacactattcatatatgggctgtgattgcttttcctctcttaaacaactctttttctccagaattaataattgtcttttgtttaattttctgtatgcttatgactaattgaatttccaactctctgaattacaaatatccttctgttcattctgaatgtgtttactcattatcttaattttaaaagagaagtaaacataggttgggttttagagttttggtgtaaagaaaattcttagtgttagaattttctggcaaaatcagggcaaatattctttgttactttttctatttacacacataccctgtccggctgcagataaacaaatggttttacctttatttcagcttagttcctgatttttgtcaagagtctgtttcttcatcgattccaaacattggtcacatagggaagtaggaagagctgtggcatagagaccagaacacttaggttcttgttctgatttggttttaattgacctcaatgtaggatgatcaggtaacctccttggcctcagttttctctgtaatagtgacaagctcagactagattataactgaggcctcttctagttaaaatgtgatttcaagtagataaagtatttacttcagtcctgactgtatatgtagtatctctaaattaagagtgttgtcatttccagtacttttaaagaaataccctgatgtttagaaagacattagattaaaaggtgttatagagaggggaaattttataaaagacaaaaatggaccatgcatggcatctttgttgtgcttcaaatttttatatgggaattgtggttttcactttccaagggtgtctggaaaagagaaattctaagaccatcagaaacctcattgtttattacccaacagattagatttgacccatagagtatgctctgaagtaattaatgtggcttttatggagatttcttcaattgtagaccattgaaactagatgggtccttgggggcttctaagaaagtccttggtgtctagcagtttctagttgatataaccaagggcagaatgtactgttttccatttgcaagtgtttttactttattgtgaatgttgtgtgagggatatttgatatttgggatacttacatttttttcagagggcattaaggtgaattgccttaatgccaaatatacatttggaaatgaatttgtaagtttatttgtatacacctgttgatgcatttgtacatgtgtttggtgatgctgatagggtgccactttatggggttccatgaaaagcagatatgtaatttaatttcataacaaacatattcattggttattatatttactggttattgttattcacataacttattttattggttttcaggtacttgaagaaacagaagctcaacatttatatcagtccatcttgcctgatatggtgaaaattgcactctgtctgccaaatatttgcacccaggttagtggatgtagcttcctcagtagcttccctgagactgacaattgaatttcccttaaacttgaatggccagggtcacagagagagagagagagacagagagacagagagagagagagagagagaggaagagaagagaagagaagaaatgggaaacagtttttgccaaagagtatagtaattttgctgtattaaggaaaaggttagagggtagagagtactacaaaaggacattaaaaatgcagcattccattcctcagcttctgtttacactgttgaagcttgtttactttgacttttttctctctttgtttaaataacctctaacttaaaaaagtattcattatttcaaaacatactagtggatttggaatagcgtattttcaaaatggcttaatacgacccactccttcctcaccctcccccaaattctacaacaaatgagttaatgatactttcttaactttttttgagacagagtcttgctctgtcacccaggctggagtgcagtggcataatcttggctcactgcatcctccacctcctggattcaagcaattctcctgcctcagccacccaagtagctgggattataggcatgtaccaccatacccggctaagtttctttttttggagtgcaatggcacaaatcccagctccctgcaacctctgcctcctgggttcaagcaattcttgtgcctcaacttcccaagtagctgggattacaggcgtgcgccaccacacctggctactttttgtacttttagtagagacgaggattcagcatgtttgccaggctcgtctcaaactcctgacctcagatgatgccttggcctcccaaagtgctgggattacaggtgtgagccactgtgccagccttaacttttaaaaataaagaatcctgtattttattttgtttggagtacattaattatatattgctacataacaaattatgtcaaaattaatggcttaaaacaataaacatgtattatctcacagcttctgttgactttgggagcagattagctgactgagtggttgtggatcaggatttctctcgtggttgcggtgaggatgtcagccagggtttcagtcatctgaaggcttgcctggggctgaaggacacacctctaagttggcttacttacagagctgttggcagaacgccctgacatgggtctctctataggctgattgattgtccttatgacataatagctaacttccccagagcaagcaatccaagggagagagcaaggaagctgcagtgtcttctatgacctatttttctcaaggtacctagcatcacttctgctgtttttctgttcattggaagctagccagtacccagggggaggggtattagaccacctgttttttttttttttttttttttttgagactgaatttcatccttgtcccccaggctggaatgcagtggcatgatcttggctcactgcaacctctgcctcctgggttcaagtgattttcctgcctcagcctcctgagtagccgagactacaggcatgtgccactacactcggctaatttttttgtatttttagcagagacggagtttcaccattttggccaggctggtctcgaactcctgacctcatgtgatccgcccgcctttgcctcccatggtgctgaaattacaggcatgagccaccgtgcccaagactccacctcttaaagagaggagcatcaaagaatttgtgaacgtattttcaaacctccacagggtttgttttgttcataattttattcctgtgtttctcacaaccgtgcttgaatttgcctttgtcttttatttctagggccaacgcctcttgctgcatggctgctagccagggttctgctagcattttactccacaggggccctatggacatttgggtggaacaatttctgaatgtgtataatggtcccatgcattgcaatatgtcattaggacaccccaaaaaccacaaatagggtcactggggcaaccagaaaacaacccatacatgtccaaatgccttcctggactatgccaccttcagttgagacccatgaaatgttttccagtgtgatgttttcaattttatgtaactttaatttcacctcagtaatgcattgtgcctgaaataagttttactattgggcaggggaaatatattttaaaacatatcttcttgtttctgttggaagttatttgcttgatcatattccatgtttgttctttttcctttctctccttacttagtaaattctctccctacttcctaggtatgcctgtctgttacttcccctgtgaagccttccctgcctcccaggcaaggttcatccctcttgaagcactcaaatcattgttttgtaattcttgtcattatatatctcttgccactggattatagtctccttaaagggagatcctctttgtgtccctggtttgcatggtgcttaattatatgctttttgaattcaatatgtagttcataatcaataataggtagtaggtagcctttgggtgtgggccatttaatcctcttcccctcgtgcatatgagagtttccatattttatttaatgagaaatttttgttcaaaggtatctgactttgtaagctataacaagtcccttggaaccaaaatcagacccctgagtcctcagctttttgtcctggcttctctcagtgactttcttctccattagcatatcaacgggtaggcatggaaattctgtgctttgccccctattgaaaagtcaatctctgctgtgaaagttaagatttttatttgagatcaaaatacgtcttgtggcaagttaaattgtatatgttggtgtttaataatttatcacattgaagtactctaggccaaatctaaagggtaaattttagatttatcaaaataaaattaaaggaaacaaatttggtcaggaactttttgaaatatcttggttcacagtaaccagcctcttattttgttgagccgattgcttgacagtaagatttacatctcctgatttctccaaataatgagtttttaggcatttctcctcaccaagagaggagaaatcattaactctatttaaaattatactatttgtttatttgggagacaagaaatgtttgtgtttgaagtccattaagcctgaaatatttaccattaatttttaaaatcatttttctgaataacttggtaaatggtagttaaaaactcatttcttcctaaaaccaagcagcactttgcttgaagccattgatgcactgtcaccttttctaaactcgttgcttggttgtgaacaaatgcacaggatggaaaatggagatcaatatgagctctctatttttctcagaaatggtgattgctaagacctgaaggggagagaattttgtataacatagtgaaaatacattctttaccttttgcttatttgtttacctttgaatttttccaagagaaatagttgaattacaagtttaatctgttcttttttctggcaaactcttattctagcagtggtgtgtacttctgtacttagaaaagcattcattattcagcaccgcagttttggtttgtcttgcctgccctttcctcaggttcattctgggtgtccactcctgaggtatgatcaggacagtttgctctaggcatgccattttgagatgagtgcagttacccgaaactcttagttctgggtcttactgaaggggagaatgaaatgcatctctaaatattctgtgggagcattttgaaacttaacagcagaaggataaactggtagttggtctttgattttatcagcatgtctttaaaaacatagtttaacatttaaaatatgttaacaaaaagagtcaaactctgtaaaatatttgaagagatttattttgagccaaatgggagtaaccagtggcctgtaacacagccccaggagatctgagaacatgtgcccaagatggtcaggcttggctttatacattttagggagacataagacatcaatcaatacatgtaaggggggcttacaggtcttaggtagattcaaagattttctgattggcaattggttggaagagtcaaagacctggaatcaatagaaaggaatatctgggttaagataagggtttgtggagaccaaggttttatcatgtggatgaaaccttgtaacaggcttcagagcttttatcagatctaaaaaggtaccacaccctttcttaattctcacctggaaaggaatagagattctttacagaacgtacattttcccaacagacagctttgcagggctatttcaaaatatgtcaaagaaatatattttggggtaaaatacttcaattctttcaaggtatgctatctgtcatgtgatgctatactcgagtcaggctggagttgagtcttattattataaaaagatttgtttcatcagttttaaggtctctgttttcttgttaatgctggtcacttgtgctgaattctaaagtgaggagcatataatgaggcgtgtcagacccacacttcctatcatggtgtggactagtgtttcaggttaactttggaatccccttggtcgagaggaggggttcattcagttggttggggggcttggaactttatttttggtttacaaacagaataaaacccactgaacacaatactcaggtcgtgtggattatactgaaataaaaggtaagtgaatttggtggcataactagaagacattttagacataaaagatttgaaggaaaaatgtcttacatcttccatgacttggaatgtttggttatgtaagaaatgtcttatctttttacaacttatacatgtccgtatggtggtttttacatgttctattaatagctttaatgaagttagatttgattcttataaagaaattgtgagtatgaagtgtaatttggaataagagggagggttaagacttatttgttgaattatcttagatcattttattgaggactaagaaagattattctagccaataatttttaatataaataagaacaaaatttagcttaaacaatgttatatatttttgtttcatcttttgttctaatttttcattacatgggcaatgtgtttttatttacttgctgaagcaatcttgtttttcactaataagtaatgttttatattctcttcactatcattattattgattagaaatctgcagtttgtcaaataagtgcattttctgaatcatccctgataaacagcccttgacttttacaatattgctgatttaaggattcaagaatggcctgaaattatttctgccttaatttagcaaatgcaatttggtgcctctgcttttgaaattgctaaactaattattgctcttctcgtctgtatttttttgtttcttttatcagccaataccactcctgaaacagaagatgaatcattccatcacaatgtcgcaggaacagattgccagtcttttagctaatgctttcttctgcacatttccacgatgaaatgctcagatgaaatcggagtattctagttacccagacattaacttcaatcggtatgttttcagaaaacacctctttaacaatgaaaaagacaaaggtggaaggaactaataatatttcttgaatgaattccataggccaagcattttatatgcagttgtcttatttaatttttacagtacttaagtgacattttcaccattttgcaggcaaggtgattaaagttcattgaggttaaaagaacttgattaggatccaggagctagtaagtcacagaactgagattttatttcaggcctgtcttactccagggcccatgttctttctgtcctctcagatgattccccagttctctggactccacatgcctcttcagtttgattattcacgagaacttttgttgtgcttatattccttaatgctgaaatactgtgaaaggtagaggaaaagtcctcctttctacaaaggtcttataaaatgagagtctaaagtcatgagctgtcttatgagacttgaaaagtgtaattgttttgatgaaaagtgaaaggtgattttgaccctttatagacatggttaatttatcagtgtaatatttttaaaagaaaaacaaaagaatgttcaaactgctcgactaaattaatacagtgtgaaggtattgataaagttttagattccagccattttcccaggtgactactttctctatcttctacacaaacaaaaatattttaaagaatcttcttggcaaattaatgtttgttcttccctcctactcactactcccatatccccacctctgtttctttcttcacttgagaattatctttataggacccatgaatagaatatgtgagttttcttccctgatttcagtgtgagacttgagaaaattgctataatctgtgcccctttcccagcaggctgtgtgtaatgcccttcactgcctctggtcacccagagcctgcctctgagggtagggcagtatgcagagtaggagataaagtcatagagcggatacacaaacaaaacccacttttgtttgccatactgcttttgtctctgaagtagaatgatcagtagcatcactttttttttttttttttttttttaattttaagacggagcttcactctgttgcccaggctggagtgcagtggcgcaatcttggccaactgaaacctccacctcccgggttcaagcgattctcctttctcagcctcctgagtagctgggcttacaggtgcatgccaccacacctggctaatttttgtatttttagtagagacggggtttcaccatgttggccaggctggtgtcgaactcctgaccccaggtgatctgcctgcttctatctcccaaagtgctgggattacaggtgtgagccactgcacccagtctgattctaccagtttttctagtatcctttttctgttccaggatcctacccagcatcccagttacatttaattacctagtctcctccaacatgttccttgttttttcttttctttcgtgatcttgacagttttgaagagtactcatcacagttattttggagaatattctcagtctgggtttggctgatgttttttcaggattggaatgaggtcatgcatttttgggagaataccacagaaatgatcctgtgtccttctcagtgcaccatatcagtgggatcatgatacttcttattactggtgatcagttggcaaaggtagtgtctgctgactttttccactataaagttaccatatttccttttgtgattaataaatattttccaaaagataaaacactatgcaaatgttgttttgcctcacatttatccctactaattttggcatccattggtgcatcttgtctgcaatgattattaccatagtgtttgcctgttgtgaattttctgcttccctcttctacatttgctaattgaaattccattgtaaggaagagctatcccttttcccccgtttttaaaatatcagaatggactcatggatatttattttgttgtgtcagtttaaattaaacagtattatttattttactgctttaattattctagctttggccattagggctcctttaggttgactcctatgttcttttgataagccctatcctttttttgagcattaactttcattctggaatcatacattgttccagattcatcttacattttccatgcctcaatcctggaatgaaccattttctcaaggattcctggtctcttttattgtacaacggtatttagagaccaacatctaggtgataggtgtgctcattgctgctagagtgtcattgtttctaatgcaacttactttatgtgggcagcattccttataactccacatggcagcagagaaatgaattcacaattctctccaatatcagagtgtcagccccgaagaccatattttttagccttttaaaattggagaatgttttactctcttaagatgagaagaattctagaattcagctggttagttcctaatgtaaatttttaattaaacttaaaaactagacatttcggtgcatttattgtgtgtttagcagatgaaagtatagcagatgacttgaatataagctgctcttagactgtcataattcttgggttatatttttatgaccttcaaacattaaaatattgatgataatttgttattatatatggttaccctctactatcaacactaagaaaggggcagcaaagaatgaaaaataatgttatctaagaaaatttctttaaaatcctagtgttagcaaacaggatagtttttttttaatatataatatgctccttggttacataaatattagttgcaaggggcatatttttaatctatttttcaagtttgtacagtaggtaagtttgtttttagatactggtatttagtcaatgtttagttcaaatgtacaatgagcaactgcaatattccccacagtgtattaagtgccataaggttacagagaaaggagaagccagtttctgagttcttactgttatgtagtattgtctcattttcaaacctcacgtcacagatgcccttctcttttccacgtggcttttattcctcctccagtactcagttcacgtatcagtttttctggtgtctcagattctgctaggataggtttgctactccaggttcctatgctagcctgtgtgtacctctggagaggtgcacagcaccatgacgttttattaaagaaagatataatttaataaaggaaactttcctcaaggaaataacttttcttgctgttgttgttttgagactgggtctcattatgttgcccaggctggtctcaaattcctgggctcaagagatcctcccacctcagtctctaaagtaactaggactacaggtacatgtcaccatgcccagcgcaacttttgaattaagtacaaaagggtgaataagagttttgccaaggagaaggagaggtggttgcattctaggcaggggaaaagtatgtgtaaagtcactgttgcaagaaggacctgacatgtccagagactgagagaagacagtgtggttgcagcacagagagtgagaaggagcatggagatggtagaggctacagaagtagctggaggctggaccatgctgtgcctcactaggccatctgaaaacaacaggaagtcattggaggattagatatgtgggtagagggagactagcacatgtgttcagatttacattttcaaaagtttattttggctgtaatgtgggaatcaagcagagaggggccagagtacatgagtttacccaattggagaggctactgcaatgcaccgggaaagaggatggtagctgggatagtgtaggggaggggacagaggtgtggagacatttgaaggggtagccagagtgatggtgatggacaggattggtagatgggcagagagaggcatccaaggtactccttaggtttgtacagccagatgtgtgcctttactgtcccctacttttcctactgtactacctagactacttcataattgcttatttaatcatttcagtgggacagggatcttaactgtctttgttattttcacaaagtctcatgcattgtaggccttcaataaatgcttcttgaatgaatgaaaagaaattttacagatgaaatatttgagaattaagtgacttgttttgagtaatggagctggttagtggcagagtgctaagactataatttagaccctttgttctcagtctcttgtcttttacttttcatattatgtcttagtcttaggaattacgagatgttttatttttaagccacatataatcaaacatagcttttacttctgatttcgttagtaattggggtagaattgagagaaaacacagagcattggaatctgcaattgcagttatataaaaaacctgtttcacaggcatgagccactgcgcccagcccatatattacttttacgtgcagaagaaaaaatagttcagggaagaacaagtcagttgtcagaaatcaagctgaacacaaagttaataagagtggacaatttttgtaatttgattttgagggtggaatttcacagattttttgaggcttttccaaaaaagctagtgtggatagcttctttccaattactcctccatagacacattgtcattgtgtctacttcaccctattttacttattcagcatatagcattttatttcttatggaagaaatagaatccacagagttctgtagggagcaaagacccatcgctgctggatggctgacaggcagaggtcaagatgtcttgggaaggcttggctttggtgacttccaatttcctgtaaccaattaccagaatttacattcatatatatatcttttttgtttttgtttttgttttttttgggacagagtctcgctctgtcgcccaggctggagtgcagtggcgccatctcggctcactgcaagctccacctcccgggttcacaccattctcctgcctcagcctccctagtagctgggactacaggcacccaccaccacgcccggctaattttttgtgtttttattagagacaggatttcactgtgttagccaggatggcctcagtctcctgaactcgtgatccaccagccttggcctcccaaagtgctgggattacaggcatcagccaccgcacccggccaattttattatatattttaattttaaaagacctttgtttttcagccaaccttctgagtggggaagcctggggcttcttggcgatggcaggtttatctttttcattgtacatggtcatttatcctgaagactgagctggttagcgctgaaagtcagcatgttgggcttgatgggaatcaaggctgggccatttttttaaatgaagggaatattaattagaacaatgcaactgctttatgtaaatgaatgttgatttttttggcctgggcattatgtaatgccttattttagcgcaagtaccttagcttactcagcattatctgaaattcatttacttgtcacattaaccatatgaattagaatattgattaggaattgttgttacactcatttttaaaatgaggtggaagtttagagaggggaggttacttcaccaagttaacacagtaactagtagacttgagattcaaacgcaggatgtagtctcctttgagaagctgtgtcccttaaccattctgctacacagtctccctttgaatgaactgaattaataattcttacctcatgactagtcaaaaattagaactatttttagaaataattattgatctattaaatgaattaaagccatttttaagtccagagtgaccgtgacggatttaagcttgcagcaaatagcattctcaccaaataagagtttaagtagttccgttgaagatttgaaatcaggcatattcttgtcttcctaggtgatggatgttcttttggatagcagaacatgaaaaatgaattaaggcaggtaacctagtgttagtctccacaatgttgtagagaatcctaagcagccaggatgtctgcacttgcctttcactgtgagatggtgtgtgttttaatgagcctaagctagcaaataataggaacaacaactgtacatcaccattgatactgtcttttgatggcttgctttgattctgtctatggaattttctaggtagggaagcctctctactgataaggttcagggagaataaatgaattgttagcacaactggaacttgatcactgtcttctactcaaactcagtgttcttttattatatctcaaagcctgtcatgagcaaaatgctctgagtgctccggaaatgccaaacaactgaaagtccccccacttttatgtggcttctgaaagatccagtacgtaatctgatgagccatttgttaagctgattatgtagcattttattgtgttatttccttttatgcatagtttctacttatgattatagtttctagcagtggggagttgtgtgtgtgagagtgtatttaatctcaaaagagaggtatggctagctagttgaataagaaaaatggtaagagtatgtggtgggaggctgaagtcaataaattgaatatgtcttcccttttttatttattgctgtgttctttaagccctgcttagttatggtaaatacccctgacctttttccctgcttgcctttcaggtcctaaacattcatataaaggcttccaatgtgattagcatcgatgcttctgagtttgcatggaaactagatggtcagagataaattgtgggtctcagcagtggttagcccaggaggtttttacatctgcctcttccctgtattgaaaatgctgctggggccatatggcagagtgcctcacagaagagccaggaatgactttctggctgggttccggactatcacttgctcgtattttaaaatggaggttgtagtgctttgggtttgatttactgtatactaatgggattattacttaacttgaaatggcatagtgggtcatggtgggggtggggatggatatacctagaataaaattccagtaatgttatcagtattccattcagggaaagattttattcaactctgtttctccttataagtatgcaaagaaaaacaccagctaataagtgtctgacctttgactgatgtctgtctttgaaaataccaacagttttgtttagaacaaagtaagatttcctgactggctttttgtgtttgatttctttaataatctgtaattatctttcaattaaatgcccaaatgtcctccctacatgtagaggagttattgtggcctggtttgtgtgcacactgctgacttaaaatatgccttcaaatatacatacccaggacttgaaaaatctaaattaaaaaagaaaggtgttgggaagtttacaaaaaaagtgggggcgggggaatgatgcttaatgattatgagaaggcctcactttctctgagcctgtttgtgtatgtctttctctctgtgtgtctgtctctcatgctctctttctctaaccccatttctatcagcctttctcttctctctatcttccctgccccatctttcttctcccccttcacccgtttcttgggctccagcctcagtccttttgttttcctcctcattcccaaaagctgtccctcagattgtatatcactcctgggatgactttcattcatgctgtttgcctgtctatttatgttatttttacttgcttccatatcaggataattcattttatttgagtggctgtgcatacaactttaaaatttcacaacagccaagtctgagaattgtcacaaggattttaaacctgcttcatctcctctgactttatctccacttcttacccccgacacccaccacgacacttcccccacttccccctgctctatcaggaagatgggaaagtgtatttggttacacagtgatttgaagttaggattggagcagtgaataaacagagtacattgagattctgcttgatttgtacctttaagatttgtacctacaaaataaacagtggtgttcatttgtagtgggtgataataacagccataaaatcttccaggaaagtctgtctcgccaggataataaatctgcagtctcacgaggctcctaaagttaataatttgtcatcatggttgtgaagtatgtgaccttttatgtgattttatacagatgaccgcatatggaagctagggacacttttcctatgttttagagaattatttcttaagagcaacagccattttctcctcactatgcaatagttctattgaagaagaacttttatcctttaattgaattgtatagtacatcaattcatctctaggaaaaggtggtggctacttttgtattcatattgctttcctctagtgcatagtgagcctagaaagagattttgcagtggagccttaggtattcatttagtaaatcatatttattgatataggatgtttaattaaactgccatgtggcttcttcattttgacttaaataaactctattctagaagaagccatgctgaaacctgcaccctcaaagagcctttctttcagctggcaactggattataagagtatgtgtattaaatattttagaaagataggttctttaaataaaaattatcacacaggctgtcttaaactatttttaaaaagagatctgattttagatttggttaaaatactagcatacattagtattctttttaggaaataaatattcatataaattgtttttccagaaattgaccctgaatacagatttcagatcattgaaaacggaaccatttgaaatgtgcatttcctttccttttcctaatttatttcagtcgctcaataggattttctcatggaattaacttttccctctcagcgtagttacataagcttgctgttgtaatcatgaaaaataattacccatttcagcacttattaacatggactttacttgaagggtctctggttttaaagtcagagcacatgactagaggcagatgaagagtacctcatcattcatagccactgagtctctataatttttaaatgcctttggaaagctagatcttatgctcaaaagcatgcttttgtgttagaaatctttcagtgagctacttactcaggtcataatgcttttaaagccctgcttttctttcctcagaataaactgaattgtatgttaccaataacaatgccacatcatttcaaagaaaacggaattaagtaatccaagtccgggttgctgaaaactagatgacacagggtaggcactgttgtggttaccatgcaaaggatctctattagtcagcttgggctgccataataaaataccatagaactgggtggcttagacaacagaaatttattttctcatggttctggaggctagaagctgcagatcagggtgctgctgctttggttcctgatgagggctttcttcctggcttataggttggctggcatcttgtcctcacatggcagagggagagtactgtagtctcaccttgctttttaaaatgacaccagttctatcagattagagtcccacccctatgacctcatttaactgttactacctgctcacaggccctatctccaaatttagctatattagggattaaggattcaacatataaattttgagaggtcacaaacattcagtccataaaagaatctagttgtttaacaaggattgttgagccctgatatcttgttatacctgcctgtgtccctacccccattcccctccactctcatttcctcacaaacactcagataaggattttttttgataccgtttttgttacttatcaaactacgtagtaacattatgaattataaatgttattagccattgagaaagtagctgtgcactgactgactgaccccagttgactgggagggctggatggtgccttctctgtggtggaagataggttggagaaatgtggttggtagtaaatgatgtctgatttgagcagctttgaagaagtctggttctagttggtttcagttctttccagatgccatttgaatctaaaccaattttccagttcttatcattacagaattgtcttctggaagaattatttctttgtattacttggtagcaatatggatgtagttttgtgaatcattaaggcattttaacttatcttccattctcttttattttttatctcttttagattgtttgagggacgttcatcaaggaaaccggagaaacttaaaacgctcttctgctactttagaagagtcacagagaaaagtaaattcctttcattcttactgtaatttttcttgctgatgggaacagttcaagtcaagtgacatgtgaggaacattttgtgtttaacgtaaaccttcctgtcccaaccacattgaaacactagtaatgatgcgacaatataacctagattttatgcttatgttgtgtataagcataaacgtgtgctaaatgtaggggggcggggtttacatactctgaaatcggacccatattctctgaaatctgtaatatacatcaaaagattttcatgaataaaaaccagagaaagtatattgaccaggaaataaattttggatgctctttatttaaagaagtattcactagtttatttgcataagtcaactaatgcattgcttttctacccattcctctcttttgtgcccccctaagccctttgtggagttcttataaaactgttttgtactgagttttatatctccatcttcctctattgaaccttaacattcttgcttccccaaaaactgatagcagctaacacagtaatagtaaatgtccaaaaaatactggtaatgaccagctgataatagattggtattgccactcttatctcagaagctgaatgaccatggtcaagtttcttgacacctctaagcttcagttttatcacctatgaaataatataataacggccattaccttacagggtagttatagatattaaacaagaagatacatgcttaataaatgtaagctattatcaatgggtagcctttcctacaagtggatgtaaaccagaacacctcaaaagttcctttgtgctaagtaggtaaggtcaacctggtcaagtgaaatggctttttttcagttctgggtcataggattgtcttaaaatatgtctttgaatcattttaaggtcatttttctcatatccttcttttactcttgcattacaatgtgcttggcatcttcccccttgaatgtattgctattggacattgttaaatttttagaatgaaatcaattatcaggattttgatatttaagggaaaattacatgcttctctgatatggaattacctcatagcttattgaatttcagttttgtgccctgtactgaatgaaatattaaaatgcagaatcatttggacctatgagacacaaaatcaaattagaatttgtaatgacttgttaaaaagatgactacgtaaggcgaggcacggtggctcacgcctgtaatcccagcactttgggaggccaaggtgggtggatcacgaggtcaggagttccagaccagcgtggccaagatggtgaaaccccatttctactaaaaaatacaaaaattagccaggcgcggtggcgggagagtgtaatcccagctactcgggaggttgaggcacaagaatcacttgaacccaggaggtggaggttgcagtgagctgagattgtgccactgcactctagcctgggcgacagagcaagactctgtctaaaaaaataaataaatgactgctttttttggccattctaggtctaattagaattattactattgtttttttttgttttgtttttacagtactttgagttgccgttttaagtagaattattataactaagtagtacagagtttacttttttgtcctgggagtcaaatcatgtatgtcttctctaaaaactaacttggctttctaaattttaggatttcagatactttgaggaaaaagcttaaagtttgttttttcagctggaaatgtatatgccattataagtattgggaatttgaagaaataaattataactagacattttattttctgactttttcactgtacatgttaattaagttctttgtagaaatacagtacaacattgctcttggtcttcagtgtgtaaagctaatggtttgaagaggaaatactaaagagaataaaagaggttgcagtataatgagtggttgtgtagaagttctggagcctactcaatagacttcagaagcttatttaaggtaccatatttcatcgaatctgagatgtcatagatgactttttaaaaatgctcttatattatatacctctaagaaggaaaaaacactcaggacagggagtttagtaggagacatgacccacaaggctggtacacctaaggataaatgagaaattaacttgaccttccaggaaagggaccataaagaaacgtgcaagtctcaaccttgacactaaatagagaaaggaaaaaaacatttctctgagaatttgaaccacaagccctaagctttgagtgtgcagccttaccaccagtgtggtccacaaaggcctgccacaaaggattaattcagatggtatcaggctgatagtgttcccagacgacagcagaagcagatgcacatcttctctgggaaaattcacctctagtctacacctatggtaagatacctccattataaaagatgtattccagtttcagaaatgtaacatgtgaaaaaacatgccttttagaattgataaactagaattccatcaggaccaacttttcagtgttgttaaacatgtgtattttatatctgatgaagatcttgagactgaagtattttaaaaagccttctgaattaaattactttctatatagttttagataaagtgtcttatagatcaggtttttgaaaatttatgacctgtatatagtatatattgtgattttatgatgggaagtatttgattaatcaaagtatcctattctgagatgaaagttgccttgttacgaaaaaacgctaacagacgtgctctcaaggcatttttgttaatctaagaaaccatgttcttctgccttttcttgctttgccagcagtgtttatgaatttcttttagcatctcttagtatatattaaggacatttgatgttcttctctgctaagttaccgaatgacaagagagatgttttctattatattcatggaattgcttcactagtgtttgagttgtttgaccacttacttgtgagttttaaatatgttatccatttatcttaaagttaggtatctaaaagacgtaagacccatcttaacaaaaaaatttgttttctactgcaactgctccatatggtttttgagtggttcctgcttttgactgagaacaaggaaatgtggaattgtgcacaggaatgaaatgatggccaggctttcactgggttatacactgtcatcactaatagttcctgacatctctctctttccttaagagcttttttgtattcaagaaaacagaaacggcatggcctttttagtttgttctttgatttgaatcagacaaattacttctggccagctgatttatttgtttcttttgctactagcttgaaaaaataaataaataaatctgactagaaaaggatctcatcctctaaaattattgactacattaatagtacttcatttagatcctcccaaatttattgctccttgaaaaatatgtcatctttgttctgtaaactcttagaaccagtaatttctcctctggctacgactgctactaacaagtagagtgattgcccactatttaagcctgagacttagctgtactaactccagaggatgtgcaaatgatttcctttttaaatctgtgacatttcactttaccatatagtacataaatgtgtatttattctccagtctttgaatgtagggttaagtcctttctttgtaaaggagtctacaaatttgaattcaattttgtctttattgcattagctgtaccagttatacatcctttttttcaatgctctttttttttaaaaaaaaagtgtattcagcttcaaaaactttaccaaaaataccagcactcaaatcctactgttgtgctgttatttgtatagtttcgtttagtgaagtcttattattttatagaaggagtttctactgtaaggatattattttcaatcaatattctgttattttccaatgctaggctttgtatttcctggttagttttatagccaatgttagacctattcttttaccgagtgtgtgtgtgtgtgtgtgtgtgtaatcttttcaaaattgaaacttattttggttatgtttttcttttattgcttctgtagaacctactgggttggtgacatttacaagacagagtcttgaagattttccagaatgggaaaggtaacaacaataataaaaataatcctagaccccctagaaatagaaggactcttgcaccatgagaggattctattttatagcacctagaaagatggttttccaacctctatttatcctagtgccagggaatttcttctcataaatgatccattgatagctctcatgtttgaaaaggttatgccttttaaatcaaagtctataaccctttgatttctaccattttgtcttggttttgtcttctgaaacaaagtcctgtttaaaattgagaagtgttgtatgtgaagacactaataaaaggaacaccaatatttaaatgtttctccttaccctttttttttggttagtgtttgaactttatggcttttctttctggaggacaagattgagaaaagtctttttattatttacattttagtaaacagtaaccatctagagttcgtcgagtggcaagaattttgaagtttggctgcccttgtgtactactggtagattttgtggaagttgctatttactgtttgtttcttatttatcagaaaatattgaggagatagcagccaatatgagctaattcagatttgtaaagtccttagtgtcctgaaatagttaacatatttcttaatctaaagcaagtctcccaatatacttaaagaagggtcctgaaatagttaacatatttcttaatctaaagcaagtcccccaggacacttaaagaagtgtagattaactttttaaatatgtttgaggacatgatgaagcatactaaatacatatttaaccaatgcctcccattttcactttctaataattttatgatagtttgtaattgttttgtttggaattagtgatgaatggaaatcacttaaaaaaacgttaacttgagaagtcatatctgcttaggtggctttcctgcagtgttttcatccatcaaagatgtttatttgtgaagtgaaagataaagaaatttacttcagaagactgagtgcgtggtttagatgattattaatagagggaagtagataaaaggttaagcgacctgaagagagaaaaaaaaatgagccagaaaaagatgagaacatgtacagcattttggcatcatggcatgttagatctgaaaggaaccccagccgcctgctaaaactcttgatcagctctgtaatacctgcaacagacagaagactggatagcttcagtgatggcagatccgctgtttcgtatcagtttgttccattggtggctgcttgtgttatcatctcatgctttcattcactaaaaatgttttctacattcattctccaccattcctggttcttccttctggagctacataaataaatctgaatttctagttttctttaacatttgaccctccttcatgtatcttaatggcttcttaacctacttccctctctaacagtgcatacaagttcatactaaactgattcgtttcttctatttcacatgtaatatggattctaaaccctttatctctgctcttaacatactcccattcattgggccctcttaaaatatagtacctggaattaaaagtaccattctgctgtgtcatctctatggtgcagaggattgtttttcttcactcttctattaatctctaataggaatgcatatgttttgttcctgttactttggtgtagattttatagatcaatctgagggcttatttttaagtcatccaggatctctactttgcatctgatattcatttggcactaatgtgaaagaacacccatttgtataccaccatgtgggagagaagggacaggtcaaaatgcagagactggcaaggctgctgtgtcaatgagacacagtaactttgcctctaagtgagacgaagattgtccccttaattttgataggcagaatttgacttatttttatttcattgatctcttttttgttttagttgctttataagtgagttggagaatataattaaaaccagtctcccagactccacagaaccagaaacatgcattcacttaaagagggagaatgaagaaaagataaggattgttggtgttcccaagcgtaaggggctaaatgggtccaggaacttagaggctttcctgaattccatgtttctggcatgttatagttaaccctttgattatcagcaaatactttagccaggcttaatcacagagagccagaatcacctacgtctctgactcctggggcgggggtgtagaggatgacctactgggaagttagaaaatgcttcaaaacaaaaccaagaaaaagtttctagcaatttcgtgattttattaagagctatactataaagtttctagcttcagtcatggagaatagttgacaacagatggaattcccattctgaagtcctgactgacagcccagagatttttagattatgcttctttatctttttagtagtatgcttacaggggtcttcctctgaataaaatggctaggaaagtaggaccaaaaaaaggaagttaaaaaaatatatcaaacttaccgtactgttttctacaagagactgggaaagtaatttttctaaaagtgtagcatactgattcagagcttgagtgagtctacctagtttcacatctctgctgctttatttcactagtcttggttagcttacttagatgttctgtgctttgtttccccgtctataaaaggagatagtaatagggttgttgagaggattcaatgagttaatacaaataaggctcttagacagaacctgtgcagaattaccttctgagttaaagctatcagcctgttgggctggagttttgccagaaatgtatttaaactcattgaaaccaggaaggaatcaaacaattctcagtacttttccagctaacctcctagactattttctaaaaatataatcatctcctccctcccaaaaaagattatgggcactcttatgtgagttagaactttggatctcctctgtttcattcatttatattttttattcagtaagtgatcaggggaaaaatatctaataaggcaaataatgttaacaaatacttttaatacaatggaatttgttgttaatataacataagtcaagtaaatacctcagtggccatggttgaaagggaaagaaaataattatgccttctaaattacaggtactaagtttatctgttaaccttattaatagaaaaataccattgttcagaatttctgtggcaggtattttcatcaagacacacacacacacacacacacacacacacacacacacacacacggttatgaaacagtgaaaatagaaaatggaagccagaagagaatcatatatgatttattgccaaatttttctacatttttcctcagattgccaactctagccataacaaaatttcatagatcttaattttttttaatattttgtaatgtttttcaactgttttaaagaagaaaaactttcatattatttagaggaaaatcaggtttcaaactatgttatccaattttaatttaaatatgtatatttacatgtttgaataaaggaggatcaataccaagaatgttaacagtaggcatctgtttctgactttcgagatttggggtggtttcggtttttgaatagttacctatattttcacttttgtccgcagtgaacaacttgtcattaaaataataaataagggaatgtctttttatattgtagatgtgaaaaacccttgacacgattgcatgtcacttacgaaggtaccatagaagaaaatggccgaggcatgctacaggtaggtgaatcttagtagtgtctgtgtatggttaggactttttcttgtcaagcttctgacagcaaaagaaatttgaaaaactgtttatttgtctcctaaactgatttaatgcaaagaagcatgatagcagaatgaagaaaaacaccaaacagatcactttgacagccttggtaatgttgtgatttgccagtgtatactctctgtttcttatatgtgcttctctaaaaagcctttgacagaaaatcccaagatctggacagcatcagcctcttggttcagacattgatagtaggttgacagtggaggaagttcccagggtatagtcttgacagactgtcaccaggcatttttattctttttccttaaaggctcttcttgctctgccccagttgatgaccagatggagatgtttttctgccaccaacagctttgtttaggttgagggggcagacatctaaaactgattgataagaaaggcctctctctcatatgtaacagtttcacgcacgtgagctagctgtttgctatgtcttttccctgttaaaagcaggtaattctggtccacttctcaatctttgttaataatctgttaccgcctttacctttaaaaagtatttttggagaagggggttaacaaaagccccgtgtttaaaatatagtaatatctaacctaatcttttgatttataatgcttctttaaaattcactaatgttagtgttttgtgttcttatcccatttataagagcattgtaaactgagttttctttgaaagaagcttgtataccatctcatttatactgataatagtttatttttcttcttagattcttatttggtgcttatattggttcagaatctaaagaaagcagttgcctgaaaatggactgatttgtttgaataacttaatgctcactataaaatttacgtctagttattatttaaatgaaactgagattcttttttaaatggccttttatttggacatatttgtaattaaaatcttcaaagagacaaactatgttttattctaaatcaccttctcccagtggttatttgagcttataaacaaaaacaaaacatatttaaatttgcatttactcctataccttttttctgtttaaaaaataatcttaaaatatgcttaaatattggttcaaattagtatcactttttcccccacattcccctcttgatgaagttctttccatctttaaagtcttggataaactgagagattcttaatacacatgaactaaacaaagttactgctagttagcaccacaggaatgctgacctttcattacaatacaattcaacaaggaattatttaacaacagttaaggttgagatcctccccacttccttggaatatattatagatggaaatgtgagacctcggtagattagagaataccgtaagggcttcttgctattaattgttctccctacccatgccatgtctccgcaggagatcggggaatattgtattgcaatgctacagagctccttgtgtagcatataaattacatgatgctgaatggccacaacaacaaaacctctctgaggagctttatcattcctgtcttttcatcaagttataattcagaagctgagtaatctgaatgagtagctttaaagtgacttggaaaataactggctaaaaataaggatgcattcacattcttgttttcatgtactggaacaggtctctcaactgttgtagagggtctttattgttaagaacttttttaagtagtaaaactttggttttctaaaagactctggcatttagaggcatactgagtttagtgtctttatttctgtgcacacctttcaagttaaaaatgtgggccttttattcaaagagtaaacaataacatacacattgaatgtatttcatcatcattatcaagtagtacataagttggatagagcttatctttttatttttgttatgtaccttattccagtaaaaattaagttaggccaatcttaaacctcgtctgtttctcatttgtagtcacaatatcattatacttttaggcactcagccagtctcttagttctcaagtacagtccattttatttctttaccgagtttcttctctttcctttactttaccactttcctgtttgaggccctagtagtgcctgtataaactatttagtactcacctaaccagcatttttacttttagttttacagttttccatttattctttaaactctagcctgaattatcttcctaaaacataggtccaggtgttacttgaatctttcccagaaccttcagagggaaattgagtaaaaattccctagacctcagaccacctcatcaccaactgtaagcctccacctactctacactgcaggcaagcacaatgaatctgtttaccattcccctcatacagtgatttacatttgtttttttttttgccctgtgtccttgtgcagctatgccctcagcctgcatgtcagctgccacatccccttgtaaagctttcctatcttcctcccatgctccaattttagttaattgtattattagaaagtatcaaatacatagtaacaagctcttcaataatcatcttctcattctgcttatgctcattctgactgccatctaaattgcaaatgccgtgaggccaggaaccatacatatcttattcatctttgtatccagtgattcccagcacaatactcagtaaatagttgttgaattggacagtttaagccatgaatcacccagtgcccatagacctcatatgtagtaggtagctaattctaatcaacagactggtttcaccaaaattattttcctatttaagctaaagagttactctggttttttagcattggttttagtactccagaacacaaatccaaatatatgattctctctggtagctcaattgaagaactcctcagtggtatgttttagtattttctaagttctcctgtggtaaaagaagactgcttcgccttctattaatttctgtcttttgacatatatttttacatatcaaacgattcatactattgttttactattttgtaaaataggcttcagattgtcatttagtatcagttgctttagagaacactgaagttttaagaaatcgtatattttaaaatagtttgaaagaatataagcctcatggtatttagtaaatcctattttacttgtgtgtatgactatgtatatacacaagttgtgtgtgtgtgtgtgtgtgtgtgtgtgtgtgtgtgtgatctaactcctcagatagtctcactaaggaaaagatggttgctatttcttacatactgcttcatgaggctggcatagtgctggacacactggacaaacggaaataatgccagcaagttgagtttgctttctctggaggattgtgtaattcttctttattagtaggcatttggggatcccatcatactactccacataaagcttaagagtttccaacctaattggaaatattactttaattgaatctttgttgctatactgggttttctttcttccttttttccttagttatatttttaaaaagtagtttgtaatgttcatgtagtttggggtttggggttgaatttagaaggacaaaaattcgatctctttattcttacaataaagttggaaaaggttacccaaaaagttgattactaaacttttcagttctttagggcaagtgtttggttaccatattacataagaaaagtttaattatattaaagtcacgtgaaatacataaagggaagttgagtagtgaatgggggagaatgactttgaaaccttcccagataaagacctcccttgatttgtggcccatgagacacaaataggtttataaacaagagtctgtatgattcataatattttgcctaaaagctccattttccagattgcttctctggttctgggatccagaaaaatgtgcagagatgttaactgcagtgaggtggaaagagcttaagcaaccaaaatctgcccttcctgggaagattacttatttggggattgattttcatgggagaggaaaagatgagagcttagagactatgtgcttcttgatcatatgtgtaggtatttttgaccattatttaatgtcacatttccccaacaggtggattttgcaaatcattttgttggaggtggtgtaaccagtgcaggacttgtgcaagaagaaatccgctttttaatcaatcctgagttgattatttcacggctcttcactgaggtgctggatcacaatgaatgtctaattatcacaggttagttttgggaagcctggaaaatggggtagtcttccccatctgtgaatatctgtcatgaagactagagactacccagtatagcttttatcttccatgggcatcagtcccaatatttttatccattaatttatacttagtttttgaaattattacagccttattttcctaatcttaagtaagacatcttatttttaccttttctttctttcgtggcatctttatctgaggaagagggattaaaaactattcagttaccccacagtttgaattttttttttttttgagacagagttttgctgttgttgcccaggctggagtgcaatggtgcaatctcggctcaccaaaacctcctcctcccaggttcaagcgattctcctgcctcagcctcccgagtagctgggattacaggcatgcgtcaccacacccggctaattttgtatttttagtagagacagggtttctccatattggtcaggctggtctcgaactcctgacctcaggtgatccgcccgcctcggcctcccaaagtgctgggattacaggtgtgagccaccacgcttggcagtttgaaattttatgacataataatgctcttaagaagaacatagtgatatgcctctagtatgtattctgttgtaattcttccatttgagagtgatttgtttctattaaaaataattttcaagtggtttcttgtactttagtatgaagacattgtgtaaatataagaagcacaggaacagtatttagagaaatcagtaaccttttgtttaccctattttgaatcctaaaagaaaaagttcagttatcatggccaggcgcgatagttcatgcctgtaatcctagcgctttgggaggccaaggcagacagatggcctgaggtgaggagttcaagaccagcctggccaacatgacgaaaccccgtctctactaaaaatacaaaaattagccaggcacggtggcgggtgcctgtaatcccagctactcaggaggctgaggcaggataatcacttgaacccgggaggcagaggttgcagtgagctgagatcgcgccactgtactgcagcctgggcgacagagcaagactccatctcaaaaaaaaaaaagtctgattatcttggtgtttcttcttgttcttcttgatttctttacgctaatatgggaggaggaggggggaaatttagtcacgtgtatgctttaggtctgttatagagatttaatttttttttgtttcttcagactgagatcactatgtaacagtattttctttgaataagctatcaagaaaaatgatgattacctcatatctcttaagaaactcttaatcaggcaccatatgtaagttgagtcttttattcaagtacgtaaaagaatattcccacataagtgccgttaatgcaccatgagttgctggtactatttttttttcctgaaaaagtggattttttatttccacttagaatctgttactgcttggagatgagtttcggggtctaaacactcacctgggttgtagaatttagtttattgttattcccaaaaattataataggagaaaaaccttccccatgagttatataaaatgtgtacccaaccgcattacctccaaagacatgcatgacaaaaccgactccaaagtctaatcttgaagccacactgtgcctcagatagatttgtagacaaccttcagaagagtatattttcttatgttttgcttttaagattctctttgactttcaatggtttgaatatggtgtgtctacatgcagatctctttgactttatcctacttgaagttttttgaacctctctaatgtttgttatatttggtaaatgttgggccattatttcttcaaatgtttgttcttcccctttcctcatcttctgggactcccaaattacgtgtttgttgattcacttgatgttccacaggtctcagaagctctgtttatttttcttcattctttattcttcttgttcctgaggctcagtctcaattgccctgtcttcaagttcactggttgttttttctgcttgctctaaactgcttttaatctcactggtgaattttttatttcagttattgtacttttcaattacaaatttctgtttattttttataatttctatccctttatttattaatattctctatttgagaggcatcattcttatactttagttttttagacatagttttctttagttgtttcagtatattttaaatagctgatgtaaattctttgtctactaagtccaacatctgggctcctcaggggcagttactactgactgctttttttttgagtatgggccatactttctcatttctttccatgtcttctaattttcatttaaaactggacatttaaaataatgtaatgtgaccctggaaatcagattttctcttttcatcacagttcatccttcttgctgttttttcaatgacttttctaaactaattttgtgatgtctgtgttctttctgtgtgtggccagtgaagtccctgcttgttagattagtagtcagctaatgcttgaacagatttccttagatgcctgaaactaataagtctcaacgaagtctaatagtctttgttgaagggctgtatgtgcaggtgcagcctaccttcaacactgcactaagcagttgatgcctctgccttagccttcacttcctgtcaaggtcaggcagaggagagagctgagggctttctctagtttttcctgagcattcatatggccatgggcacgcatgagccctctagattccttcttgttttaatatattagaacttttcaaagccctttgtggacattctcattcttcagtttttcctttgaagcttttggttagcctattgtttgccccagctgtttgccaccacctcaagaagtttcagtgttaaacaatccctgtaattgttttcatcaaaccctcaaaagaattatgcttttcctactggccaagctccaagtcctgtaaagtaaagacagccttctgagcggggccctccaggggaccaccagacaggtcaaataatgacagttctctgagaattgggctttgaaggagcttcagctttcttttgccccctctgatggcttctgattttcactgtgattcaggaaggttagtttttaaggccgagatggagcttgggagagtgggatgggaataaggcaaataaaacactgcaaagtttattgtttttaccaagattcagctggtttttcttgaataagcactccctggattgctgcaagcctttggctacttttcagttgattctcacagtgctcatcacagtgttcacattgctttcatggaggagagagttttcagaggtttttactgcaccattttttactgatatctttttatcttttgtaagcacccgtggataaaggagctttcaatgagttattctacatcatttagacatcctatgtaaatttttatccctgtgattctgcttttttggtgaagtaaggcaaaaaataaaaaattgtaaattgtctgagtttatgtaggaaattaagattggaacttccgcaaaggaatttttttcctggacagagcctcagtcagccatttgaagttagtgacttggagtactgcattcagaattctgagattatgatccaaattatactgaaatggaaagataaactccttttgtactcaacacttcctcaactcacattttggccatctgtctgcatttgttagttatcatggatgcacgtgggaggtatataattgggcaaggtactaggggagataagattgcaaggaattacagaacaaaaaaaactggcataaatctattgttgagcaaccagcactttggctattggtctcatactattgtagggaagctctgcaggtttggaatatggctgtcttcatcatttacgtacatcaaataatactttaaaagattgttattccggctgggtgcagtggctcacgcctgtaatcccagcactttgggaggctgaggcgggcggatcatgaggtcaggagattgagaccatcctggctaacgtggtgaaaccccgtctctactaaaaatacaaaaaaaaattagctgggcctggtggcaggtgcctgtagtcccagctacttgggaggctgaggcaggagaatggcgtgaacccaggaggcggagcttgcagtgagccgagatcgcaccactgtgctccagcctgggcaacagagcgagactgtctcaaaaaaaaaaaaaatttttttttttagctcttaaggtagatttggattgaacactgagaacaaaatatcccatcagtttttaagatgaatttacattcttgaaataaaaaacttggtaaaatgcatttaaacttaaagctaacttgtttcatttgcttaatttctctagaaagtagtaagaactgggctgggcgaggtggctcacccctgtaatcccagcactttgggaggccgaggcagggggcatcacaaggtcaggagattgagaccatcctggctaacacggtgaaaccccatctctactaaaaatccaaaaaattagccaggcatggtggtgtgtgcccgtagtcccagctactcaggaggctgaggtgggagaatcttttgaacgtgggaggcagaggttacagtgagccgggattgtgccactgcactccagcctgagtgacagagtgagactccgtctcaaaaaaaagaaaagaagaagaagaagaagaagaaagtagtcagtacattgtcatcctccattaatgttaatgtaaataaaggatgtcattttccttgggaataaaacaggaatgttaaaaggaaaacataagaatattttctttttttaaagataatttgtccccagtctaaaaaaggattctaatctccttttacgtaatctctaaacgttcctgcagctattgtaaaatgaatggaaaattgcagatccatgactcaccttcagatctgtaattacctcaggctaaggacatatggggtgacttttaactcagcattttccccccacatccacttaactttattatagtgcctcctaattaatatctgtgatgtgatgttaccttaatggaaatggccatttcatcatctatttgatgtctggatttctgccatctccctccttaggagactcttagccatgcactgcaatctatctgcctgatcaattctgttccttcaatgatgcatccagctcagtgagctaatggctgtgactgtgctgcctgaatctgtagaagagtttgagaaattggaaataaattaaatttatcatcattgtgggacatctggttggtatcattattttaaaagaatatgaaacaggtcatgcaaacaggcaaatacttttatacagacagtgttatccctctgtttgttgtgatcctgcctggggcagccatgagttaaaaacctttcagtaagtatagatagagggaaagagttaaaattccaatcttcccatttcttcttttttttttgtcttctcttacttgtttctgtacaacatccagaaaatagtttcaatactaaagggtgttaagttttctgagagttgtttttctgcttctgtttggtgagcacataaaccaggtgcctagacatgaaacctactgggcagagtattcctgtatttaacgtaaaacctgcctctagtgaatcagattatcccagacatcacaaatctttacatcttttccaaatgtcagcagagctgatagaaatgataacaagtagacaccattgcttatagtactggtgacatcttctagagttaaagtactagaggtgcctgtcaagacaccagctcattgggaaaggtccaaattcagttggagttttccaaaaatgtttggaaattaaacgtttttatgcttgtcttttctaagtttttaataatcattagaattaaaagcaagagttttctatttactgcataatcactactgtttgagtgatgctaataaaatttgggtaaaatggtgtttatataaacctgctttccaagggaacaatccattggtaagtagaattttttttaatctccgaatgttttttcccatgatcgttacaaactcttattcctaataagggaaaataaccatgtttcttactactaaatctaaaaaatcatgaagaggtcatgaattcctcataagattttaatggattccttctagttttttccttaagtgaaggtctttgactatgaagtcttaaaggcccatccctagtgagagctatcacaaaggtcattcagtcttctgtctcagtagctgttaccagtttacctttatattttcatcatagttcattaatttaaattttaaacaagttaagggcattcacttttttcgaaggagacagttggcatgttaaaaggtgtctacttagaaaacccagggtttaacttgtttagtacaaaagtgtttgtatgtgtattttttatttcccatgaaggagggaaggaagtaaatctaaccttgttcctctcagagaagaacactgaaactatattaacatgaagtagaaacatgataattgatatgttatatttttcagccactttcttttaaaaagacagaacaagtatttgttttccgagttaacagatcagaataggcagtttgtctttttatgaacaggaaaaacgaggcttgtctaccgctaggcagaaaacagaaaagaaggagtagtccttgctgtcttggttcctatcaggcaagtagaccaggttgcttttcaccctcgagtaaatagaatcacgtatctgtggtttctctacccccttaaaaaatttatttctaatgacaccaatactgatggctttgtgggtttgaatgaattttttacttgtcttatttagtttcccaaggaattctatgatgtaaacaaaataagaattattaagaaccctgaatttcagatgatggaatgatgtccagtgaggtttggttatctaaggtcacctagctagtgaagatccactttgagtttctcacgtttcctaatctcagtgcagtgctctttttaccataccatgcatttattgtagatgtgaatttttagtatgcgtcagttatgtagtgccttcggattatttctggactcattgttttaatcatcagttaaatttctttggctcattaattattatgtttattcggcaagttcttactcaactgcttttatattcttgcattacaagatgctaatgtagataaaaatattatttattttttctttttttagacacaggatctctgtcacccaggctagggtacagtggcacaatcctagctcaccgttaccccaaattcctgagctcaagggatcctcccacctcaaactcctgagtagcaggaactgcaggctcacaccactgcacccacctaacttttttttttaattttcagtggagacaaggtctcattctgttgcccaggctggtctcaaactcctgggctcaggcagtcctcctgcctcggcctctcaaagtgctgggcttacaggcatgagccaacacaccccgcctataatttataatccctgcccttgaggagctgagagtctagtgagggagtcagattccatttcttaagacagatttattgaggtataattgacataaaataaactatttgtttatacaattatgtaagtttggacgtatgactacacccatgaagctatgttttgtttaagttttcattgttttttgttttaattgagttttgaaagctttatatattttggatataaatcctttatcagatatttctagcatgtcttttcattctcttcacagtgacttttgaagcacagaagttttaagttttgaagtaagcttattaatgtgttgttttctttcttcctgttttggttgctatagctttataataagtcttaaaatcaggtagtatgggtccttcaacttttttctccttcagagtcattttgccaagttttagaatcagtatttcaatgtttaccaaaacagcttgctgaattttgagaatgctttgaatctgtagatctgtttggggagaattgactttttttttgagacggagtttcgctcttgttgcccaggatggagtgcaatggcgtgatctcagcttaccgcaacctctgcctcccaggttcaagcgattctcctgcctcagcctcccttgtagctgggattacaggcatgtgccaccatgcccggctaattttgtatttttagtagagacggggtttctccatgttggtcaggctgctcgcgaactcccgacctcaggtgatccgcccacctcggaattgacatcttaacaatgttttgtctttgacacatgtctaggatgtatgtctctgtttattcatgtcagttttactcactagtattttatattagtattttatggttttcattgtataattcttccccattttgtcagatttatccgtatttcataattttgttgctgttgtaagtttttaaaatttctgtttttaattattcattgctactatgtggaaatgcaattgattttcagattacaattcaatatgctaagtgctctaccaatgttatgtgcaaaataccttgggagcatggaggaagaacaatcaaccctacttatggtgtcaaggaatgcttcataaaagaaataacataaattttctagttattttcttgatttttagcatgaatatcttgtccaaaattctagataaatgtctaataattaaaatacaaattatttttagaagtagtatattaaataatagactggaaactctagtattgagtttaaatcttggaacttttgattctggaaatttttaatcatatatgaaaatagagtattttcatagctttatttatattatgtggtttttattgtgtgtttttctgtttgttttgagacagagtctcactctgtcaccaggctggagtgcagtggcgcaatctcagcttactgcaacctccaccctccaggttcaagtgagtcccctgcctcagcctctcctgagtagctgggactacaggtgcacgccaccacgcccagctaatttttgtatttttagtagagatggggtttcaccacgttggccacgatggtctcgatctcttgaccttgtgatccgcccgcctcgacctcccaaagcgctgggattacaggcatgagccaccccgcccggccttatattacgtgtttttatgtgtatgtatatgaaatttcagacttacagaaaagttgcaggtataatacatggaatttccatatactctttactcagattcacagaaaagttgtaagaataatacatggaatttccatatactctttactcagattcaccagtttacatttttgtcccatctacttcatcattttctctattttcttttcttgaattgtttaggaatatgttggagatactgtgcccttttatccctaaatactttgttgtatatttcctaagaactaggacattgtcttacatcagcacagcacagttagttatcaaaatcaggaaatttaatttgatacagtactgttagttaatctatattataatataattttgttattccaattatgacctttgtagctttctttccagtcttcaattagtccaggctcataccttggtattctttaaactggaaccatttctcagcttttccttgtgtttgttcactttgatatttctaaagtggataggctagttattttgtagattgtccttcttgtgtttgcccactgcttcttcctaattaggttcaggttattcatttcggtaggaatcccactgaagtgatactgtgttctatttagtatatcttttgaggagacatgtgatagcactttgtcccaatatttgtgacaccagtgtaatgacttggttaagttgggttgaccaggttcctccactgtcaggttatactttttcattctgtaattaatgtatcgctatatattttatatactttgaaactgtaaacatcttgtcctcatcaaaccttcacctactaattttagcagtcattgctaattttttaaactcccattctttctacatttagtagttggcattctactataaggaagaattttccctttttccttatttgtgtatacttatttattaatatttattatttattaatatatatgcaagtatagacacttgcattcttattgtattcagtggattatgatccattgctattttctgtttggtgctaaattgtcccatattccatcagtgggaatgccttcaagttaactattgtgtgcctttgacatgtgcccatcattctttaatgcactttcttctttgagcatctccatctttttagcacaaaaagatgttgtaggctcatcttgtatattccctgcaccagctctggaatcagccatttctgcaggtggtcctggattttagttagttttggaagccaagatttgaactagaacatatatgttacacacacacacacacacacacacacacacacacatatacaactgtgaatttatattgatacctcccattcttaaccagcatcacagcctatattatagtctttccccctttccataattggaactctcttctccaacaatgaagaatgtggctcccaatatcttcaatttttctcatttgtttaagcctaatatatacaaaaggtgatttcagaacttctaaaccatgccactgcaaaaagtaaacctgttaaatagagttcattacttgtttacagttcttttatttttgaagtaaaatttacacacattgaagtatacaatgttaagtggataatatggtgagttttggcaaattgatatgcttttatatcccacacccctatcaagacataaaaaaaaaacatgtctatcacctcagaaaattcccttgagcccttttctggtcagtccccaaccccagaaacaaccataatttttattcttttcattataaattacttttttcttttttttagaatgtcatgtaaatatatgtcatacacacttctgtatcttgctgcttttgcttagcgtaatgtgagatctatctatgttttttaatgtgtcagtggttctatcccttttattactaaggagtattcctttgtgtgatcgtggcaaatgttttgttaattttttatcaatagttggattgtttccacctttagttttgtgatagtctttttttttttttaatgtcaacttagctaggctacagcccccagttattctgtcaaacactaattcgggtattgctgtgaaagtattttatagatgtgatcaaagtctacaagtaaaggagttaatcttattgcattcaataagcatttttttttcctttgagacaaagcctcactctgttgcccaggctggagtgcagtgatgtgaccttggctcactgcaacctctgcctcctgggttcaagtgatgcccctgcctctgcctcccaagtagctgggattataggtgcctgccaccatgttcagctaatttttgtatttttagtagggacagggtttcaccatgttggctaggctggtctcgaactactgacctcgagtgatctccccacctcggcctcccaaagtgctgggattacaggcatgagccactgtgcttagccacattcaatacaatttgcattaagtaagcgataatctgggtgggcctgattcagttgggtggaaggccttaagagccttacccagagagaacacaatgacatagtgtaaacaggtaaatcatttatagtaagtctcagaggttaaaggatttgggggcaaacaaaaggaatctagttctttgttttcctctatactaaggacatgccactagcatcctgacaaaagctcattcctcctttgctttgagagatctgctttaaatcactggggttgtaacatcactatatactgtccaggaaataatcctaagaagatcttgtactaaaaataatcttgtatttttagtagagacggggtttcaccatattggtcaggctggtctcaaactcctgacctcaggtgatccaccctcctcagcctcccaagtgctaggattacaggcgtgagccaccactcccagcttattttaattttttttttaagacagagtctcactctgtcatccaggctggagtgcagtggcacaatcaaggctcactgtagccttgacctcctgggctcaggtgatccatctcagcctcctgagtagctgggactacaggcacacgcctccacacccagctaattattttttttttttttcttttttggagatggggtctcactatgttgcccaggctggtcttgaactcctgggctcaagcagtcatcctgcctcagcctcccaaagtgctaggattgcagatgtgagctaccatgcctaggctgctttaattcattattttttattttcatgtttttaaataatattattatcttgatttttcttgacttttcagtcttacatattgtctgttgacttccaagaggaaagctgtgttaactccgctaaaaattgtacaaaatacgcttaaagtagaaaggaggtcacatcctttatataggtcagctcatttaccattctctgaaggtagtagactggtactcccttgttttatagacaaagaaactaaaattcagacaagttaaattacctccacatgctcacacagctctgtcatgttctagtgcatcaaactctagtctgagtccaaagcccgttgtctttctcaccaaaccaaattacctccaggacagagaaatcaggaaaatttctagaaaagggaaagaagtaataaataacagttgagccagaccttaaggatggactgaattttctgatgtatctgtttgattatatgatacatataaggaaggtgtgggagaaaagtctgggaagatagtttaggcttatggcatggaaagctaaggtaagaagcttaaaattacatagaaaggcagcatgtcatcaaaggtttttggacagagtattagaattatctctgaggaagattaagttagaagtagtgggtagataaaatagattggaggtagaagcctaaagtcaaaatggtccaggaaaagtattagttgaagagatggtgaggaaaaggttgaagtgaaagatgattgggtcagctgggcacggtggctcacgcctgtaatcccagcatttttgggaggctgaggcgggtggatcccctgaggtcaggagttcgagaccagcctgaccaacatagagaaatccggtctccactaaaaatacaaaattagccaggtgtggtggcgcatgcctgaaatcccagctactcgggaggctgaggcaggagaattgcttgaacctgggaggtggaggttgcggtgaggcaagatcacgccactgcactctagcctgggcaataagagtgaaactctgtctcaaaaaaaaaaaaaaaaaaaaagaaaaaaaaatgatgggatcactagaagacggtttgctgtttggtggtttctttctctgttttgttatattgtggaagcaatatatgtgactttgaatagcatagcagctagctgtcctgggctccctcaccactgcccccatctgtcccttacttgtctcttccaggcaagactaaactcactaaaatgtttcccttgtttttttttttttttttttgagttggggtcttgctctgtcacccaggctaaagtgcaatggtgccatcatggctcactacagccttgaactcctgggctcaaaggatcctctcacctcagcctgcccagtggttcagactacaggtgcatgccaccacacccagctaatttttttcattgtttctttttttgtttagcaatggggtcttgctatgttacccaggctggcctcaagcaatcctcccacctcagcctcctgagttactggattacaggcatgagccactgtgcccagctgtctgaattgtttttgactccccatagtactgtgtccttttaggagagtttttttgccactgattctcagttgtttgggtgattgcttttctgtgggtgggaggaattgtcctagatctctttgagggtcttatgaaagtttttgacagtttctaaaccctgcattaacatctcagtatgtgtagactctcgttaggagaattatgaaacttaactctttagaagttttataaacactttgaggcttatgattaaatgaaagtgctgatatttagaaggtagcaatcaaaatccaattaagcttttttttttgcttttttttttttttttttttaaacggagttttgctctgtcgccaggctgcagtgcagtggcacaatcttggctcactgcaacctccacctcctgggttcaagcgattctcctgcctcagcttcccaagtagctgggattacagatgcccgccaccacgcccagctaatttttgtatttttagtagagtcggggtttcaccatgttggccaggatgttctcgatcccctgacctcatgatctgcccacctcagcctcccaaagtgctgggattacaggcgtgaaccaccaggccgggccaagccagattctttaaagtggctctatcttctctgtaatttgctcccttgccactttgatgactccagattctactcctattcccattgtcttttaactcccacttcagggcctttattcttgctgttaccatttcctagaacaatccttccagatacctacctcaaatgctgcatcatctgtccatctttgttcagataccaccttttctttgaggccttctcttaaacactgtcgtacatacagttttgcacatacattttagttgtaggataaattgctaaaaattaagttatttgagcaaattatctgcatgcttaaaacgtgaatgactactgccaaatgacccttctagtacttgctaacgtttgccagtgtgagcatctaccatcactttttttttttttttgagacagagtttcactctcgttggccagactggagtacaatggcatgatcttggctcacagcaacctctgcctcctgagttcaagcgattctcctgcctcagcctccccagtagctggaattacaggcatgcaccacgatgcccggctaattttgtgtatttttagtagagacggggtttctccatgttggtcaggctgatctcgaactcccgacctcaggttgcagtgagcagagatcgcgccactgaattccagcctgggcgatagagcgagtctgtctcagaatgaaatgacgtgacatgacatgacatgatgaaatgaataatgaaatgccgggtgtggtggcacactccagcctgggcaatagagcaagtctctgtctcgaaatgaaatggaatgaaatgaagagaataaatgaaataaatgaaatgaaataataaaatgaataatgaattgccaggtgaaatgaaatgaaatgatgaaatgaataatgaaatgccaggtgcagtggtgcactccagcctgggcaatagagcaagtctccgtctcgaaatgaaatgagatgacatgagatgaaatgggatgaaatgaaataatgaacaatgaaatgccgggtgaaatgaaatgaaatgaaatgaagaaataaatgaaatattgaaatgaataataaaattctgggtgcggtgatgcactccagcttgagtgatagagtgagactccttcttgaaatgaaatgatgaaataatgaaacaaaattaaatatgaaatgaaatgaaatacgaaatactgggtgcggtggctcacgcctgtaatcctagcactttgggaggctgaggagggtggatcacctgaggtcaggagttcaagaccagcctggccaacatgatgaaaccccatctctactaaaatacaaaaactagccaggcatgatagcgggtgcctgtaatcccagctacttgggaggctgagagaggagaatcgcttgaacccaggaggcagaggttgcagtgagcagggattgcgccactgcactccagcctgggtgttagaacaagcctctggctcgaaatgacatgacatgacatgacatgacatggtgaaatgaaataatgaaatgaataatgaaatgcgtgtggtgcactccagcctgggcaatgcagcaagtctctgtcatgaaatggattgaaattgaatgggaatgggaatatgggaatggaataaatgaaatgaagaaatatgaaatgccaggtgtggtggcgcactccagcctgggtgatagagcgcgtctccgtcttgaaatgaaatgaaataaatgaaatgagaaatgatgagatgaaatatgaaatgctgggtgaaatgaataatgaaatgccaggtgtggtggcgcagtccagcctgggtgatagagcgagtctctgtcttgaaatgaaatgaaatgatcaaatgaaatgattaaatgaaataatgaaatgaataatgaaattctgggtgcagtggcgcactccagcctgggcaatagagggagtctccgtctcaaaatgaaatgaaatgaaatgatgaaatgaaataatgaaatgaataatgaaatgccgggtgaaatgaaatgaaatgaaaaaatgaaataaatgaaatgatgaaataatgcaatgaataatgaaatgccaggtgcagtggcacactccagcctgggtgatagagcgagtctctatctcaaatgggatgaaatgaaatgaagaaatgaaataatgaataatgaaatgccgggtgaaatgaaatgaaatgaagaaataatgaaatgaaatgaataatgaaatgctgggtgtggtgatgcactccagcctgggtgatagagtgagactccgttttgaaatgaaatgaaggagatgaaatgatgaaataaatatgaaatggaatatgaaatgctgggtgcagtggctcacgcttgtaatcctagcactttgggaggcctaggtgggcggatcacttgaggtcaggagttcaagatcagcctggccaacatggtgaaaccctgtctctactaaaatacaaaaactagccgggcatgatagcgggtgcctgtaatcccagctactcgggaggctgagagaggagaatcgcttgtacccaggaggtagaggttgcggggagcagagatcacaccactgcactccagcctgggcaatagaacgagtctccatctcagaatgaaatgacatgacatgatgaaatgaaataatgaaattaataatgaaatgtgggtggcgcactccagcctgggtgatagagtgagtctctgtcatgaaatgaaatgggaaatgaaatatgaaatgaataatgaaatgctgggtgcactccagcctgggtgttagagcgagtctacgtcatgaaattgaaaaatgaaatgaaatagatgaaatgaaaaaatgaaataataatgaaatgccgggtgtggtggtgcactccagactgggcgatagagcgagtctctgtctcgaaatgaaatgaaacaaatgaaatgaaatgaagtgagaaatgaaatgatgaaatgaaatacgaaatgccgggtgaaatgaaatgaataatgaaatgctgggtgtggtggcgcactccagcctgggtaatggagcgagtctccatcgaaatgaaatgaaatgagatgaaatatgaaatgaaataaatgaaactaaatgataaaatggaataatgaaatgccgggtgcggtggcgcactccagcctgggcaatagagcaagtcttcatctggaaatgaaacgaaatgaaatgaaatgatgaaatgaataatgaaatgctgggtgaaatgaaatgaaataaatgaataatgaaatgccagatgcagtggcgcactccagcctgggtgatagagcgagtctctgtctcgaaatgaaatgacatggcatgacatgacatgacatgacatgatgaaatgaaataatgaaatgaataatgaaatgctgggtgtggtggtgcactccagcttgcgcggtagagtgagtcttcatctctaaatgaaataaaatgaaatgatgaaatgaataatgaaatgccaggtgcggtggcgcactccagcttgggcaatagagcaagtctcttgtctcgaaatgaaatgaagtaaatgaataatgaaatgccgggtgtggtggtgcactccagcctgggcgattgagcgagtttccatctcgaaatgaaatgaaactaaatgaagaaatgaaataatgaaatgaataatgaaatgctgggtgcaatgaaatgaagaaatgaaataatgaaatgaaatgaataatgaaatgtcaggtgcagtggcatactccagcctgggtgatagagtgagtttccatcttgaaatgaaagaaatgaaatatgaaatgctgggtgtggtggctcacacctgtaatcctagcactttgggaggccgaggcaggtggatcacctgaggtcaggagttcaagaccagcctggccaacatgatgaaaccccatctctactaaaatacaaaaactagctgggcatgatagcgggtgcctgtaatcccagctacttgggaggctgagagaggagaatcgcttgaacccaggagatggtggttgccatgaggcaagatcgcgccactgcactccagcctgggcagctgagcgaaactctgtctcaaaaaaataaaaataaaaataaataaatgaataaaataaattactctctatctgacagctgctagtttttccctcatgatctttctattaaaatagctctgtacctactatgttgagcccttcctttttttttgacagggtctcagactagagtacagtggtgtgatcatggctcactgccacctctgcttcctgggttcaagtgatgctcccatctcagcctcccaagatgctaggactacaggcacacgccaccatgcctggctaatttttttgtgttttttgtagagacggggtttcaccatggtgcccaggctagtctcaaactcctgagctcaagcgatccaccctgccttggcctcccaagtattgggattacaggtgtgaaccaccgcgcccggccccctctttttttaaatttctgtatttaaagagtacattggggattggaaatagtttagatcagcagggattagccattccctaaatgtaaacttcagtggtgctatacttagagtgcccaaggtcatttccaaatccatgaatctggacgttgaagttatattcgtattcccaccacacaaaatttatgtctgtgccctgtcttcttgggtctattttttaaccagaaattaataagacattgatttgcctttgttagagtgatttcagtgtttcgagttattaagacaggaagtgtgagtccctgttggaattctgggtcagcagattatttacctcttctacaattgcaatggaaattgaaatctatttgtcctgtgacatagaattaatgagtattcttttttgctttttctcttctgagccaagagctttcttttcataatttatgttggaggtgttccagactatgttatgtgactactgcaagaaggtccttgccacagaaagttagactctcatttcttttgacaatatcaaatattcagccttttcctctgtcttaagaatacatataatatgccttaagttagatgctataccatagtggcttcccttgtgtaagaaaatggagtggagggggctgagctggagcttccatgcctatctgttgggctagaaacacctcccactcaactccagccatttgccactctgcataattagtgtacctcatttattcagaagaagctggaatcccagatttttatgtgaaatctcctgtttttaaaatatttgatctttttcaacataatttggcccaacaaaactcttgctggcttgagtgctgcccttgtactgccaattgaagtttaacatttgtctaaccctaaagactttcaaagtgaaattatttttaggttcttaacaaggtttttctatgccaaggtaaaattttcaagggcatatgaggtatttactgtctcactcagagttctgtttaagtgatcacatgggcatgcatgttggagaaagtgttgtgagctcttacagataaagtttgaaatgcaacctattttcaatagaaaaaagcctcttactctcagatatctcagaaaaacttagattttacaatccttttaagacttaagactcttaggtctgtggagtcaaaatgctacgtgatatttgtggtggatgaattactgaaaaacagaattcctcagcaaatcaagtgtctgatgcataagaaaccaacccaacaaaaaaagctgcctttcagaggcaagaatatagaacatgtgtagttaattaagctatttaaaacagaaatgttaggcctggcacagtggctcacgtctgtaatcccagcactttgggaggccaaggcgggaggatcacaatgtcaggagattgagaccatcctggctaacacagtgaaaccccgtctctactgaaaatacaaaaacattatctgggcatggtggtgggtgcctgtagtcccagctactagggaggctgagacaggagaatggcgtgaacctgggaggcaaggcttgcagtgagccgagattgcaccactgcactccagcctgggccacagagcaagactccgtctcaaaaaaagaaatgttatgaaaaatttggaaatatttgtcactagctgtatgaccttttgaaaaaggtccgcctaataccttgctcatctataaaattgcggtatgattatcaatttacaggattgtggtgcattttaaatgaaacaagttccattaagtgcttattgctgaaggtataattcagtgaatgttctttccttttcttagagcagagtttggtattttattttcacctaagccattttggttcagttcttaaggctttgattatttttttaagttgaatggtgtttagtgtgcccatgttcataacagcatattattcacaacagccatacaggctgggtgtggtagctcatgtctataatcccagcactttgggaagccaatgtgggcagattgagtccaggagtgtaagggcaatatggtgaaaccctgtctatacaaaaaattagccagtcttggtggtgggcacctgtagtcccacttactgggaaggctgagatgggagaatcacctgagcccaggaggtcaaagctgcagtgtgccttcattgtgccactgcactctagcctgggcgacagagtgagaaaaaaaaaaaaaaaaaaaagatagattctaagaggccaaggcaggcaaatgggcagattgcttgagcccaggagttggagactagcctggacaacatagctactaaaaatacaaaaaatgagctaagcatggtggtacatgctactcccgaggctgaggtgggaagatcacttgagcttggggaggtcaaggctgcagtgagccgtgatcatgccactgcactccagcctaggtgaccctgtctcaaaaaaagaaaaatgtggtatatacatagaatattattctgcctgtaaaaaggaaattctggctctccctctcactctccctctccccacggtctccctctccctctccccacggtctccctctccctctctttccatggtctccctctgatgccgagccgaagctggactgtactgctgccatctcggctcactgcaccctccctgcctgattctcctgcctcagcctgccgagtgcctgcgattgcaggtgcgcgccgccacgcctgactggtttttgtatttttttggtggagacggggtttcgccgtgttggccgggctggtctccagctcctaaccgcgagtgatctgccagcctcggcctcccgaggtgccgggattgcagatggagtctcgttcactcagtgctcaatgttgcccaggctggagtgcagtggcgtgatctcggctagctacaacctccacctcccagccgcctgccttggcctcccaaagtgccgagattgcagcctctgcccggctgccaccccgtctgggaagtgaggagcgtctctgcctggccgcccatcgtctgggatgtgaggagcccctctgcccgggctgcccagtctgggaagtgaggagcaccttttcccggctgccatcccgtctaggaagtgaggagcgtcttggcccggccacccatcgtctgaggtgaggggagcgcctctgccccgccgccccgtctgggatgtgaggagcgcctctgcctggccgcgaccccgtctgggaggtgaggagcgtctctgcccagccgccgtgtcttgagaagtgaggagcccctccgcccggcagctgccctgtctgagaagtgaggagccccgccgcccagcagctgccccctctgagaagtgaggagcccctccgcccggcagccgccccgtccaggaagtgaggagcgtctccgcaaggcagccgccccgtccgggaggtgggggggcagcccccgcccggccagctgccccgtccgggagggaggtggggggcagcccctgccccgccagccaccccgtccgggagggaggtggggggcgcctccgcccggctgccgccccgtctgggcggtggggggcgcctctgcccagccaccccttctgggaagtgaggagcccctctgcccggccgccaccccgtctgggaggtgtacccaacagctcattgagaatgggccatgatgacgatggcggttttgttgaatagaaaagggggaaatgtgcggaaaagatagagaaatcggattgttgctgtgtctgtgtggagggaagtagacataggagactccatttctttctgtactaagaaaaattcttctgccttgggatgctgttgatctatgaccttacccccaacccggtgctctctgaaacatgtgctgtgtccactcagggttaaatggattaagagcgtgcaagatgtgctttgttaaacagatgcttgaaggcagcctgctccttgagagtcatcaccgctccctaatctcaagtacccagggacacaaaaactgcggaaggccgcagggtcctctgcctaggaaaaccagagacccttgttcacatgtttatctgctgaccttccctccactattgtcctatgaccctgccaaatccccttctccaagaaacacccaagaatgatcaataaatactaaaaaaaaaaaaaaaaaaaaaaaatactgcaagaacatctgccccagaactgcctgtccaacctggactgacatcatccttgttattgatctttgtagccaaatataattattttaaaacaaacaaaaaaagagaatgtaagcagtataagactttaaaacacacaaatgaaatatacatgactacatgcttcagtgaactaaaactttcatctgtaatctttattttgcaacattctgaagtaacattacagtcttttcagtgtgctgtgtcatttatatcccttactttatcctaggaatcctgtattgccattgagcatatgcagattgagacatgtgcatagcttctccccgttgagcccatcagtggggaggagctatgtaccggggacatttggcaaagattttcacgagtctcttggatgtaacagctccttaagaaaacctcagtttaccttccctattttttaccatttgtaaaactaaggctcagtgatgtaaaatataacacattctgtgctgtggcataactgcagcttaggtttttatattcaagacaagcagaggtatagctgaaaaggtatgaacacttactatgcttcaagatcccttcgttggtttagttgtggcattttagaacagctgacttgggactaaagcatctttctatctgggatcagtatttctaagttgcctttaagctgaataaacatttggtttttatatttagttgcttcgatgtgaaacactgcaatttaaaaaattacacatatgtaatatagtattttacactaaataatagtgactggcagtccattggccgaagaagtattatttttcagatattctgctctgtcatcagctatagacactgacaggtatttatctggaaaggcttgctgtcaggggttcacagtgctgcttgtgggttatctccagaccctttacatttggcactttaggacagcgtgagtcacaggttgcactagaagttgcctttgaaattagacctaaactatgtggaactggaacccttgtacacaaagctctctatcatccaaatcctgctgaactctcttaggaaagaacagttttacagattcattctttccacacacaagatttccccactgcccagttactctcacctttttattttcttgactgttatgttttacttgactctggaatcttaccttgtactctcacatttacatggaagtatagcttatttcaccaattatactatcaaaagcagaagtagttacttacacctgaaaatttgtactgagaatgtagctgtgaatatgtttaagaaagtatacttaaagcagaaatccaaggaagtatatttaaatcaaagcaagaaatcccatttccaaatggcaataaagcatgtgttacatagaatcagtgcatgaaagtgttttagtagcccagattagattgtaccctggcgaataagcaagagttctttttcattttcatcttgcaattcaactgggtatttgggttctttttctattcactcatgtcagatagagacatgcatgttgtaaattattttgtcagaatgaaagcctggcagattaaatgctttcttctcttcttgctttacttgatatcaatctcttgttcatttcttgataatatgtttggttatttttgttttcattgcttttagtgtcagagatggctttggattccccattctgtgtgctgctgtctggctcctgaacccacctgtagaggtgtgtcaatcccagctggtgaagtactgagaagaagctacacaaaaggcatcaaagtattagtaagtgtacctctgacattttaaccacctctgacttttccatggaatggacaagtagtagtctctgtcagagctacattttaaaggagaaaaagaaacatgaagtcatgaactgtttatttatgctgttatttttgtgtttactcacctcatttatattgacttgtaaattagtaatttctgaactattatttatcaattcattgcctacatgtcagcaaacaaattttcttcttaataaagaatacagttgctgggcacaatggttcacacctgtaatctcagcacgtttggagggcaaggcaggaggattccttggggccaggagttcaagaccagcctgggcaatatagcaagatttcatctctacaaaaaaatgaaaacattggctgggcatagtggctcattcctatagttcaggatactgaggagcctgatgtaggaggatcacgtgaccccagtagtttgaggctgcagtgagctatgatcctaacactgctctccagcctgggtgacacaccaagttgccatctcttcaaaaaaggaatctagagacatcagtgtgtgcacaagcatggtttgtgaatttggaagtgtgtatgtgcgtagttgtgctcaagaatgtgttgatgattataccttctcagaatgaaggtaattttttttcttttcttttttttttgagatggagtcttgctctgttgccaggctggagtgcagtggtgctctcagctcactgcaacctctgcctcccgggttcaagcagttctcctgcctcagcctcccaagtagctgggactacaggcacacaccaccactcccggctaattttttgtgttttagtagagacggggttttaccatgttggccaggatggtctcgatcccccgaccttgtgatccacccaccttggcctcccaaagtgttgggattacaggtgtgagccaccgtgcctggcctgaaggtcatttttataaagatctctccacgtcttagatttgattcttcctttaaatatttttctcattgacatttgaaagcacctgaccttatataaaatgaacaattttcataactccataaaaggagaattatggcatcatctatttctttctcttgtctcataaatctaaaccatcaacctgcttatttttgtatactgtcacactgtgtattccctgcattgaatgcctgtctgttgaaattgtctgtaaaaattgtgggaagttttctgcaccctgaaatttctgttatgcagattaaatatccactatccatgtttttccaagtcttacagtagaaagggtaaatgcagccctcacagcatcctgttgttcgtcctgcaaatgtgtttccatcacattacacaaagcctctttgtcttcgtggttctaccctactaataagtttttaaaaaaattatgtaatgtgtgtatatacaaatacctatatgtatgtgtgtacacatacagctgatatctgctgagattatgtatgcatgaactatagaattaacttgtaattttaagaaaataaattattttgtaaagataaatctcatgtttaagaagaggaattacagttgaatcatttagggatgcctcagcctaaacataatatggaaaaagccataaccaaaagtcattttagagtactgctaggttactcaacctatcatcacatttaattaaaatgtcagtttgaaccatggccagtctatgttggttaatatgttatttaaatcaacttgtgaagtcttcattttaaatatagaatttgtgttaatggactggaaaataacattctattgcttggaagatgtgttaaagtctaaagatttatgactttgtaaaagaagaaaaccaggtgatgatcagttggcattagtatatgaggatgtactcatatttggtaatagccatttttttctaactagagtaagggagttgggaatgggaggcagaagcaaggacacagacatgtaaaaaatcatagaacaaaactgtattgagttctgagtatgggtctgtgatccatggttcagtttgagaggttcatgtgtcccttatgagaagggacaggaaagccaggaggaaaggagtatgtttgggcctgtgcctctgcttccgccacaaaagtcagcagctctacctttctcttttctcctctttatctaataattgtctcctcttcaaatttgggaaatgagcttaatcaaagatttgttgtgttttgtttgtttgtttgtttttgaaatgtggcctcagtgtgtttgcccaggctgatcttaaactcctgggctcacatgatcctccctctcagcctcctgagtagctgggactacaggcatgatccactacacccagctaagttaatgctaatgtgtagtttatctgcttcaattttgaagggtaggatatatatagttatgtgtgtgtgtgtgtgtgtgtgtgtgtgtgtgtgtgtgtggtgggggggtagtgtttgtgtgtgtgtgtgtatatatatatttatatattactagtccattgctgctacaacaaactaccactatgtcagggcataaaacaaatttattacactcctgtatgtcagagtatgatgtggatctcactgggctaaaatctaggtggtggaaaggctaccttcatctctagaggctctaggggatcttttttctcgccttttccacattctggagtctgcctgcattttttggctttgggctcttctccactctcaccattagcaaccttgcattccatggacccttcttctgtggccacatgtctctgtggctctttccttcccccttctcttccactgttaaggactcatgtgcttacttagtcctgaatggacacaccgtcatcatccacatgagcccactgtcctaatccatacaggctgctacaaggaaatgcattagaccaggtagcttataaataacagaacttcgtttctcacagtcctggaggctgagaaatgcaagatcaaggtgccggcagtcttggtgtctggtgaaggcctgctttctcatagaggcttccttcttgctgtgtcttcgcatggtgagaggaacaaacaagctcccttgtgcctgtaataaggtgctaatcccagtcatgagggcagagtctcccgtaaggcttaacctcctaataccatcaccttgagggttaggattttaacacatgaacattgacagaacacaacattcattccatagcaccagggtagtctcctcatgtcaaggtctttacctgaatcacatgcatgatgtaccgttttcatgtaaggttctaggaatctgtggacatctttggggggccattattttgccaatcacatattacatatattttaatatcctagactagtatgaaaacaatgccacttccattgctttatatatgtatatatatatacacattgtctaatgctataattaaaaaaaagttgtagacacaaatatacccatttaaaaaaaaacccatttttttctattttacttcatactgccaactcctttttcctgaaactgcttcaactctggaattcttttttgctattagttttattttattgaagtattcatgaacaagcatacacttgtatatggatttaaaattcacagtaatgttttcatgaattcatctgtgaataacattttatagacaaaatgtctgcactaggacaagagaaagatgtataattaccttgttctaaggtaccgccattcattgttattattttaaaatacgagtgtcgactgatgttaaaacacaaaatggggccgggagtggtggctcccgcctgtaatcccaacactttgggaggtgggtggatcacctgaggtcaggagtttgagaccagcctggccaacatggtgaaaccccgtctctactaaaaatacaaaaattagctgggcatgtgttgcgcgcccgtaatcttagctacccgggaaactgagtcaggagaattgctggaatctgggaggcggaggctgcagtgagccgagatcacaccagtgcactccagactgggtgacagagcgagactctgttcttccccccaccccccccaaaaaaaaaccacaaaaagggataattggccgggcacagtggctcatgcctgtaatcccagcactttgggaggccaaggtggacagatcacctgagaccgggagttcaagaccagcctgaccaacatggagaaaccctgcctctactaaaaatgcaaaaattagccgggcatggtggcacatgcctgtaatcccagctactcaggaggctgaggcaggagaattgcttgactttgggaggtggaggttgctgtgaaccaagattgcaccattgcactctagcctggacaacaacagcaaaactctgtctcaaaaaaaaaaaaaaaaaaaaaaaagatttataactgggcaatggaattgaaaatcatttttaaaaatatccaaaatatctaaggaacttgtataaataaataggaaaaaaaaaaagaaaaacatcaagaagcccacaaaaaagcagatttgtaaatgggcaatggatttcaatagacatttagccacagaagatatccagttggtgaaaaggcatatggaaaggtgctcagcatcactgattatcaggaaaatgaaaatcaaaaccaccacgagtggtttagaccatagcggcatgcatgaaagttttcagacctccagttgttgggagtggctgaggagattggggagcttctgtctgagttggaagagtggagtctcaacaagaaccattgtattctggacatgtgtgggccctggagtgtgcaaggctggatgccttgtctgcctgtgccttacagagtgacaccattgtggtgtggttgatcagaggtttgtttgcccacggatgaaagcaaaagtgagttggcttcccaagaacttttaccagtagcctgttttgctacaattctcgacccagactggggtcccaaggcatcatagcccacagcttcttagcaagtgcatgttcagttggatcccccagctcagcctgggtcatccccaccttttgcctcttgggccatagctcagctctgcacactgagccatcatcctatggtgagcaagaccccattcttgggcttcagtctctttccttgcagcaggcaatcaaggtggtggctggaaagggccaaggagccacatctcacagtgccctgctgcctgaacaaggaccagaggcctgtggaacacatggctctcagatttctcccatttgatgactcatcagctgcccccacatggcttcctagctcacagcagatctagccttctctgagcagtgaagatgggatgttttgtggtcattttccctggtgcgcagagcccaagtggagttcttcagcaccctacaccatcccctcactaacacccccacctgtccagtcttacctgccttcatatcaaaagcacacagttaacccagagggcttctgccctgccctgcctgactttctgggaaacccccctctccacccaccctaatcaggacactgtctgaaggttccccctcatcattttaaaagaaagaaatttttctgcctcagaggttctggtgaagtggcctgctcccacatcacagggtgatggcggtttgggctggaccaggatcagacagtgctgtcctgaggctggccgtctgataaggggctacagaaagggcagtggtggagccctgggaggctttctgctctcctgatcacaggtttttggtgagaggacctattggccactagggtgtctgcgtgcgtgcgtgcgtgtgtgtgtgtgtgtgtgtgtgatgtgtgtttacttggattgacttctttcagcatgaagcccactgttttgctgaatgtatctcactgtttcctgaaactcagtacattcagctggcttaagggtcctggggcctcgctgtgtcatatttgcacaagcctagtgtctgtgcagactgtacactggagttcagttgtaagacccttttgatcccttattctgttcctgtagtagaaaaggcatttcactcaatggaatagaaacccagatccaatggagagatgttctaatctgccatacactggggcagtggccagtgatttggactttgtggcacagatggaaatttccaggttctctaggtggtaggcagaggcctcactttttaagaaactcccccactccacccctgccaatgaggacgttgcttagaggtatttctatcagtgttgagtagaagagatcatttcttgatgttgaatttcaggtaaggatgccagcttctgcgtatcagggtggtgatgcttgggctgagacaggtctagacagcactgtctgaaagggggctcaaggaagtagctgtgaaaggcccctgggatgttttctgctccccttcctgcaaatcccctggagggagatcctgttagtcactacgggatgtgtgtgtgtgtgtgtgtgtgtgtgtgtgtgtgtgtgtgtgtgttcatcacttgttgcttgggggtgggaagagacaacaacaacctacagaatccagagttctcagttcatctcccatcctagtccaatcatggcctaacatccttagctaccgatcgcagaggagactgtgcatttgtgttcatgtggccttggatgttggcagattcagattggtgccccaggcatctgtgcctgtaactgcagtttcagcgggctcaggaccaggctaaagggcctccaagcttcctccagtttcctggtgcatgcatgtgcaatatgctcccctggcctgggtctttcctgccgcttcttgccagttgggtcagaactagcttattaaccagttttttctgagctttaatcgaactggctccaaccagttggagacttgaaaagggctacgtgatagttatagatttttaaagatatattattattttagagtagtattgagtgtacagcaaaatggagtacagggtccagagatctcatatggcctcaattcctgtatactctcgggtcactccaccaacaacctcctacaccagagccactttgaaacattagaaaatatatttgagcattcagaaatgtataaactaggcagccccagactgcaagcagctcagaggtcccacagagaggcttagggagggtgggggaagaattttatatggtgaatgtggaagaaaaagaaaatacttgattgggtgaagtggagcagtggcctcatttggaacattacagtggaaggtctctagttagatgttagttggtggtttctgactggttaaacttaagtttccttttattatttacactgagtcaagttttgggttatttaaggaggaattgagtgcactgcagccacctcagcctcatggccacctgtttatttgattatttttaacagagaagatcctttaaaaaatatctgttaccctggctggagtgcagtgacgtgatcacggctcactgcagccacaaccttccagctcaggtgatcctcccacctcagtgctccccaccctgagtagctgggactacaggcatgtgccaccacaccaccatgctaggctaatggtttgtatttgtttgagagatgcggtttccctaagttgcttaggcttcttttttagactcaaataatctgcatgcattggcctcccttagtgctggaattacaggccatctaaatcttttatctcaggtttgccttgtgacaaaaggaggggtactttttctgacatgaggcagagaaaggtgaggtgggcgcatcctgtgcatatgattttctcaggtgatgggaatatggttggctcttgactaatgggatatattttctctttgaatgatttggcaagatatcagatgagagaagttgaatgaatgttagaagaacatagaaaaaataggttatacacgttgggtttctgaagaaatgatgtctttggagaaacaaaacttttattgatttctggaaacatttagggccaattttttatgtaagtaatttgaatttatgatgatatctctgaccactttttgatattttttctggttcaggtgagtggtgtcattgagcaaacacaaagtcgggctcatccaaggatgagattttgccagagaaaggacgagcagcaagtcagggagcttaaggtaattatgggaatgtgactatctgcaatttcttaggtagaaggagacagattggatttttgtgtgtttggtatttgggataagagggatgtgggtgtgtacttgacatgggttgtttattctctgtctctctctttttctctcttttttttttttttttttttttttttgagagggagtctcactctgtcgcccatgctggagttctgtggcacagtcttggctcactgcaacctctgcctcccaggttcaagggattctcctgcctcaacctcccgagtagctgggattacaggtgcctgccaccacgcccggctaatttttgtgattttttttttagtagagacgaggttttactacgtaggcgaagttggtctcgaactcctgacctcagatgatccacccgcctcagcctcccaaagtgctgggattacaggcgtgagccaccgcgcctggcctgtttattctcttaagagagaaaatgaggggattagtggactgtagttctggacaaggtggaaaactcttaaagtggaagtattggggcaagtgctctgacaggctaggatggtgcagtcagtcccttcacccagaaatcagtagaatgttaacagttcagactcaaaccttgtgaaaaacaggttctagaaaggaaatccctcacagcaactggcaccataatcaagacagaatttttgcagaataaatagagttacctgctttcagccccaggtcgtagctattgtctgccctgctgatatgtgataataatttgtgatcctgttgtcttaaaatggggtcactcatctccagtagaattaagtccacagtgaagttgtccccccatccccagagataaacatatatgaatgaacttacgtgataacaactactgctgcctgggatcatgagagacctgaactgaactgataggaagtgaaaggtggctgaggtaatgagaatagacccatctgcagaggatcataaaaccagcaaagacaagatcttgtctaagatgccttcacaaactttgtccatgagaactgtaaggtcttctccagacctgttggctgctgctgtgatctctgcccaagaggagcttctgaccaacatccaaagggcttctggacccactggactcctctggaggtaccttggtctcccgatccatggctgtgtttttttactccctttatcgctgcctgtgtgtagaatgataattgcacaattgatagtgtgaagacctcttgataaatggtaaatctgagcatatgtatttggctgacatgtcattgtgaaacctcacagcttcagtcagtgtcagcacagctagggagcatgtacctaatgcacatatcactgggcatagtctacaggcacctaataactcaggtaccttaacagtcactaatgcgtgtctctccaaggtctaaacaatggaagactgtagaagatgttattcattaagatatctcaagaatgtggaagactattattcgcttctaaagggacaggacttcatagggcacctgaagaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacagactttttgtaagtttttcatatatgcttgcaaagggttgtaaaactttattgtgattattcttgctctaagctgaaacttccctaatctttctttagagattgtggcatagcatgttagtttcttttccatatccaattgttttctgtaatgaatacagaaatatgggcactattttgtaactttaaatagacatcatctcaagtctacaagaattatccaaaatggtatttaatgacatttctaggtcttcagacactattaatgcagattgtagcctctaggtcctgaagattttactagatactggttactgaaactgagctttcttgaattatttttccttccactgtggtttcccgcatttcaacacatcacctatttttgtcctcaaacattacttaaattttttccacagaattaaattaaatatgaatcatccctcctctgatttttgaaatgaccctttgcttcctatgataatgattcttctggtccattttgtagttatatgttagagtttgtaaatagtcacacattttgcaactgcatataattttcttattattttttcctcttcctctaaacctgctgttatttcttttaactttttgtgggaaaaattaaacccatctttcactttgttgatatacttatttataattgaactccttgatttttgctcgaattgcttttcaagttacccacttttagggaagacattatttgggttttgtttagtgtatcaggctttttttagttagttgtatcaagaagtgtagacttttctatacataatatcctttttcccacagtagtttttttttttgtttgtttgtttgttttttttttttaaagtctggccgggtgcagtggctcacgcctgtaatcccagactgtgggaggcccaggcgggcagatcacgaagtcaagagacggagaccatcctgcctaacacgttgaaaccccgtctctactaaaaatacaaaaaattagctggacatggtaacgggtgcctgtagtcccagctaatcaggaggctgaggcaggagaatggcatgaacccaggaggcagaggttgcagtgagccgagatcgtgccactgcactccagcctgggtgacagagcaagactccatctcaaaaagaaaaaaaaagtctgttaaaataaaggtcatcaaaagatcttttcctaaacctttcctttaccagaaatatctctagagtcacatggtcctttctcccttcttgcttttgtaggagtccaaagctaatctgtccctgatccagattgcaggcacctgtgccttttggggcccttctgcattagttcttccttctcttctaacctcaaaaatgtgttttctctgttggctctttccctttaacatagaagtatactcacgcttttgttgaatcttggaataaaagtcttcctttaccacatatctccctttaatactacatctctcttctcagccaaatacttgggaagagaagccctgagtttgtgtcattgttttctcacctccagttcactactttacccactgcctgacatccagctcgctcacacacacacacacaagcccaatcactaagttgccatagctaatttgtggctttcctgccctcctggcaaaatttgactctgcattgggataatacatgttgagtacctattgaacaggcactgtgctaggtgctgctgttatagatatgaaaagaaggcatcatctcctttctaacaactcacaggagcagccattcctgattcatatgcaggtctcttgagtctcagtgctcacttttgcaagcttcacttaatgccgtgcaaatcaccctattctccaggtcttctttcttcccagttctccttactatacacagcttctcagggcagtcacctccacacccatggcttcaattgctttctccattctctgagaacaacagaattttaaatggcttttttttttcatgtattagctttattttatacaaggtgcctcaattgctgtaaccatagattcaaagttgctccatgaaactaataaatgaaaaatggtgattttttagcatgtaaattttaggaaatttccccagttacgcttaatggcttgatttagtatgtatgttatttttgaaaacatatgttgggatgtcacaaatggacttagcctacagagatttatattcaacttttgaccagagagttccattttaatgtgacactgagagtaaaaaactatcttttcctccttacctatttctcttcctacattcttggccaggaggaaggcactgctacatacccagtcttccccagcagagcctgagcagctctgttttccttctacttcccctcttctttcacatctcatgaccaagcacttcctattctgtctcccaaatgatcacagactttttcctccgcttttgtcactgccactgcccttagcattactctgcctttagagaaagtctcttaatttgtttggttgcttccttcagtccttattatacagaccactacacacacatctgacagagacttttcaccttttcatggttgaatgactgaaattcccagaataaaattaaaaccaccccagcatcaaatttgaggtcaaatagaggtgggtttgtatcccaggttcatatactgtccagcagtatggtctcagaaaactgacctccttaaggctttgtttgtgtatctgcctacactcattgagagttgggactatttcacacatacagtgcctggcatgtagaagggacttaatcaatgttgaaagaaggggaggcattttaaaatccacatcaaaaaaatgttgttctgttcgggagtggtggctcatgcctgcaatcccagcactttgggaggccaaggcaggtggatcacctgaggtcaggagttcgagatcaacctgagcaacatggtgaaaccccatctctactaaaatacaaacattagctgagcatggggttgggctcctgtaatcccagctacttgggaggcttaggcacttgaatgagaatcacctggacccaggaggtggaggttgcagtgagcaacgattgtgccactgcctgggcaacagagtgagactctgtctcaaaaaaaataaaaaaaaaattcttttaaaaatatacgaatctggctgggcacggtggctcatgcctgtagtcctagcactttgggaggctgaggcgggcctgaccaacgtgcagaaaccccgtctctactaaaaatacaaaattagctgggcatggtggcgcatgcctgcaatcccaactacttgggaggctgaggcaggagaatcgcttgagcccaggaggcggaggttgcagtgagccaagatcacgccattgcactcctgcctgggcaacaagagagaaactccgtctcaaaaaaaaaaaaaatagtgttcagcaaggttgaagcataaaaggttaatagccagaatcatttatcaattgtatttctatacatctacaagacacaatctgaaaatgaaattagagaaacaatttcactgggcaacaagagcaaaacttcatctcaaaataataataataataataataatcatcatcatcatcatcatctacaatgtcatttcccatccaagcttgacttctacctttactttctgatatggttttgccatgcccccacccaaatctcatcatgaattataatccccataatcctgatgtgtcgagggaggggcctagggggaggtgattggatcacgggggcagttatcctcatgctgttcttgtgatattcagtaagtcctcatgagatcttatagggttttgttttgttttgttttttgggatggagtcttgctctgttgtccaggcaggagtgccatggcacgatcttggctcactgcagtctctgcctcttgagttccagtgattctcctgcctcagcctcctgagtagctgggattacaggcatgcacaaccacacccagctaatttttgtatttttagtagagacaggatttcactacattagctaggctggtctcaaactcctgacctcagttgatccacctgccttggcctcccaaagtactagggttacaagtgtgagccaccgtgcccagctgagatctgatggttttatacatgtttgacagttgctccttcacatgttcccactctctgtgcggccaccatgtaagtcggacctgcccttctgccatgattgtaagtttcctgaaggacttccccctctgccatgattctaagtttcctgaggcctccccagccatgtgaaactgagtcagttaaacctctttcctttaaaaattacccaacctgaggtatttctttatatcagtgtgaaaacagactgctatactttctgataatcatgcttaagcaattggggaattcagactagctgggatcaaactatggccccacccttagcagtcatgtgaccttggggaggttgcttaccttctccgtttcaacaacttctgcaaaatctgtaacatgagattgtttctgagggttaaatgagcatagcacagtggggacactgtcaggcacacactacttgccagatgtcgagtattcatctttattgaaataggactgtggtaagccactttatggctctcgattttgtatgagaaaatcatgcttagtgccttgttagtaaaagaaagaaaacctgaaagtccctgccacggaaggaagaaatagcggggagaaaagggagttggtaagtttcagcatttcagagcttggaggggcaagttaggtttctattttatggagaaggaggtggaggcaggatgggtcctaaggtgtcattcaaaacacacagccataactctttattgagagtagagctagggccccagggattgctgtggtcaagttgcggacaaaaatgaccactcgttggaagacaggagaggagtgtttagttacaaaagcagtcaacaattcaggtgtatctatatttagtcagcaaataaaagttgttcaacttggttgctaatgggacccactctactgaggctttgtatagaactcatagaggaagatggcttcaagtaatgaactaccctttgcttttcttaggactaaaatctcaggaagctggtgatgaatgaaaaccttagtcccaatggcactgcacgaggggccaggagagcagcagcatcataagccacagggtggggcagccaaggcaggggcattctgagctgttggggaggggtggcaggcagggtggggcactgtgagctgtcggggagggcattgtgaagtgtggggtggggcattgtgtgccacatgcctgggctcccacctggggccagtgggcttcagtctgtaggtgactacagaaggaggaggagctccgtctgttctctcttcaggcagttgttgtgtctctcagcacttgttgggttcacaacctattaaataagccggctggtcttcaccctcccagacaagtcaactcaggggaggcagcagggtgcgggccttggcccgcagccctagccggggccggggccagggccagggccagggctggtgcccggggccgcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctggggacaggatggcaggagcgcccatggctgctgctgtacagcctgctgaggtgactgttgaagttggtgaggacctccacatgcaccacgttcgtgaccgggagatgcctgaaggtgaggaggtgataggtgccatctaccctcggtttgcctctggctgctactgtccccaaggttccctttgaggcatcccacacttcgagctcctttctgcttgtagccagctttcccgggagctggccaggaacaaaagctggctctgccttgaattcccaccccttagtatttccccaccgagtccagtcagtttcttttcgcctcccctcccaatcgcccagttcttgctctctcatctcattctcccaggctggcatgggaccatttatttatggctcttgtcgaataagcagcagttgaataaatgagttgataaatttttataaatgattacatcttttttcttttctccctctatacatatagctttggagtttaacctttctgccaatccagaggcaagcacaatattccagaggaactctcaaacagatggtgagacaacagtgtctgtagctctgtttattatcctgtgggactttgtttaggcttctttgagctattctcttccttttctcaataaaaactcaaatatcccaacttttcagtacccatcttattttttctttgtacctatccagatggtacctaagtgaaggaaccaggtaagtgcctaattgtttcctttgttaaagtagccaaatctcaagacagttcctattcaagtatttggggatttcttatttaaaatcagaatggagtttgccatgggagaggctatatggtattcttaatgggctgctttaagtcaccttgatagaagctgcttagtttcttctaactgtaatttgaacacagaaggaaaaagaaaaaaggagagtgcttaaaataattgtgaaaggtgtgaaatgtcacagccggggctgcagaaaaatggttgtgtgtgtgtgtttggggtttctcaaaggagtttacctatgaagctcttttctgttaaagtaagaactttaacagaaaatgtgtctccagatttattctggtgacttaacagactttatttacctccttgttctaaaagagaggtggggattggttcatggtcaaaactttcaaaagacatgaaacgtcaatgtagactttcaatgtgtaatataaagattgcaggttaaaatgtcagaccttccctgtaagagtgtttgttgccatggctccccctttgtcccttcccctcctgacaatagcatcttgttcaaagataagaaagttacagttttggctgggcttggtggctcacgcctgtaatcccagcactttgggaggccgtggcaggcggatcacctgaggtcaggagttccagaccagcctggccaacatggtgaaacgctgtctctactaaaaaaaaaatacaaaaattagctgggcgtagtggcacatgactgtagttccagctactcacaaggctgaggcaggagaattgcttggacctgggaggtggaggttgcagtgagcagagatcacgccaatgcactccagcctgggtgacagagcgagactccgtctcacaaaaaaaaaaaaggaaagaaagttggagttttttagtctctacactgctggcagaggcaggggatgggagccggtagaaaagagaaaacaattagttggtttgcctctaaaattttgcaaagagatgaatctaagtaaaagtaattctgggtaataatatggttcttgaataaaaactgaaattttcaaaatagaaaacattgcatcataaacatattacatccagtaggcttattggtttcatttaaatgccagagatttcatcactgtagaggaaatgtcttatagctcttctatttaaactttggttgcgctcttaatttttaaagaggtaggataattaagactcattatgagtgtgactttgtaacttggaagtactatcttcacatttcaagatatttaaggattgctttagaataaacaaatgtattatgtgaattaattgattgtacctttatacacaaagcatgtaagtacttgtgtaaacttatactctgcttggtgatgttcggaaagcctgatggatgttacacaccagttagtagatgggtagtgttggatgagagcccaaaaatggctctttattgtcattctttaggattacaacacagtttatgtatgtctcacttggccctttccaatacaaataaggcctgtgtatgttctccctatgtgttgctaatgaagaaatgaaaacttagagatatcacatgactatggaagacagctactcaagagaactaaggttctgtgtcctcagaatgaaatggaagtgacagatatgatgaatttactttttaaaaattttaaaaactctagaatacatcttatattttgcctataaaatagacctgtcttttaaaacttactgccatcttgatttattttatgcaaagttgattttacacaactcaaagccaaaatttacctcttcttttttttttttttttaaataaaggagggtgtcattatgttactcatgctggcctcaacttcctgacctgggttcaagtgattttcccatctcagcctcctgagtagctgggactacaagcatgtgccatcttgcctggctctctcttatgtctatacattcatttcaatggataagaatcaaagtagagatagtgaaatagcctaaatgcagcagtcgaataaacgagttgataaatttttatcaatgattacatctttttttcttttcttcctctatgcatatagctttggagtttaacccttctgccaatccagaggcaagcacaatattccagaggaactctcaaacagatggtgagacgacattgttttttccaccaagagaaagaataaaagctcttgtttgatcaggttatagaaagtatttagaaaaactcatattggtttaaaattttcatcttttcacatgttcacttgtcttattttaatatgtgatatactttcctttagttcttatgatgttagtgaaaacgtgtaacctttttgtttatacattttgccatctttttatcaacacaattaatttgtgatgtgatggaggagtcatggatttctctttataattcttggatttatctttatttataattaatggattcatctttatttacaatcccttttcccttgctccaaaaagtacattttaaagatgaatgatagaacttcagcttggttttcatttaaacaaattaaaaaacatagtcgtttatcatcagggattgaatctgtgatttgggcctcctcttacacagtcctctgaccacattcatttaccacatccaagtttacgctactcaaaagttttaggttattaactttttcatttgatataatgtaaatttaaacatgccttactcctgcttatttcccttaatgttatattaaatcctcatttatttgccaacaagccatacacagccaagttttccagttgacttaaacagcaagaacacaagtgagggttctataataatgtgcgaagtaatgcagcacagtaaaacacgggagtttgtaacctttgtttttatagtttgagtagactttgcccatcttgagtcagttatttctggttagaatttgtcttcattttttacattactataaagagatacctaaggctgggtaatttataacaaaaagaggtttaattggctcaaagattttcaggctgtacaaacatggctttaacatctgcttctggtgagggcctcagcaaacttacaatcatgataaaaggcaaaggggaagcaggtggttccacaccgtgaaagagggaggagagaggggaagggggaaggtaccacactcttttttttttttttttttttgaaatggagtctcactctgttgcccaggctggagtgcaatggcacgatcttggctcactacaacctccatctcccaggttcaagcaattctcctgcctcagcctcccgagtagttgggactataggtgggcaccataacacctggctaatttctgtatttttggtagagacagggtttcaccatgttggccaggctggtctgaaactcctgacctcaagtgatctacccgcttcagcctcccaaagtgctgggattacaggcttcagccaccgcacctggccagtaccacagtcttttaaattaccatagtgagaatgtgcttattaccatggggatgggaccaagccattcataaggaatccactgccattacccaaacgcctcccactaggccctgtctccaacattaagggtcacatgttaacatgagacttggaggggcaacatatccaaaacatatcagaattgtatttcccagttccttccagaggcatgggcttctcacacctagagagcatggaagcagtaaaagaaaagctattccatgtccctcactcttcagtggtagtaacttttgcctacaaggccctcccagcatcaaaggcagaggcagtgtaggaaacaaagcatggcccaagtccctcttggggcttttattattctggcctctttttagggaaaaaaaatgattttttgtgctgcagacaccatgtccaattaggtttgtatacttattttaacatcaaaatttaggccaggctctgtggcttacacctgtaatcccaactctttgggaggttgaggtgggtggatcacgaggttaggagatcaagaccatcctggctaacacagtgtaactctgtctctactaaaaatacaaaaaacaattagctaggcatggtggcacgtgcctgtggtcccagctagtccggaggctaaggctgaagaattgcttgaacctgggaggcagaggttgcagtgcgctgagatcccgccactgcactcgagcctaggtgacagagtgagactccatctcaaaaaagaaaacaaatttaagataggttactttccagttgtgtaaagaccattttttaattttgttttgtttttagtgacatattagtagataaccactaagtgtggttcaagatgcttacagggattctgttgcatctagagataggtgtctggtcaggaagtagtttttagaactgttagctcttagagtctgataattaaagtaagctatgtgtaaatgcagaatgagagaatactaatggatcatggctcatatatgcaacagttaaactttttattagctaaatttttcatctggcctaatttttttgcccttttcttttgtacatgaggattctttcatttgtgtgtaatagaaacaaaaagtaaactaaatgaaaatctaagtttttagatttgacttatgaaattaatcatgccagataatttaaattatatgttattgaaaattttttttttaatggaattttgtctcatttttcataggagtaatcagtaagatgttaacaactacttttattttatggtatttgtatcagaagtgaccagtttttttttttttattcttagttgtagaaataagaagaagcaactgtacaaaccatgtaagtaaacactcaaatagttaagaaattgatagtttgacataaaaggatgtctctcttgatttctttaaattacaatgtggacctggtggtggtagcatggacctctttttgtggattttctaaatctcttctattttcctgagtattaaatttatccagaaaagtgcttagtttagcgtgtccaccttttaaagatttctgacatttaagttaaatttcaatagtccggttcaaaagatctgccttaaggctgggcatggtggctaacgtctgtaatcacaacactttaggaggccgaggcaggctgatcatctgaggtcaggaatttgagacaaccctgaccaacatggtgaaattctgtatctactaaaattacaaaagtagctgggcgtggtggtgcatgcctgtaatctcagctactcaggaggctgaggcaggagaatcacttgaacccaggaggcggaggttgcagtgagccaagatcgcgccattgcactccagcctggacgacagagcgaaactctgtctcaaaaaaaaaaaaaaattgccttaaatatttaatcttatttttaatgaaagaacaaaaatagaatagctaagttaattgccagcactgtctattgactttctgtcacagcaggtaaaagcataccttccccgctacaccatgatcttatgtttctccctgtgtttcttccaattgtagcacactttttaattaaatcagtaatatttacatgattatgactctgcaaatattattcactgctaagtcatatggtgttttcactgtgcctctgcattccatgtccttcatcctgtctctgaaacagttctgaaatctgagcacttctgcaattctcctggatcttcttttttcctagcctacgttagtttatctatccaaatatcgttaagtagcctctgggtgctctgtttgctttcacatccattattttttagcatgaagctaattttctgactatattcatttgcctgttttctaacagctgttttcccccaagtattgtagcatttatcacatgcctttcaaagatattttccatctgcgaaaacacatctgttcctttttatgtgtgtgtggggggcaactttctttggccttttgtcatcctagttcaatatagcgtgggtttccctagatatgctcaatgtctgcttttctgggctaactctttaaagtcttttggtatctcacgtaactgctgtcttgtgtgggatcgcctgagtcctagattctgtgtttccttctgtcctgttatcgtctctagttgtacttgaacacattttcctgtgtggagatgttaaaatccctcctctttgatagagagtacacctctaggttgaatctaaattgtatggttctgaagacattttgcagttgtgctcttattacagtgttgttcttgaatctattgccagtgtgtgatatgttatttacaaccaggttttagttatctgcggaagctttttagaatctctctctctaaggttctgaaattttataacagcttgttggggatcttttcattttattgaggctactaaacctgcagactatctcttcttgagaatttttttttttattttctctgttacttttttactgatagtcttgttattcagatgctaggctgcttagaccagtacgcctgcattgatttttaatttttccccttgtatttttttcagtttgtctttttattctagttctgggatattctgtgactttatcctctactatttctattgaattttatattttttgagagtgttttaagatttttttttaaagttttgctcctgattttgactggtcctatcaattccttttttctattgttttgatctcttttcttggaggcttccctccaatgtgtggtggtccctggcctgctttatttggaagcaggatttctgttaactgatagcactcagtgtgaggccttagaagcctgactagcttttcatttgggagacctcagtgtattatctggggatctttattgaagacatttcagtttcttctgagaaggatctcccagttttctgcctggaaagtaaaagcaggcctggaaaggaaaagcagagttagcgaagaaagttggagttccatttttggtgtacagttttctttatatctcaggtttaagccatggtatctctgagccagaaattctcaggtttgatatatccagagaacacacatctaagtttcttgtcagatggaaggacaggtggacttggggctctagttagagatttgcaactgaccttgctggcttttttttttttttcacattttaccctactttccaaagtgccatttgcctgtaagttcacaacctgcctttagttctgcaagacaaactggctcgcttctgttccagtcactttctgtaggcaccaaagttgtgtttctgtgttatttaccactcctttatctactttttatgtctcagcatttattaaaaattatctctgtcaaccttctgtgctggtcatgggtgtaacctttattttatgactgatgaggcttccggagggagacgaaataaatttgtggtcaatctattatatttaatccaaatttaggacctgtgtttaaatcaaagtctaatttgagtataattaatgatattaagccagagaattttttaaattaatgtatctataataagcatattacacttttctcctaaggccttgtttaatattttcattcaaagtttatccactgccatatacttcccattacttcacaacatagatggagctgttttcctgaatgcccaaagtgttagaaatatttaagttaattaagatttgttcatttttagcctggtcaacatcgcaagtcctcatatctacaaaaaggttaaataaaaaattagccaggcctggtggcatgcgcctttcgtattacctactcaggaggctgaggcagaggatcgcttgagctcaggagtttgaggctgcagttaactataattgcaccactgcactccagcctgggcaacaaagggagaccctgtctcggaaaaaggaaaaaagttactaattctttaaaaacctatctaaaatttgtcctgcccaaaaggagagtgaaaaatatgaactttagtctttgttttattttatgtttgctgagaaaaatgctgtactttatttatttatttattatttccataggtttctgggggaacaggtggcatttggtgacatgactaagttctttagtgatgatttgtgagatttaggtgcacccgtcacctgagcagtatccgctgaacccaatttgtagtcttttatccctcaccctcctcccagcctttcccccaagtccccaaagtccattgtatcattcttatggctttgcatcctcatagctcagctcccacgtatgaaagagaacatgatatttggttttccatgctgagttatttcacttagaataatagtcttacttccatccaggttgctgggaatgccatgaatttattccttattatggctgaggtggtattcctcatatatatatatatatgtatgtatatcacggtttctttatccactcattgattgacgggcatttgagctggttccatatttttgtaattgtaatttgtttgagttcctcatagattctggataatagccctttgtcagatgtatagactgtgaagatttcctcccactctgtggttgtctgtatactctgctgattgttccttttcctgtgcagaagctctttagttaagtctcacctatttgtttctgttgcatttgcttttgtgttcttggtcatgaagtctttgcctaagccagcgtctagacgggtttttccaatgttatcttctagaacttttatggtttcaggtcatagatttatgtccttgatccatcttgagttgatttttgtgtaagctgagagttgaggatccagtttcattctcccgcatgtggcttgccaattatcccagcaccatttgttgaatagggtttaccttcttcactttatgttttaggtggctttgttgaaaatcagttggctataggtatttgagtttatttctgggttctctattctgttccattggtgtatgtgcctatttttatatcagtaccatgctattttggcgactatggccttatagtatagtttgaaatcaggtaatgtcatgcctccagatttgttgtttttgcttagttttgttttggctgtgccggttcttgtttggtccatataaatttcaggattgttttttctagttctgtgaagaaggatggtggtattttgatgggagttgcattgaatttgtagattgcttttggcagtatggtcattttcacaatattcattctacccattcatgagcatggggtgtctttccatttgtttgtgtccatgacttcattcagcaacgttttgtagttcccaacggcatatcaaaaaataatcgggccaggcacggtggctcacacctgtaatcccagcactttgggacgctgaggcggacggatcatgaggtcaggagttcgagaccagcctggccaacatggtgaaatcccatctctactaaaaatacaaaagttagccgggtgtggtggcgctcacctgtaatcccatctactcaggtggctgaggcaggagaatcgcttgaacctcggaggcagaggttgcagtgagccaagatcaccacactgcatattccagcctgggcaacagagcgagactccatctcaaaaaaaaaaaaaagataatccaccatgatcaaatgggtttcataccagggatgcagggatggattaacatacacaagtcaataaatgtgatacaccacataaacagaattaaaaacaaaaaatcacatgatcatctaaacagatgcagaaaaagcatttgacaaaatgcagcatccttttatgattaaaaccctcagcaaaatcagcatacaagggtcacagctcaatataataaaagccatctatgacaaacccacaaccaacatgatactgaaagggggaaaagttgaaagcattccccccgagaactggaacaagacaaggatgcccactctcaccacttgtattcaacatactactggaaggcctagccagagcaatcacacaagagaaaacaataaaaggcatgcagatcagtaaagaggaagtcaaactgttgctgtttgatgatgatatgatcatatacctaggaaaccctaaagactcctccaaaaagctcctagaactgataaatgaattcagcaaagtttcaggagacaaaattaatgtacacaaatcagtagctctgttataccccagaagcgaccaagcttagaatcaaaccaagaactcaaccccttttctgatagctgcaaaactaaactaaactaaactaaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgacgttagagtgtttgtttctattttgtgactaccttaaataatacctataaagagtaaactgttagtagtgtttttgctgtaattaaatgtagtaagacttaccttccaaatgataactgaattgtcaaacacttgtcgaagttttggatttactcaaaattctatgctcagcagctggaggtaggaagagtaagggccctcccttactcttatggagaggcatactttctcacaaggggaatactctgcaggaattagcatcttgtaagcagtggtgaattcaactaattagtgtataaaaatacattttttggtgtggctgccgacaaagagatccaagagggtagatggagtcgagcttgctgaagcaaggaaagagaaaagcagtattctaggcagagagcaggggtagagcaggaaaatggctaggtgcaggtcagatgatttatagaatgcaattgatcaagttttgaagtgaatgcaaagtattctccgagagtctcatttgagtcatgtcttggcagtcttatttaaacatgaagtgaaagttagattttttaagttgtcatttgttttcagggtgtgagagaatatgtaagtgatactctttttatcctccacataagaaaataggactagagaaacctatggcttcctcacttgttggtggcctagcagccctggcacacagagcctctgaatctgaaacacttcttttgtaacaatatcacctgaaataatacatttaggattagtaatttagtaaatgcattagtcttgtattcactgcaataaaatgctcttgtagcaggattatttaatacattacattttatcgtagtaaataaataatagaagggctgggcgccgtggctcacgcctgtaatcccagtactttgggaggctgaggcaggcagatcgcgaggtgaggagatcgagaccatccaggctaacacggtgaaaccccgtctctactaaaaacacaaaaagttagccgggcacggtggtgggcgcctgtagtcccagctactcaggaggctgagtcaggagaatggcgtgaacccgggaggcggagcttgcagtgagccgagatcgcgccactgcactccagtctgggcgacagagtgagactccgtctcaaaaataaataaataaattaattaattaatagaaattctcagctgctttttattgctgcagaaaaaaaaatgaaatcttattttaaacttttctttttttttttttttttgaggcggagtctcactttgtctgccggcctggagtgcagtggcgcgaactcggctcactgcaagctccgcctcctgggttcaccccattctcctgtttcagcctctcaagtagctgggactacaggggcctgctaccacgcccggctaattttttgtatttttagtagagacggggtttcaccatgttagccaggatggtctcgatctcttgacctcgtgatccgcccgcctccacctcccaaagtgctaggattacaggtgtgagccaccgtgccccgcgaagccgacttttcccattatttttaacggtaattcataaaatccttgttaggtttgatgacaggtaccatattaagggcagcattttataacccatatcttaaacatcatctctggaagttgagagcctccaatgggttttctatagagtgcacatgataccacactcaggcagttcatggagtgtaagacatatcttagtgctttgtcatttgacattttaactgagaaaataatacactttgataagtttgacttacacttcccttccccttcaggtatctactgtgcgtttcagtcaacaatacagcttgtgttcgacaatattccttgatgacagcacagccatccagcattatcttacaatgacaataatatcgtgagtacaactatgctgccgagggacagattcctttattctaaaattatttcagtcatttggttgtccttttcagcaatcagtttaagaaattggagtcaaccatatattgatatccagattctgaatattaagtatcagtttctcttttaatcttagacgtcgtggtggaaggaaaaatcagttagcaaagaagcaatcccagaaacagtgtatctttttgatgcctttatgcctttagacaatgttgaacacagtgagaaggataggttccctttattgaatgttttttgtggaaacttagtttttcaatgcatcataggcctaaatcagtgtgcactactttggacattatccttggaagaaggaacagcttttcttcttctggcaccacagtgtatctgcatttgaatttctcccattgtgcatgagcacctcgtgggccacaaagatgcgctttgagagcaccctgagatgaagtttattttaaaaggaacaacaaccaacaccaccaccagctccacaggggctgtccagtgtacattattctcatcttcttgggttattagtcttgatttttagaacacagtttggaaagtgctaatttagaatattaatgtctttatctttaatttaacttttcattctgtacacataactagcttataaacaattttgtttcaaatgcactagcctttttaactaattcaattgtcaataacttttacttcaattaaaagtggaaagtttacactcataataatgtcactttcctccctcccttttaacaatagttgagaggaaattgtgtttcgaacaaaaactggactcaaactctgtctcaagtcctgagctttgggacctattgagtaatcactaaatgtctgtagtcagctaagtctcttaaatctctgagcacacatacacaaaaattactttgactagagtccctggcttcttctgagttccaaagattttgatatgttagcatataattcaaaagcagctttgaagattaattttgctgaaacaaatttcgtgcttttttcctcattattctactttttagaagtctacttttgagagtatagtaagttttaatttgccaccagcaagtttgagaaatgatcatttggtgtattcactattggtgaaataaagttattgaacaaattcatagggcaaattggcttcaagaagatattttgaaaaatgttttatcatgaatcagtagtgcactgttgtcagtgggataggtggaactcgctgagatcacttatgcaaggtttttttcaaaatacaagtctgcaaacacatgtatcttcccatctccactttccctctatctctaggcactgagaagccttttaggaaaatcgggatggatgtgaggcatctttctgtgaagaaaagcatcccagaagattctgattttcaccccaactcaatcattccaaactttgctgctgattgaaatcacctgggaaacgtttaccaaggaccttgatgccgaaagccatacccaatactaattaaattaaaatgtctcatgtggaagatgaggcagatattaaagcttctcaggcgattttaatgtgcagcaaagtttgacagccactgcttaatttgagtttaggacgagaaactgctccaatttggtgggaccttgggcaagtcagttttaaggtctgtttccctgatctgtaaaacgagtgttgaattaaatgtcacataaggtcattggtcctttccagcatgtaactttaaattctgtgattttaaaattatttcagagatgaaaactacttgaagcactatagacatatccatcttacctgctaatgttacaggctttttaaaaagtgctaatattgtgtagacctattagtagaattgagatttgccttccctcagttgttttgagcctcactctacaaaattagctgggtgtggtggcacatgcctgtaatcccagccacttgggaggctgaggcaggagaatctcttgaacccgggaggcagaggttgtggtgagccgagatcacaccattgcactccagcctgggcaacaagagcgaaactccatccaccccaccccccaaaaaaacattatctgggcatagtggcacaaacttgtagtcccagcttcttgggaggctgaggcatgagaatcgcttgaacctgggtggtggaggttgtgaggagtcaagatggcaccactgcaatccagtctgagcaagagagacagactctgggtcaaaaaataaataaatacataaaataaatcgcatgggacgaaaggtttcgtgggtagaaaagcatataacaaggaaatctgttattatttatatattgtaatcaccaacagaaacgcgtcttctaacggcatatttccttgcattttggttctcatatttttgtaaaaaacaaagaaatgaaaacaaagtgcccttatggtactgttctgaactagaagatttgaatttcagggccactaggagagtttcctctgccccccttttaaaaaatgtcttcaggcctaacaaatgttaacatctattgttatgaatttttttccttccacagtgtgaccttggagatacctcatcatatcacacaaaggtgagctttttagaaacctgtcttgttattctagctaagtactttgcaagatatcaagctcagtgttaggtcacagctctagacatcataagctgtattgtgcctactaaaatattgaagcaaattatttgtattttctttgttccttaagactctcataattcttaaatgattgagaatctcaaagagtatgtgtttatattgattatattgatatttagtgtggtagaattatacaattgaaattttttcaaaatctatttttagtttagatttcacagccttaccactgttgatattatgggctagataatgctttgttgtgaggactgtcttgtgcattgcagagagtttagcagtattcatggcctctaccaactagataccagtagtaacccatgacccaggttataacaacagaaaatattccttgagaacagtattgttaacagaattttttcattgaaaagtaacttttctacaacaaaaagttgagtaaaaagtgcgtcatgtatttatattatttaaagtctctcatgttgagcttaataggagacaaatggattctctagagctttctttgcaatttgctttaaagcagcaataagaggttgggcacggtgtctcacgcctgtaatcccagcactttgggaggctgaggcgggtggatcacaaggtcaggagatcgagaccatcctggctaacacagcgaaaccccgtctctactaaaaatacaaaaacttggctgggcatgatggcacgcacctgtagtcccacctattctggaggctgaggcaggagaaccacttgaacttgggaggcggaggttgcagagagctgagatggtgccattgcactgcagcctgggtgacagagcaagactctgtctaaacaaacaaacaaaaaaagcaataagctggtggggcgtagtggttcacacctgtaatcccagcattttgggaggccgaggtgggtggatcacttgaggtcaggagtttgagaccagcccgaccaacatggtaaaacctgcctctactgaaagtacaaaaaatggctgggtgtggtggtgcatgcctgtagtcccagttacttgggaggctgaggcaggagaatcgcttgagcctgggaggtggaggttgcagtgagccgagatctcgccattgcaccccagcctgggtgacagagagcgactctgtctcaaaaaaagaaaaaaagaagcaataagatgacctaacctcatgcaaatatgtagttggtagaaggtgtatttttaaagttttcagacagttgtgggtatttgttaacactaaatcaaaacttcacaagtggtggtttcttaaattagttacggtggcattttacatattaataaatttattccatcagtactcattgatctttcttgcacagtaaatggatcttttgctccatacttgcatttataatatcatgcattagttacttggaatatattggtttatgttttattgtgtcaaaagtcacttttagtttaaccaccaatctttctttaacacgcctttaagtattgaaaagctgccaagcctacagtagaaggaacaagtttttcaaagtccacaggaaagcttaaattttatcattgggaacaaatacgtatttcccttgaagtgacaacctctcacttcatttatttttgagaatgatagttgaactggttttttagaccgagtttcactctgtcacttggctggagtgcattggcatgatctcagctcaagcaatcctctcacctcaggctcctttgtagctgggaccacagatgtgtggcaccacgccaggctaattttcttatatgtttgacagtgacagggtttcgttatgttgcctaggctggtctcgaactcctgaaggagctcaagccatctgcctgctttggcctctcaaagtgctgggattttacaggcgtgagccactgcgctggcccagttgtacttttaaataaaaatgatgttctgtgaaaaaagtgatttttcagttcacagttaaatcacggattctttaaaaacaaaaaaaaaaaagcgcttctggttaactttccacttattcagaatattagagacatgtcaagatttaacaacattaatttttactgcttcatcaaagacattcttaagaaattcaggctatgttttttacctgtaggggacagtgaagaatagaatgactactaatgtaattggtaccactgccttgatttatgctgagaaaccagccattgtacccacttttgcttttatataatcatggcaagtgtcaatgaaaaagcaggcaatgactttgtattactttcacaaatttttaaaatttttcatcagctttctcaggtttaattagtatgattcagaacagtgttggccaggcacagtggctcaggcctgtaatcccagcactttgggaggccgaggcaagcggatcacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaaaacttggtctcaaaaaaaaaaaaaaaaaaaaaaaagaacagttatgacctcttaggccttctggaaggggtcttcgggatcccgagaggtccacagagcacatttggagaaccactggtttatacacaggcacaatgcattagttttacaaagtttaaagttcatcaaagactggcgtcttaaaaaggcagatgagtttgtcattcaaacaacagaaagtacataaatacatcatgagagtatactacagagaactaaagagaaaggaagctaggaaatctgaatcacatttacatttattaaagtttactacaactgctttgtagaacattcttgtgtttcaatgtgtggttagaagagtgaaaatatgtttggtttattgccatggcctgttagggagagtcaatactcacgggcatttctgactggttatcatataaaagacttcacggtacaggccatgatgtgctgagaaagaagaagtcaggaaaccctctgcaagtcaggatccaagagaagaattcgtaaaaactgctttggtaaagtaaacaccaaagcacacaggaggcagtattttactaaacaaatattatactaagatattaacagtttttgaagtaatgcgctttcttattttatagagatgcagatagatctttgagcatacctgatgaacagttacactcatttgcggtaagtggcacttttattgaggttgtattttcatcgtacacttgtatctgtttcatgctgaagtcaaagccatctttttttaaatcttccccatttcatgttgcatttagtcatcttaagtgttgtaaaaagaatgtgctggagtaagaactgatctgcagctctgtttagttagtgagctagtatgagtaaatatactatccaaacaacagaaaatgtatctttttttttttttttttttttttatggactctctttctgtagcccaggctggagtgcaatcgcgcgatcttggctcactgcaggctctgcctcccaggtccctgttcaagcaattctcctgcctcagcctcttgagtaactggaattacaggcatgtgccaccatgcccagctaattttttttctttttttttttttgtaaagacagggtttcaccatgttggccaggatggtcttgaactcctgacctcgtgatccacccacgttggcctcccaaagtgctgtgattacaggtgtgagccaccatgcctggcccagaaaatgtatctttttaaaaggtaattgtgagctgtctataggaccctgcaagccactacccaatttttgaagccattcctccttctgttccacacaggtttccaccgtgcacattatgaagaaaagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacgtggcactttgaagccacgacatatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaatgcccactgtgtggactgtgagacccagaatcctaagtgggccagtttgaacttgggagtcctcatgtgtattgaatgctcaggaatccaccacagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgtgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtatagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggccacattgcccaagtcacacaggcttctgtattatgtatttagataaaatgtgtgaaaatatatttgaaataaagttcataaatatgc

SEQ ID NO: 38718 - DNA, 21899 bp, Homo sapiens
gtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaaggtgaggaggtgataggtgccatctaccctcggtttgcctctggctgctgctgtccccatggttccctttgaggcatcccacacttcgagctcctttctgcttgtagccagctttcccgggggctggccaggaacaaaagctggctctgccttgaattcccaccccttagtctttccccaccgagtccagtcagtttcttttcgcctcccctcccaatcgcccagttcttgctctctcatctcattctcccaggctggcatgggaccatttatttatggctcttgtcgaataagcagcagttgaataaataagttgataaatttttataaatgattacatcctttttcttttctccctctatacatatagctttggagtttaacctttctgccaatccagagtcaagcacaatattccagaggaactctcaaacagaaggtgagacaacagtgtctgtagctctatttattatcctgtggtactttgtttaggcttctttgagctattctcttccttttctcagtaaaaactcaaatatcccaacttttcagtacccatcttattttttctttgtacctatccagatggtacctaagtgaaggaaccaggtaagtgcctaattgtttcctttgttaaagtagccaaatctcaggacagttcctattcaaatatttggggatttcttatttaaaatcagaatggaggttgccacgggagaggctatatggtattcttaatgggctgctttaagtcaccttgatagaagctgcttagtttcttctaactgtaatttgaacacaaaaggaaaaagaaaaaaggagagtgcttaaagtaattgtgaaaggtgtaaaatgtcacagccggggctgcagaaaaatggttgtgtgtgtgtgtttggggtttctcaaaggagtttacctatgaggctctgattactttaaaattcttactttaacagaaaatgtgtctccagatttattctggtgacttaacagactttatttacctgcttgttctaaaagagaggtggggattggttcatggtcaaaactttcaaaagacatgaaacgtcaatgtagacttttaatgtgtaatataaagattgcaggttaaaatgtcagaccttccctgtaagagtgtttgttgccgtggctccccgtttgtcccttcccctcctgacaatagcatcttgttcaaagataagaaagttacagttttggctgggcttggtggctcacgcctgtaatcccagcactttgggaggctgtggcaggcagatcacctgaggtcaggagttcgagaccagcctggccaacatggtgaaacgctgtctctactaaaaaaaaaaatacaaaaattagctgggcgtagtggcgcatgactgtagttccagctactcacaaggctgaggcaggagaattgcttggacctgggaggtggaggttgcagtgagcagagatcacgccaatgcactccagcctgggtgacagagcgagactccgtctcacaaaaataaaaaggaaagaaagttggagttttttagtctctatgctgttggcagaggcaggggatgggagccggtagaaaagagaaaacaattagttcgtttgcctcaaaaattttgcaaagagatgaatctaagtaaaagtaattctgggtaataatatggttcttgaataaaaactgaaattttcaaaatagaaaacattgcatcataaacatattaaatccagttggcttattggtttcatttaaatgccagagatttcattactgtagaggaaatgtcttatagctcttctatttaaactttggtcgggctcttaatttttaaagaggtaagataattaagactcattatgagtgtgactttgtaacttggaagtactatcttcacatttcaagatatttaaggattgctttagaataaacaaatgcattatgtgaattaattgattgtacctttatacacaaagcatgtaagtacttgtgtaaacttatactctgcttggtgatgttcggaaagcctgatggatgttacacaccagttagtagatgggtagtgttggatgagagcccaaaaatggctctttattgtcattctttaggattacaacacagtttatgtatgtctcacttggccctttccaatagaaataaggcctgtgtatgttctccctatgtattgttaatgaagaaatgaaaacttagagatatcacatgactatggaagacagctactcaagagaactaaggttctgtgtcctcagaatgaaatggaagtgacagatacgatgaatttactttttaaaaattttaaaaactctagaatacatcttatattttgcctataaaatagacctgtcttttaaaacttactgacatcttgatttattttatgcaaagttgattttagacaactcaaagccaaaatttacctcttctgtttttttttttttttttttttaataaaggagggtgtcattgtgttactcttgctggcctcaacttcctgacctgggttcaagtgattttcccatctcagcctcctgagtagctgggactacaagcatgtgccatcttgcctggctctatcttatgtctatacattcatttcaatggataagaatcaaagtagagatagtgaaatagcctaaatgcagcagtcgaataaacgagttgataaatttttatcaatgattacatctttttttcttttcttcctctgtgcatatagctttggagtttaacccttctgccaatccagaggcaagcacaatattccagaggaactctcaaacagatggtgagacgacattgtcttttccaccaagagaaagaataaaagctcttgtttgatcaggttatagaaagtatttagaaaaactcatattggtttaaatttttcaccttttcacatgttcacttgtcttattttaatatgtgatatactttcctttagttgttatgatgttagtgaaaacgtgtaacctttttgtttatacattttgccatctttttatcaacacaattaatttgtcatgtgatggaggagtcatggatttctctttataattcttggatttatctttatttataattaatggatttatctttatttataatcccttttcccttgctccaaaaagtacactttaaagatgaatgatagaacttaggcttcagcttggttttcatttaaacaaattaaaaaacatagttgtttatcatcagggattgaatctgtgatttgggcctcctcttacacagtcctctgaccacattcatttaccacatccaagttcatgctactcaaaagttttaggttattaactttttcatttgatgtaatgtaaatttaaacatgccctactcctgcttatttccctcaatgttatgttaaatcctcatttatttgccaacaagccatacacagccaagttttccggttgacttaaacagcaagaatacaagtgagggttctataataatgtgcgaagtaatgcagcacagtaaaacacgggagtttgcaacctttgtttttatagtttgagtagactttgcccatcttgagtcagttatttctggttagaatttgtcttcattttttacattactgtaaagagatacttaaggctgggtaatttataacaaaaagatgtttaactggctcaaagattttcaggctgtacaaacatggctttaacatctgcttctggtgagggcctcagcaaacttataatcatgataaaaggcaaaggggaagcaggtggttccacacggtgaaagagggaggagagaggggaagggggaaggtaccacacttttttttttttgttttgatatggagtctcactctgttgcccaggctggagtgcaatggcacgatcttggctcactacaacctccatctcccaggttcaagcaattctcctgcctcagcctcccgagtagttgggactataggtgggcaccataacacctggctaatttctgtatttttggtagagacagggtttcaccatgttggccaggctggtctgaaactcctgacctcaagtgatctacccgcttcagcctcccaaagtgctgggattacaggcttcagccaccgcacctggccagtaccacagtcttttaaattaccataatgagaatgtgcttattaccatggggatgggaccaagccattcataaggaatccactgccattacccaaacacctcccactaggccctatctccaacattaagggtcacatgttaacatgagacttggaggggcaacatatccaaaacatatcagaattgtatttcccagttccttccagaggcatgggcttctcacacctagagagcatggaagcagtaaaagaaaagctattccatgtccctcactcttcagtggtaggagcttttgcctacaaggcccttccagcatcaaaggcagaggcagtgtaggaagcaaagcatggcccaagtccctcttggggcttttattattctggcctctttttagaggaaaaaaaaatgattttttgtgctgcagacaccatgtccaattaggtttgtatactcattttaaacatcaaaatttaggccaggctctgtggcttacacctgtaatcccagctctttgggagactgaggtgggtggatcacgaggttaggagatcaagaccatcctggctaacacagtgtaactctgtctctactaaaaatacaaaaaacaattagctaggcatggtggcatgtgcctgtactcccagctaatcaggaggctaaggctgaagaattggttgaacctgggaggcagaggttgcagtgagctgagatcccgccactgcactcgagcctaggtgacagagtgagactccatctcaaaaaaaaaaaaaaaaaaaattaagatatgttactttccagttgtgtaaagaccgttttttaattttgatttgtttttagtgacatattagtagataaccactaagtgtggttcaagatgcttacagggattctgttgcatctagagataggtgtctggtcaggaagtagttcttagagctgttagctcttagagtctgataattaaagtaagctatgtataaatgcagaatgagagaatactaatggatcatggctcatatatgcaacagttaaactttttattagctaaatttttcatctggcctaatttttttacccttttcttttgtacatgaggattctttcatttgtatgtaatagaaacaaaaagtaaactaaatgaaaagctaagtttttagatttgacttatgaaattaatcatgccagataatttaaattataaattattgaaaattattttttaaatggaattttgtctcattttacgtaggagtaatcagtaagatgttaacaactacttttattttatggtatttgtatcagaagtgaccagttttttttttttattcttagttgtagaaataagaagaagcaactgtacaaaccatgtaagtaaacactcaaatacttaagaaattgatagtttgacataaaaggatgtctctcttgatttctttaaattacaatgtggacctggtggtggtagcatggacctctttttgtggattttctaaatctcttctattttcctgagtattaaatttatccagaaaagtgtttagtttagcgtgtccaccttttaaagatttctgacatttaagttaaatttcaatagtctggttcaaaagatctgccttacggctgggcatggtggctaacgtctgtaatcacaacactttaggaggccgaggcaggctgatcatctgaggtcaggagtttgagacaaccctgaccaacatggtgaaattctgtatctactaaaaatacaaaagtagccgggcgtggtggtgcatgcctgtaatctcagctactcaggaggctgaggcaggagaatcacttgaacccaggaggcggaggttgcagtgagccaagatcgcgccattgcactccagcctgggcaacagagcgaaactctgtctcaaaaaaaaaaaaaaaaaaaaaagtgcctgaaatatttaatcttatttttaatgaaagaacaaaaatagaatagttaagttaattgccagcactgtctattgactttctatcacagcaggtaaaagcataccttccccgctacaccatgatcttatgtttctccctgtgtttcttccaattgtagcacactttttaattaaatcagtaatatttacatgattatgactctgcaaatattattcactgctaagtcatatggtgttttcactgtgtctctgcattccatgtccttcatcctgtctctgaaacagttctgaaatctgagcacttctgcaattctcctggatcttcttttttcctagcctacgttagtttatctatccaaatattgttaagtagcctctgggtgctctgtttgctttcacatccattattttttagcatgaagctaattttctgactatattcatttgcctattttctaacagctgtttttcccccaagtattgtagcatttatcacatgcctttcaaagatattttccatctgcaaaagcacatctgtttctttttatgtgtgtgtgtggggcaactttctttggccttttgtcatcctagttcaatatagcgtgggtttccctagatatgctcgatgtctgcttttctgggctaactccttaaagtcttttgggatctcacgtaactgctgtcttgtgtgggatcgcctgagtcctagattctgtgtttccttctgtcctgttatcatctctagttgtagttgaacacattttcctgggtggagatgttaaaatccctcctctttgatagagagtacacctctaggttgaatctaaattttatggttctgaagacattttgcagctgtgctcttattacagtgttgttcttgaatctattgccagtgtgtgatacgttatttacaaccaggttttagttatctgcggaagctttttagaatctctctctctaaggttctgaaattttataacagcttgttggggatcttttcattttattgaggctactaaacctgcagactatctcttcttgagaatttttttttattttctctgttacttttttactgatagtcttgttattcagatgctaggctgcttagaccagtatgcctgcattgatttttaatttttccccttctatttttttcagtttgtctttttattctagttctgggatattctgtgactttatcctctactatttctattgaattttgtaatttttggagtgttttaagatttttttttaaagttttgctcctgattttgactggtcctatcaattccttttttctattgttttgatctcttttcttggaggcttccttccaatgtgtggtggtccctggcctgctttatttggaagcaggatttctgttaactgatagcatcagtgtgaggccttagaagcctgactagcttttcatttgggagacctcagtgtattatctggggatctttattgaagacatttcagtttcttctgagaaggatctcccaattttctgcctggaaagtaaaagcaggcctggaaaggaaaagcagagttagcgaagaaagttggagttccatttttggtgtacagttttctttatatctcaggtttaagccatggtatctctgagccagaaattctcaggtttgatatatccagagaacacacatctaagtttcttgtcagatggaaggacaggtggacttggggctctagttagagatttgcaactgaccttgctggcttttttttttttttttcacattttaccctactttccaaagtgccattggcctgtaagttcacaacctgcctttagttctgcaagacaaactggctcacttgtgttccagtcactttctgtaggcaccaaagttgtgtttctgtgttatttaccactcctttatctactttttatgtctcagcatttattaaaaattatctctgtcaaccttctgtgctggtcatgggtgtaacctttattttatgactgatgaggcttccggagggagacgaaataaatttgtggtcaatctattatatttaatccaaatttaggacctgtgtttaaatcaaagtctaatttgagtataattaatgatattaagccagagaattttttaaattaatgtatctataataagcatattacacttttctcctaaggccttgtttaatattttcattcaaagtttatccactgccatatacttcccattacttcacaacatagatggagctgttttcctgaatgcccaaagtgttagaaatatttaagttaaataagatttgttcatttttagcctggtcaacatagcaagagctcatgtctacaaaaaggttaaataacaaattagccaggcctggtggcatgcgcctttcgtattacctactcaggaggctgaggcagaggatcacttgagctcaggagtttgaggctgcagttaactataattgcaccactgcactccagcctgggcaacaaagggagaccctgtctcggaaaaaggaaaaaagttactaattctttaaaaacctatctaaaatttgtcctgcccaaaaggagagtgaaaaatatgaactttagtctttgttttattttatgtttgctgagaaaaatgctgtacttttatttatttatttattatttccataggtttctgggggaacaggtggcatttggtgacatgcctaagttctttagtgatgatttgtgagatttaggtgcacccatcacctgagcagtatccgctgaacccaatttgtagtcttttatccctcaccctcctcccagcctttcccccaagtccccaaagtccattgtatcattcttatggctttgcatcctcatagctcagctcccacgtatgaaagagaacatgatatttggttttccatgctgagttatttcacttagaataatagtcttacttccatccaggttgctgggaatgccatgaatttattccttattatggctgaggtggaattcctcatatatatatatatatatatatatgtatgtatatcacggtttctttatccactcattgattgatgggcatttgggctggttccatatttttgtaattgtaatttgtttgagttcctcatagattctggataatagccctttgtcagatgtatagactgtgaagatttcctcccactctgtggttgtctgtatactctgctgattgttccttttcctgtgcagaagctctttagttaagtctcacctatttgtttctgttgcatttgcttttgtgttcttggtcatgaagtctttgcctaagccagcgtctagacgggtttttccaatgttatcttctagaacttttatggtttcaggtcatagatttatgtccttgatccatcttgagttgatttttgtgtaaggtgagagttgaggatccagtttcattctcccgcatgtggtttgccaattatcccagcaccatttgttgaatagggtttactttcttcactttatgttttaggtggctttgttgaaaatcagttggctataggtatttgagtttatttctgggttctctattctgttccattggtgtatgtgcctatttttatatcagtaccatgctattttggcgactatggccttatagtatagtttgaaatcaggtaatgtcatgcctccagatttgttgttttttcttagttttgttttggctatgccggttcttgtttggtccatataaatttcaggattgttttttctagttctgtgaagaaggatggtgttattttgatgggagttgcattgaatttgtagattgcttttggcagtatggtcattttcacaatattcattctacccattcatgagcatggggtgtctttccatttgtttgtgtccatgacttcattcagcaacgttttgtagttcccaacggcatatcaaaaaataatccggccaggcacggtggctcacacctgtaatcccagcactttgggaggctgagggagacggatcatgaggtcaggagcgggagacggatcatgaggtcaggagttcgagaccagcctggccaacatggtgaaatcccatctctactaaaaatacaaaagttagccgggtgtggtggcgctcacctgtaatcccatctactcaggtggctgaggcaggagaatcgcttgaacctcggaggcagaggttgcagtgagccaagatcaccgcactgcatactccagcctgggcaacagagcgagactccatctcaaaaaaaaaaaaagataatccaccatgatcaaatgggtttcataccagggatgcagggatggattaacatacacaagtcaataaatgtgatacaccacataaacagaattaaaaacaaaaaatcacatgatcatctaaacagatgcagaaaaagcatttgacaaaatgcagcatccttttatgattaaaaccctcagcaaaatcagcatagaagggtcacagctcaatataagaaaagccatctatgacaaacccacaaccaacataatactgaaagggggaaaagttgaaagcattccccccgagaactggaacaagacaaggatgcccactctcaccacttgtattcaacatactactggaaggcctagccagagcaatcacacaagagaaaacaataaaaggcatgcagatcagtaaagaggaagtcaaactgttgctgtttgatgatgatatgatcatatacctaggaaaccctaaagactcctccaaaaagctcctagaaccgataaatgaattcagcaaagtttcaggagacaaaattaatgtacacaaatcagtagctctgttataccccagaagcgaccaagcttagaatcaaaccaagaactcaaccccttttctgatagctgcaaaaataaactaaactaaaataaaatacttcggaatagacctaaccaaggaggtgaaggatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgacgttagagtatttgtttctattttgtgactaccttaaataatacctataaagagtaaactgttagtagtgtttttgctgtaattaaatgtagtaagacttaccttccaaatgataactgaattgtcaaacacttgtcgaagttttggatttactcaaaattctatgctcagcagctggaggtaggaagagtaagggccctcccttactcttatggagaggcatactttctcacaaggggaatactctgcaggaattagcatcttgtaagcagtggtgaattcaactaattagtgtataaaaatacattttttggtgtggctgccgacaaagagatccaagagggtagatggagtcgagcttgctgaagcaaggaaagagaaaagcagtattctaggcagagagcaggggtagagcaggaaaatggctaggtgcaggtcagatgatttatagaatgcaattgatcaagttttgaagtgaatgcaaagtattctccgagagtctcatttgagtcatgtcttggcagtcttatttaaacatgaagtgaaagttagattttttaagttgtcatttgttttcagggtgtgagagaatatttaagtgatactctttttatcctccacataagaaaataggactagagaaacctatggcttcctcacttgttggtggcctagcagccctggcacacagagcctctgaatctgaaacacttcttttgtaacaatatcacctgaaataatacatttaggattagtaatttagtaaatgcattagtcttgtattcactgcaataaaatgctcttgtagcaggattatttaatacattacattttatcgtagtaaataaataatagaagggctgggcgccgtggcttacgcctgtaatcccagtactttgggaggctgaggcaggcagatcgcgaggtgaggagatcgagaccatcctggctaacacggtgaaaccccgtctctactaaaaatacaaaaagttagccgggcatggtggtgggcgcctgtagtcccagctactcaggaggctgagtcaggagaatggcgtgaacccgggaggcggagcttgcagtgagccgagattgcaccactgcactccagcctgggcgacagagcgagactccgtctcaaaaataaataaattaattaattaattaatagaaattctcagctgctttttattgctgcagaaaaaaaatgaaatcttattttaaacttttcttttttttttttttttgagacggagtctcactttgtctgccggcctggagtgcagtggcgcgaactcggctcactgcaagctccgcctcctgggttcaccccattctcctgtttcagcctctcaagtagctgggactacaggggcctgctaccacgcccggctaattttttgtatttttagtagagacggggtttcaccatgttagccaggatggtctcgatctcttgacctcgtgatccgcccgcctccacctcccaaagtgctaggattacaggtgtgagccaccgcgccccgcgaagccgacttttcccattatttttaacggtaattcataaaatccttgttaggtttgatgacaggtaccatattaagggcagcattttataacccatatcttaaacatcatctctggaagttgagagcctccaatgggttttctatagagtgcacatgataccacactcaggcagttcatggagtgtaagacatatcttagtgctttgtcatttgacattttaactgagaaaataatacactttgataagtttgacttacagttcccttccccttcaggtatctgctgtgcgtttcagtcaacaatacagcttgtgttcgacaatattccttgatgacagcacagccatccagcattatcttacaatgacaataatatcgtgagtacaactatgctgccgagggacagattcctttattctaaaattatttcagtcatttggttgtccttttcagcaatcagtttaagaaattggagtcaaccatatattgatatccagattctgaatattaagtatcagtttctcttttaatcttagacgtcgtggtggaaggaaaaatcagttagcaaagaagcaatcccagaaacagtgtatctttttgatgcctttatgcctttagacaatgttgaacacagtgagaaggataggttccctttattgaatgttttttgtggaaacttagtttttcaatgcatcataggcctaaatcagtgtgcactactttggacattatccttggaagaaggaacagcttttcttcttctggcaccacagtgtatctgcatttgaatttctcccattgtgcatgagcacctcatgggccacaaagatgcgctttgagagcaccctgagatgaagtttattttaaaaggaacaacaaccaacaccaccaccagctccacaggggctgtccagtgtacattattctcatcttcttgggttattagtcttgatttttagaacacagtttggaaagtgctaatttagaatattaatgtctttatctttaatttaacttttcattctgtacacataactagcttataaacaattttgtttcaaatgcactagcctttttaactaattcaattgtcaataacttttacttcaattaaaagtggaaagtttacactcataataatgtcactttcctccctcccttttaacaatagttgagaggaaattgtgtttcgaacaaaaactggactcaaactctgtctcaagtcctgagctttgggacctattgagtaatcactaaatgtctgtagtcagctaagtctcttaaatctttgagcacacatacacaaaaattactttgactagagtccctggcttcttctgagttccaaagattttgatatgttagcatataattcaaaagcagctttgaagattaattttgctgaaacaaatttcgtgcttttttcctcattattctactttttagaagtctacttttgagagtatagtaagttttaatttgccaccagcaagtttgagaaatgatcatttggtgtattcactattggtgaaataaagttattgaacaaattaatagggcaaattggcttcaagaagatattttgaaaaatgttttatcatgaatcagtagtgcactgttgtcagtgggataggtggaactcgctgagatcacttatgcaaggtttttttcaaaatacaagtctgcaaacacatgtatcttcccatctccactttccctctgtctctaggcactgagaagccttttaggaaaatcgggatggatgtgaggcatctttctgtgaagaaaagcatcccagaagattctgattttcaccccagctcagtcattccaaactttgctgctgattgaaatcacctgggaaacgtttaccaagaaccttgatgcccaaagccatacccaatactaattaaattaaaatgtctcatgttgaagatgaggcagatattaaagcttctcaggcgattttaatgtgcagcaaagtttgagagccactgcttaatttgagtttaggacgagaaactgctcctatttggtgggaccttgggcaagtcagttttaaggtctgtttccctgatctgtaaaacgagtgttgaattaaatgtcacataaggtcattggtcctttccagcatgtaactttaaattctgtgattttaaaattatttcagagatgaaaactacttgaagcactatagacatatccatctcacatgctaatattacaggctttttaaaaagtgctaatattgtgtagacctattagtagaattgagatttgccttccctcagttgttttgagactcactctacaaaattagctgggcgtggtggcacatgcctgtaatcccagccacttgggaggctgaggcaggagaatctcttgaacccgggaggcagaggttgtggtgagccgagatcacaccattgcactccagcctgggcaacaagagcgaaactccacccaccccacccccccaaaaaaaaattatctgagcatagtggcgcaaacttgtagtcccagcttcttgggaggctgaggcatgagaatcgcttgaacctgggtggtggaggttgtgaggagtcaagatggcaccactgcagtccagtctgagcaagagagacagactctgggtcaaaaaataaataaatacataaaataaatcgcatgggacgaaaggtttcatgggtagaaaagcatataacagggaaatctgttattatttatatattgtaatcaccaacagaaacgcgtcttctaacggcatatttccttgcattttggttctcatatttttgtaaaaaacaaagaaatgaaaacaaagtgcccttatggtactgttctgaactagaagatttgaatttcagggccgctaggagagtttcctctgccccccttttaaaaaatgtcttcaggcctaacaaatgataacatctattgttatgaattttttttccttccacagtgtgaccttggagatacctcatcatatcacacaaaggtgagctttttagaaacctgtcttgttattctagctaattactttgcaagatatcaagctcagtgttaggtcacagctctagacatcataagctgtattgtgcctactaaaatatcgaagcaaattatttgtattttctttgttccttaagactctcataattcttaaatgactgagaatctcaaagagtatgtgtttatattgattatattgatatttagtgtggtagaattatacagttgaaattttttcaaaatctgtttttagtttagatttcacagccttaccactgttgatattatgggctagataatgctttgttgtgaggactgtcttgtgcattgcagagagtttagcggtattcatggcctctaccaactagatgtcagtagtaacccatgacccaggttataacaacagaaaatattccttgagaacagtattgttaacagaaatttttcattgaaaaataacttttctacaacaaaaagttgagtaaaaagtgcgtcatgtatttatattatttgaagtctctcatgttgagcttaataggagacaaatggattctctagagctttctttgcaatttgctttaaagaagcaataagaggctgggcacggtggctcacgcctgtaatcccagcactttgggaggctgaggcaggcggatcacaaggtcaggagatcgagaccatcctggctaacacggcaaaaccccgtctctactaaaaatacaaaaacttagctgggcgtggtggcacgcacctgtagtcccacctattctggaggctgaggcaggagaaccgcttgaacttgggaggcggaggttgcagagagctgagatggtgccattgcactgcagcctgggtgacagagcaagactctgtctaaacaaacaaacaaaaaaagcaataagctggtggggcgcagtggttcacatctgtaatcccagcattttgggaggccgaggtgggtggatcacttgaggtcaggagtttgagaccagcccgaccaacatggtaaaacccgcctctactgaaagtacaaaaaatggctgggcgtggtggtgcatgcctgtagtcccagttacttgggaggctgaggcaggagaatcgcttgagcctgggaggtggaggttgcagtgagccgagatctcgccattgcaccccagcctgggtgacagagagagactctgtctcaaaaaaagaaaaaagaagcaataagatgacctaacctcatgcaaatatgtagttggtagaaggtgtatttttaaagttttcagacagttgtgggtatttgttaacactaaatcaaaacttcacaagtggtggtttcttaaattagttacggtggcattttacatattaataaatttattccatcagtactcattgatctttcttgcacagtaaatggatcttttgctccatacttgtatttataatatcatgcattagttacttggaatatattggtttatgttttattgtgtcaaaaatcacttttagttgaaccaccaatcttactttaacacgcctttaagtattgaaaagctgccaagcctacagtagaaggaacaagtttttcaaagtccagaggaaagcttaaattttatcattgggaacaaatacgtatttcccttgaagtgacaacctctcacttcatttatttttgagaatgatagttgaactggttttttagaccgagtttcactctgtcacttggctggagtgcattggcatgatctcagctcaagcaatcctctcacctcaggctcctttgtagctgggaccacagatgtgtggcaccatgccaggctaattttcttatatgtttgacagtgacagggtttcgttatgttgcctaggctggtctcgaactcccgaaggagctcaagccatctgcctgctttggcctctcaaagtgctgggattttacaggcgtgagccactgcgctggcccagttgtacttttaaataaaaatgatgttctgtgaaaaaagtgatttttcagttcacagttaaatcacggattctttaaaaacaaaaaaaaaagcgcttctggttaactttccacttattcagaatattagagacatgtcaagatttaacaacattaatttttactgcttcatcaaagacgttcttacgaaattcaggctatgttttttacctgtaggggacagtgaagaatagaatgactactaatgtaattggtaccactgccttgatttatgctgagaaaccagccattgtacccacttttgcttttatataatcatggcaagtgtcaatgaaaaagcaggcaatgactttgtattactttcacaaatttttaaaatttttcatcagctttctcaggtttaattagtatgattcagaacagtgttggccaggcacagtggctcaggcctgtaatcccagcactttgggaggctgaggcaagcggattacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaaaacttggtctcaaaaaaaaaaaaaaaaaaaaaaaaaagaacagttatgacctcttaggccttctggaaggggtcttcgggatcccgagaggtccacacagcacatttggagaaccactggtttatacacaggcacaatgcattagttttacaaagtttaaagttcatcaaagactggcctcttaaaaaggcagatgagtttgtcattcaaacaacagaaagtacataaatacatcatgagagtatactacagagaactaaagagaaaggaagctaggaaatctgaatcacatttacatttattaaagtttactactactgctttgtagaacattcttgtgtttcaatgtgtggttagaagagtgaaaatatgtttggtttattgccatggcctgttagggagagtcaatactcacgggcatttctgactggttatcatataaaagacttcacgatacaggccatgatgtgctgagaaagaagaagtcaggaaaccctctgcaagtcaggatccaatagaagaattcataaaaactgctttggtaaagtaaacaccaaagcacacaggaggcagtattttactaaacaaatattatactaagatattaacagtttttgaagtaatgcgctttcttattttatagagatgcagatagaactttgagcatacctgatgaacagttacactcatttgcggtaagtggcacttttattgaggttgtattttcatcatacacttgtatctgtttcatgctgaagtcaaagccatctttttttaaatcttccccatttcatgttgcatttagtcatcttaagtgttgtaaaaagaatgtgctggagtaagaactgatctgcagctctgtttagttagtgagctagtatgagtaaatatactatccaaacaacagaagatgtatctttttttttttttttttttttatggactctctttctgtagcccaggctggagtgcaatcgcgcgatcttggttcactgcaggctctgcctcccaggtccctgttcaagcaattctcctgcctcagcctcctgagtaactggaattacaggcatgtgccaccatgcccagctaatttttttttcttttttttttttgtaaagacagggtttcaccatgttggccaggatggtcttgaactcctgacctcgtgatccacccaccttggcctcccaaagtgctgtgattacaggtgtgagccaccatgcctggcccagaaaatgtatctttttaaaaggtaattgtgagctgtctataggaccctgcaagccactacccaatttttgaagccattcctcctcctgttccacacaggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggccacattgcccaagtcacacaggcttctgtattatgtatttagataaaatgtgtgaaaacatatttgaaataaagttcataa

SEQ ID NO: 38719 - DNA, 31988 bp, Homo sapiens
gtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctggggacaggatggcaggagcgcccatggctgctgctgtacagcctgctgaggtgactgttgaagttggtgaggacctccacatgcaccacgttcgtgaccgggagatgcctgaaggtgaggaggtgataggtgccatctaccctcggtttgcctctggctgctactgtccccaaggttccctttgaggcatcccccacttcgagctcctttctgcttgtagccagctttcccgggagctggccaggaacaaaagctggctctgccttgaattcccaccccttagtatttccccaccgagtccagtcagtttcttttcgcctcccctcccaatcgcccagttcttgctctctcatctcattctcccaggctggcatgggaccatttatttatggctcttgtcgaataagcagcagttgaataaatgagttgataaatttttataaatgattacatcttttttcttttctccctctatacatatagctttggagtttaacctttctgccaatccagaggcaagcacaatattccagaggaactctcaaacagatggtgagacaacagtgtctgtagctctgtttattatcctgtgggactttgtttaggcttctttgagctattctcttccttttctcaataaaaactcaaatatcccaacttttcagtacccatcttattttttctttgtacctatccagatggtacctaagtgaaggaaccaggtaagtgcctaattgtttcctttgttaaagtagccaaatctcaagacagttcctattcaaatatttggggatttcttatttaaaatcagaatggagtttgccatgggagaggctatatggtattcttaatgggctgctttaagtcaccttgatagaagctgcttagtttcttctaactgtaatttgaacacagaaggaaaaagaaaaaaggagagtgcttaaaataattgtgaaaggtgtgaaatgtcacagccggggctgcagaaaaatggttgtgtgtgtgtgtttggggtttctcaaaggagtttacctatgaagctcttttctgttaaagttcttactttaacagaaaatgtgtctccagatttattctggtgacttaacagactttatttacctccttgttctaaaagagaggtggggattggttcatggtcaaaactttcaaaagacatgaaacgtcaatgtagactttcaatgtgtaatataaagattgcaggttaaaatgtcagaccttccctgtaagagtgtttgttgccatggctccccctttgtcccttcccctcctgacaatagcatcttgttcaaagataagaaagttacagttttggctgggcttggtggctcacgcctgtaatcccagcactttgggaggccgtggcaggcggatcacctgaggtcaggagttccagaccagcctggccaacatggtgaaacgctgtctctactaaaaaaaaaatacaaaaattagctgggcgtagtggcacatgactgtagttccagctactcacaaggctgaggcaggagaattgcttggacctgggaggtggaggttgcagtgagcagagatcacgccaatgcactccagcctgggtgacagagcgagactccgtctcacaaaaaaaaaaaggaaagaaagttggagttttttagtctctacactgctggcagaggcaggggatgggagccggtagaaaagagaaaacaattagttcgtttgcctctaaaattttgcaaagagatgaatctaagtaaaagtaattctgggtaataatatggttcttgaataaaaactgaaattttcaaaatagaaaacattgcatcataaacatattacatccagtaggcttattgttttcatttaaatgccagagatttcatcactgtagaggaaatgtcttatagctcttctatttaaactttggttgcgctcttaatttttaaagaggtaggataattaagactcattatgagtgtgactttgtaacttggaagtactatcttcacatttcaagatatttaaggattgctttagaataaacaaatgtattatgtgaattaattgattgtacctttatacacaaagcatgtaagtacttgtgtaaacttatactctgcttggtgatgttcggaaagcctgatggatgttacacaccagttagtagatgggtagtgttggatgagagcccaaaaatggctctttattgtcattctttaggattacaacacagtttatgtatgtctcacttggccctttccaatacaaataaggcctgtgtatgttctccctatgtgttgctaacgaagaaatgaaaacttagagatatcacatgactatggaagacagctactcaagagaactaaggttctgtgtcctcagaatgaaatggaagtgacagatatgatgaatttactttttaaaaattttaaaaactctagaatacatcttatattttgcctataaaatagacctgtcttttaaaacttactgccatcttgatttattttatgcaaagttgattttacacaactcaaagccaaaatttacctcttctttttttttttttttttaaataaaggagggtgtcattatgttactcatgctggcctcaacttcctgacctgggttcaagtgattttcccatctcagcctcctgagtagctgggactacaagcatgtgccatcttgcctggctctctcttatgtctatacattcatttcaatggataagaatcaaagtagagatagtgaaatagcctaaatgcagcagtcgaataaacgagttgataaatttttatcaatgattacatctttttttcttttcttcctctatgcatatagctttggagtttaacccttctgccaatccagaggcaagcacaatattccagaggaactctcaaacagatggtgagacgacattgttttttccaccaagagaaagaataaaagctcttgtttgatcaggttatagaaagtatttagaaaaactcatattggtttaaaattttcatcttttcacatgttcccttgtcttattttaatatgtgatatactttcctttagttgttatgatgttagtgaaaacgtgtaacctttttgtttatacattttgccatctttttatcaacacaattaatttgtgatgtgatggaggagtcatggatttctctttataattcttggatttatctttatttataattaatggattcatctttatttacaatcccttttcccttgctccaaaaagtacattttaaagatgaatgatagaacttcagcttggttttcatttaaacaaattaaaaaacatagtcgtttatcatcagggattgaatctgtgatttgggcctcctcttacacagtcctctgaccacattcatttaccacatccaagtttacgctactcaaaagttttaggttattaactttttcatttgatataatgtaaatttaaacatgccttactcctgcttatttcccttaatgttatattaaatcctcatttatttgccaacaagccatacacagccaagttttccagttgacttaaacagcaagaacacaagtgagggttctattataatgtgcgaagtaatgcagcacagtaaaacacgggagtttgtaacctttgtttttatagtttgagtagactttgcccatcttgagtcagttatttctggttagaatttgtcttcattttttacattactataaagagatacctaaggctgggtaatttataacaaaaagaggtttaattggctcaaagattttcaggctgtacaaacatggctttaacatctgcttctggtgagggcctcagcaaacttacaatcatgataaaaggcaaaggggaagcaggtggttccacaccgtgaaagagggaggagagaggggaagggggaaggtaccacactctttttttttttttttgaaatggagtctcactctgttgcccaggctggagtgcaatggcacgatcttggctcactacaacctccatctcccaggttcaagcaattctcctgcctcagcctcccgagtagttgggactataggtgggcaccataacacctggctaatttctgtatttttggtagagacagggtttcaccatgttagccagactggtctgaaactcctgacctcaagtgatctacccgcttcagcctcccaaagtgctgggattacaggcttcagccaccgcacctggccagtaccacagtcttttaaattaccataatgagaatgtgcttattaccatggggatgggaccaagccattcataaggaatccactgccattacccaaacgcctcccactaggccctgtctccaacattaagggtcacatgttaacatgagacttggaggggcaacatatccaaaacatatcagaattgtatttcccagttccttccagaggcatgggcttctcacacctagagagcatggaagcagtaaaagaaaagctattccatgtccctcactcttcagtggtagtaacttttgcctacaaggccctcccagcatcaaaggcagaggcagtgtaggaaacaaagcatggcccaagtccctcttggggcttttattattctggcctctttttagggaaaaaaaatgattttttgtgctgcagacaccatgtccaattaggtttgtatacttattttaacatcaaaatttaggccaggctctgtggcttacacctgtaatcccaactctttgggaggttgaggtgggtggatcacgaggttaggagatcaagaccatcctggctaacacagtgtaactctgtctctactaaaaatacaaaaaacaattagctaggcatggtggcacgtgcctgtggtcccagctagtccggaggctaaggctgaagaattgcttgaacctgggaggcagaggttgcagtgcgctgagatcccgccactgcactcgagcctaggtgacagagtgagactccatctcaaaaaagaaaacaaatttaagataggttactttccagttgtgtaaagaccattttttaattttgttttgtttttagtgacatattagtagataaccactaagtgtggttcaagatgcttacagggattctgttgcatctagagataggtgtctggtcaggaagtagtttttagaactgttagctcttagagtctgataattaaagtaagctatgtgtaaatgcagaatgagagaatactaatggatcatggctcatatatgcaacagttaaactttttattagctaaatttttcatctggcctaatttttttgcccttttcttttgtacatgaggattctttcatttgtgtgtaatagaaacaaaaagtaaactaaatgaaaatctaagtttttagatttgacttatgaaattaatcatgccagataatttaaattatatgttattgaaaattttttttttaatggaattttgtctcatttttcataggagtaatcagtaagatgttaacaactacttttattttatggtatttgtatcagaagtgaccagtttttttttttttattcttagttgtagaaataagaagaagcaactgtacaaaccatgtaagtaaacactcaaatagttaagaaattgatagtttgacataaaaggatgtctctcttgatttctttaaattacaatgtggacctggtggtggtagcatggacctctttttgtggattttctaaatctcttctattttcctgagtattaaatttatccagaaaagtgcttagtttagcgtgtccaccttttaaagatttctgacatttaagttaaatttcaatagtccggttcaaaagatctgccttaaggctgggcatggtggctaacgtctgtaatcacaacactttaggaggccgaggcaggctgatcatctgaggtcaggaatttgagacaaccctgaccaacatggtgaaattctgtatctactaaaaatacaaaagtagctgggcgtggtggtgcatgcctgtaatctcagctactcaggaggctgaggcaggagaatcacttgaacccaggaggcggaggttgcagtgagccaagatcgcgccattgcactccagcctggacgacagagcaaaactctgtctcaaaaaaaaaaaaaaaattgccttaaatatttaatcttatttttaatgaaagaacaaaaatagaatagctaagttaattgccagcactgtctattgactttctgtcacagcaggtaaaagcataccttccccgctacaccatgatcttatgtttctccctgtgtttcttccaattgtagcacactttttaattaaatcagtaatatttacatgattatgactctgcaaatattattcactgctaagtcatatggtgttttcactgtgcctctgcattccatgtccttcatcctgtctctgaaacagttctgaaatctgagcacttctgcaattctcctggatcttcttttttcctagcctacgttagtttatctatccaaatatcgttaagtagcctctgggtgctctgtttgctttcacatccattattttttagcatgaagctaattttctgactatattcatttgcctgttttctaacagctgttttcccccaagtattgtagcatttatcacatgcctttcaaagatattttccatctgcgaaaacacatctgttcctttttatgtttgtgtggggggcaactttctttggccttttgtcatcctagttcaatatagcgtgggtttccctagatatgctcaatgtctgcttttctgggctaactctttaaagtcttttggtatctcatgtaactgctgtcttgtgtgggatcgcctgagtcctagattctgtgtttccttctgtcctgttatcgtctctagttgtacttgaacacattttcctgtgtggagatgttaaaatccctcctctttgatagagagtacacctctaggttgaatctaaattgtatggttctgaagacattttgcagttgtgctcttattacagtgttgttcttgaatctattgccagtgtgtgatatgttatttacaaccaggttttagttatctgcggaagctttttagaatctctctctctaaggttctgaaattttataacagcttgttggggatcttttcattttattgaggctactaaacctgcagactatctcttcttgagaatttttttttttattttctctgttacttttttactgatagtcttgttattcagatgctaggctgcttagaccagtacgcctgcattgatttttaatttttccccttgtatttttttcagtttgtctttttattctagttctgggatattctgtgactttatcctctactatttctattgaattttatattttttgagagtgttttaagatttttttttaaagttttgctcctgattttgactggtcctatcaattccttttttctattgttttgatctcttttcttggaggcttccctccaatgtgtggtggttcctggcctgctttatttggaagcaggatttctgttaactgatagcactcagtgtgaggccttagaagcctgactagcttttcatttgggagacctcagtgtattatctggggatcttttttgaagacatttcagtttcttctgagaaggatctcccagttttctgcctggaaagtaaaagcaggcctggaaaggaaaagcagagttagcgaagaaagttggagttccatttttggtgtacagttttctttatatctcaggtttaagccatggtatctctgagccagaaattctcaggtttgatatatccagagaacacacatctaagtttcttgtcagatggaaggacaggtggacttggggctctagttagagatttgcaactgaccttgctggcttttttttttttttcacattttaccctactttccaaagtgccatttgcctgtaagttcacaacctgcctttagttctgcaagacaaactggctcgcttctgttccagtcactttctgtaggcaccaaagttgtgtttctgtgttatttaccactcctttatctactttttatgtctcagcatttattaaaaattatctctgtcaaccttctgtgctggtcatgggtgtaacctttattttatgactgatgaggcttccggagggagacgaaataaatttgtggtcaatctattatatttaatccaaatttaggacctgtgtttaaatcaaagtctaatttgagtataattaatgatattaagccagagaattttttaaattaatgtatctataataagcatattacacttttctcctaaggccttgtttaatattttcattcaaagtttatccactgccatatacttcccattacttcacaacatagatggagctgttttcctgaatgcccaaagtgttagaaatatttaagttaattaagatttgttcatttttagcctggtcaacatcgcaagtcctcatatctacaaaaaggttaaataacaaattagccaggcctggtggcatgcgcctttcgtattacctactcaggaggctgaggcagaggatcgcttgagctcaggagtttgaggctgcagttaactataattgcaccactgcactccagcctgggcaacaaagggagaccctgtctcggaaaaaggaaaaaagttactaattctttaaaaacctatctaaaatttgtcctgcccaaaaggagagtgaaaaatatgaactttagtctttgttttattttatgtttgctgagaaaaatgctgtactttatttatttatttattatttccataggtttctgggggaacaggtggcatttggtgacatgactaagttctttagtgatgatttgtgagatttaggtgcacccgtcacctgagcagtatccgctgaacccaatttgtagtcttttatccctcaccctcctcccagcctttcccccaagtccccaaagtccattgtatcattcttatggctttgcatcctcatagctcagctcccacgtatgaaagagaacatgatatttggttttccatgctgagttatttcacttagaataatagtcttacttccatccaggttgctgggaatgccatgaatttattccttattatggctgaggtggtattcctcatatatatatatatatgtatgtatatcacggtttctttatccactcattgattgacgggcatttgagctggttccatatttttgtaattgtaatttgtttgagttcctcatagattctggataatagccctttgtcagatgtatagactgtgaagatttcctcccactctgtggttgtctgtatactctgctgattgttccttttcctgtgcagaagctctttagttaagtctcacctatttgtttctgttgcatttgcttttgtgttcttggtcatgaagtctttgcctaagccagcgtctagacgggtttttccaatgttatcttctagaacttttatggtttcaggtcatagatttatgtccttgatccatcttgagttgatttttgtgtaagctgagagttgaggatccagtttcattctcccgcatgtggcttgccaattatcccagcaccatttgttgaatagggtttaccttcttcactttatgttttaggtggctttgttgaaaatcagttggctataggtatttgagtttatttctgggttctctattctgttccattggtgtatgtgcctatttttatatcagtaccatgctattttggcgactatggccttatagtatagtttgaaatcaggtaatgtcatgcctccagatttgttgtttttgcttagttttgttttggctgtgccggttcttgtttggtccatataaatttcaggattgttttttctagttctgtgaagaaggatggtggtattttgatgggagttgcattgaatttgtagattgcttttggcagtatggtcattttcacaatattcattctacccattcatgagcatggggtgtctttccatttgtttgtgtccatgacttcattcagcaacgttttgtagttcccaacggcatatcaaaaaataatcgggccaggcacggtggctcacacctgtaatcccagcactttgggaggctgaggcggacggatcatgaggtcaggagttcgagaccagcctggccaacatggtgaaatcccatctctactaaaaatacaaaagttagccgggtgtggtggcgctcacctgtaatcccatctactcaggtggctgaggcaggagaatcgcttgaacctcggaggcagaggttgcagtgagccaagatcaccacactgcatattccagcctgggcaacagagcgagactccatctcaaaaaaaaaaaaaagataatccaccatgatcaaatgggtttcataccagggatgcagggatggattaacatacacaagtcaataaatgtgatacaccacataaacagaattaaaaacaaaaaatcacatgatcatctaaacagatgcagaaaaagcatttgacaaaatgcagcatccttttatgattaaaaccctcagcaaaatcagcatacaagggtcacagctcaatataataaaagccatctatgacaaacccacaaccaacatgatactgaaagggggaaaagttgaaagcattccccccgagaactggaacaagacaaggatgcccactctcaccacttgtattcaacatactactggaaggcctagccagagcaatcacacaagagaaaacaataaaaggcatgcagatcagtaaagaggaagtcaaactgttgctgtttgatgatgatatgatcatatacctaggaaaccctaaagactcctccaaaaagctcctagaactgataaatgaattcagcaaagtttcaggagacaaaattaatgtacacaaatcagtagctctgttataccccagaagcgaccaagcttagaatcaaaccaagaactcaaccccttttctgatagctgcaaaactaaactaaactaaaataaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgacgttagagtgtttgtttctattttgtgactaccttaaataatacctataaagagtaaactgttagtagtgtttttgctgtaattaaatgtagtaagacttaccttccaaatgataactgaattgtcaaacacttgtcgaagttttggatttactcaaaattctatgctcagcagctggaggtaggaagagtaagggccctcccttactcttatggagaggcatactttctcacaaggggaatactctgcaggaattagcatcttgtaagcagtggtgaattcaactaattagtgtataaaaatacattttttggtgtggctgccgacaaagagatccaagagggtagatggagtcgagcttgctgaagcaaggaaagagaaaagcagtattctaggcagagagcaggggtagagcaggaaaatggctaggtgcaggtcagatgatttatagaatgcaattgatcaagttttgaagtgaatgcaaagtattctccgagagtctcatttgagtcatgtcttggcagtcttatttaaacatgaagtgaaagttagattttttaagttgtcatttgttttcagggtgtgagagaatatgtaagtgatactctttttatcctccacataagaaaataggactagagaaacctatggcttcctcacttgttggtggcctagcagccctgacacacagagcctctgaatctgaaacacttcttttgtaacaatatcacctgaaataatacatttaggattagtaatttagtaaatgcattagtcttgtattcactgcaataaaatgctcttgtagcaggattatttaatacattacattttatcgtagtaaataaataatagaagggctgggcgccgtggctcacgcctgtaatcccagtactttgggaggctgaggcaggcagatcgcgaggtgaggagatcgagaccatcctggctaacacggtgaaaccccgtctctactaaaaacacaaaaagttagccgggcacggtggtgggcgcctgtagtcccagctactcaggaggctgagtcaggagaatggcgtgaacccgggaggcggagcttgcagtgagccgagatcgcgccactgcactccagtctgggcgacagagcgagactccgtctcaaaaataaataaataaattaattaattaatagaaattctcagctgctttttattgctgcagaaaaaaaaatgaaatcttattttaaacttttcttttttttttttttttttttttttgaggcggagtctcactttgtctgccggcctggagtgcagtggcgcgaactcggctcactgcaagctccgcctcctgggttcaccccattctcctgtttcagcctctcaagtagctgggactacaggggcctgctaccacgcccggctaattttttgtatttttagtagagacggggtttcaccatgttagccaggatggtctcgatctcttgacctcgtgatccgcccgcctccacctcccaaagtgctaggattacaggtgtgagccaccgtgccccgcgaagccgacttttcccattatttttaacggtaattcataaaatccttgttaggtttgatgacaggtaccatattaagggcagcattttataacccatatcttaaacatcatctctggaagttgagagcctccaatgggttttctatagagtgcacatgataccacactcaggcatttcatggagtgtaagacatatcttagtgctttgtcatttgacattttaactgagaaaataatacactttgataagtttgacttacacttcccttccccttcaggtatctactgtgcgtttcagtcaacaatacagcttgtgttcgacaatattccttgatgacagcacagccatccagcattatcttacaatgacaataatatcgtgagtacaactatgctgccgagggacagattcctttattctaaaattatttcagtcatttggttgtccttttcagcaatcagtttaagaaattggagtcaaccatatattgatatccagattctgaatattaagtatcagtttctcttttaatcttagacgtcgtggtggaaggaaaaatcagttagcaaagaagcaatcccagaaacagtgtatctttttgatgcctttatgcctttagacaatgttgaacacagtgagaaggataggttccctttattgaatgttttttgtggaaacttagtttttcaatgcatcataggcctaaatcagtgtgcactactttggacattatccttggaagaaggaacagcttttcttcttctggcaccacagtgtatctgcatttgaatttctcccattgtgcatgagcacctcgtgggccacaaagatgcgctttgagagcaccctgagatgaagtttattttaaaaggaacaacaaccaacaccaccaccagctccacaggggctgtccagtgtacattattctcatcttcttgggttattagtcttgatttttagaacacagtttggaaagtgctaatttagaatattaatgtctttatctttaatttaacttttcattctgtacacataactagcttataaacaattttgtttcaaatgcactagcctttttaactaattcaattgtcaataacttttacttcaattaaaagtggaaagtttacactcataataatgtcactttcctccctcccttttaacaatagttgagaggaaattgtgtttcgaacaaaaactggactcaaactctgtctcaagtcctgagctttgggacctattgagtaatcactaaatgtctgtagtcagctaagtctcttaaatctctgagcacacatacacaaaaattactttgactagagtccctggcttcttctgagttccaaagattttgatatgttagcatataattcaaaagcagctttgaagattaattttgctgaaacaaatttcgtgcttttttcctcattattctactttttagaagtctacttttgagagtatagtaagttttaatttgccaccagcaagtttgagaaatgatcatttggtgtattcactattggtgaaataaagttattgaacaaattaatagggcaaattggcttcaagaagatattttgaaaaatgttttatcatgaatcagtagtgcactgttgtcagtgggataggtggaactcgctgagatcacttatgcaaggtttttttcaaaatacaagtctgcaaacacatgtatcttcccatctccactttccctctatctctaggcactgagaagccttttaggaaaatcgggatggatgtgaggcatctttctgtgaagaaaagcatcccagaagattctgattttcaccccaactcaatcattccaaactttgctgctgattgaaatcacctgggaaatgtttaccaagaaccttgatgcccaaagccatacccaatactaattaaattaaaatgtctcatgtggaagatgaggcagatattaaagcttctcaggcgattttaatgtgcagcaaagtttgacagccactgcttaatttgagtttaggacgagaaactgctccaatttggtgggaccttgggcaagtcagttttaaggtctgtttccctgatctgtaaaacgagtgttgaattaaatgtcacataaggtcattggtcctttccagcatgtaactttaaattctgtgattttaaaattatttcagagatgaaaactacttgaagcactatagacatatccatcttacctgctaatgttacaggctttttaaaaagtgctaatattgtgtagacctattagtagaattgagatttgccttccctcagttgttttgagcctcactctacaaaattagctgggtgtggtggcacatgcctgtaatcccagccacttgggaggctgaggcaggagaatctcttgaacctgggaggcagaggttgtggtgagccgagatcacaccattgcactccagcctgggcaacaagagcgaaactccatccaccccaccccccaaaaaaacattatctgggcatagtggcacaaacttgtagtcccagcttcttgggaggctgaggcatgagaatcgcttgaacctgggtggtggaggttgtgaggagtcaagatggcaccactgcaatccagtctgagcaagagagacagactctgggtcaaaaaataaataaatacataaaataaatcgcatgggacgaaaggtttcgtgggtagaaaagcatataacaaggaaatctgttattatttatatattgtaatcaccaacagaaacgcgtcttctaacggcatatttccttgcattttggttctcatatttttgtaaaaaacaaagaaatgaaaacaaagtgcccttatggtactgttctgaactagaagatttgaatttcagggccactaggagagtttcctctgccccccttttaaaaaatgtcttcaggcctaacaaatgttaacatctattgttatgaatttttttccttccacagtgtgaccttggagatacctcatcatatcacacaaaggtgagctttttagaaacctgtcttgttattctagctaagtactttgcaagatatcaagctcagtgttaggtcacagctctagacatcataagctgtattgtgcctactaaaatattgaagcaaattatttgtattttctttgttccttaagactctcataattcttaaatgattgagaatctcaaagagtatgtgtttatattgattatattgatatttagtgtggtagaattatacaattgaaattttttcaaaatctatttttagtttcgatttcacagccttaccactgttgatattatgggctagataatgctttgttgtgaggactgtcttgtgcattgcagagagtttagcagtattcatggcctctaccaactagatatcagtagtaacccatgacccaggttataacaacagaaaatattccttgagaacagtattgttaacagaattttttcattgaaaaataacttttctacaacaaaaagttgagtaaaaagtgcgtcatgtatttatattatttaaagtctctcatgttgagcttaataggagacaaatggattctctagagctttctttgcaatttgctttaaagcagcaataagaggttgggcacggtggctcacgcctgtaatcccagcactttgggaggctgaggcgggcggatcacaaggtcaggagatcgagaccatcctggctaacacagcgaagccccgtctctactaaaaatacaaaaacttggctgggcatgatggcacgcacctgtagtcccacctattctggaggctgaggcaggagaaccgcttgaacttgggaggcggaggttgcagagagctgagatggtgccattgcactgcagcctgggtgacagagcaagactctgcctaaacaaacaaacaaacaaaaaaagcaataagctggtggggcgcagtggttcacacctgtaatcccagcattttgggaggccgaggtgggtggatcacttgaggtcaggagtttgagaccagcccgaccaacatggtaaaacccgcctctactgaaagtacaaaaaatggctgggcgtggtggtgcatgcctgtagtcccagttacttgggaggctgaggcaggagaatcgcttgagcctgggaggtggaggttgcagtgagccgagatctcgccattgcaccccagcctgggtgacagagagcgactctgtctcaaaaaaagaaaaaaagaagcaataagatgacctaacctcatgcaaatatgtagttggtagaaggtgtatttttaaagttttcagacagttgtgggtatttgttaacactaaatcaaaacttcacaagtggtggtttcttaaattagttacggtggcattttacatattaataaatttattccatcagtactcattgatctttcttgcacagtaaatggatcttttgctccatacttgcatttataatatcatgcattagttacttggaatatattggtttatgttttattgtgtcaaaaatcacttttagtttaaccaccaatctttctttaacacgcctttaagtattgaaaagctgccaagcctacagtagaaggaacaagtttttcaaagtccacaggaaagcttaaattttatcattgggaacaaatacgtatttcccttgaagtgacaacctctcacttcatttatttttgagaatgatagttgaactggttttttagaccgagtttcactctgtcacttggctggagtgcattggcatgatctcagctcaagcaatcctctcacctcaggctcctttgtagctgggaccacagatgtgtggcaccacgccaggctaattttcttatatgtttgacagtgacagggtttcgttatgttgcctaggctggtctcgaactcctgaaggagctcaagccatctgcctgctttggcctctcaaagtgctgggattttacaggcgtgagccactgcgctggcccagttgtacttttaaataaaaatgatgttctgtgaaaaaagtgatttttcagttcacagttaaatcacggattctttaaaaacaaaaaaaaaaaaagcgcttctggttaactttccacttattcagaatattagagacatgtcaagatttaacaacattaatttttactgcttcatcaaagacattcttaagaaattcaggctatgttttttacctgtaggggacagtgaagaatagaatgactactaatgtaattggtaccactgccttgatttatgctgagaaaccagccattgtacccacttttgcttttatataatcatggcaagtgtcaatgaaaaagcaggcaatgactttgtattactttcacaaatttttaaaatttttcatcagctttctcaggtttaattagtatgattcagaacagtgttggccaggcacagtggctcaggcctgtaatcccagcactttgggaggccgaggcaagcggatcacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaaaacttggtctcaaaaaaaaaaaaaaaaaaaaaaaaaaagaacagttatgacctcttaggccttctggaaggggtcttcgggatcccgagaggtccacagagcacatttggagaaccactggtttatacacaggcacaatgcattagttttacaaagtttaaagttcatcaaagactggcgtcttaaaaaggcagatgagtttgtcattcaaacaacagaaagtacataaatacatcatgagagtatactacagagaactaaagagaaaggaagctaggaaatctgaatcacatttacatttattaaagtttactacaactgctttgtagaacattcttgtgtttcaatgtgtggttagaagagtgaaaatatgtttggtttattgccatggcctgttagggagagtcaatactcacgggcatttctgactggttatcatataaaagacttcacggtacaggccatgatgtgctgagaaagaagaagtcaggaaaccctctgcaagtcaggatccaagagaagaattcgtaaaaactgctttggtaaagtaaacaccaaagcacacaggaggcagtattttactaaacaaatattatactaagatattaacagtttttgaagtaatgcgctttcttattttatagagatgcagatagatctttgagcatacctgatgaacagttacactcatttgcggtaagtggcacttttattgaggttgtattttcatcgtacacttgtatctgtttcatgctgaagtcaaagccatctttttttaaatcttccccatttcatgttgcatttagtcatcttaagtgttgtaaaaagaatgtgctggagtaagaactgatctgcagctctgtttagttagtgagctagtatgagtaaatatactatccaaacaacagaaaatgtatcttttttttttttttttttttttttatggactctctttctgtagcccaggctggagtgcaatcgcgcgatcttggctcactgcaggctctgcctcccaggtccctgttcaagcaattctcctgcctcagcctcttgagtaactggaattacaggcatgtgccaccatgcccagctaatttttttttctttttttttttttgtaaagacagggtttcaccatgttggccaggatggtcttgaactcctgacctcgtgatccacccacgttggcctcccaaagtgctgtgattacaggtgtgagccaccatgcctggcccagaaaatgtatctttttaaaaggtaattgtgagctgtctataggaccctgcaagccactacccaatttttgaagccattcctccttctgttccacacaggtttccaccgtgcacattatgaagaaaagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccacctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcaaggccatggccctgcagtcgatccaaaacatgcgtgggaacgcccactgtgtggactgtgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacaagtgtgtgtagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggccacattgcccaagtcacacaggcttctgtattatgtatttagataaaatgtgtgaaaatatatttgaaataaagttcataaatatgcattgatttttgtacacatggcacctctttttcatttttatttttattttttttggacgatgttttgctctgtcaccccagctggagttcagtggcgtgatatctgctcactgcaagctctgcctcccggattcacaccattctcctgcctcagcctctcaggtagctgggactacaggtgcctgccaccacacctggctaattttttgtatttttagtagagacgtggtttcaccatgttagccaggatggtctcgaactcctgacctcgtgatccacctgcctcggcctcccaaagtgttgggattacaagcgtgagccaccgtgcccggcccatggcacctctcttaatttataaattgaactggatgtgaagtaataatgtcagttagttgagataagagggttacagattggctgggcgcagtggctcacacctgtaatcctagcactttgggaggcctaggcggactgatcaccaggtcaggagattgagaccatcctggctaacatcatgaaaccccatctcttctaaaaaatacaaaaaattagctggccatggccgggcctggtggctcacacctgtaatcccagcactttgggaggctgaggcagggggatcacaaggtcaggagatcaagcccatcctggctaacatggtgaaaccccgtctctgctaaaaatacaaaaaaaaaaattagccaggtgtggtggcgggcacctgtagtcccagctactcgggaggctgaggcaggagaatggcgtgaacccaggaggcggagcttgcaatgagctgagattgcaccactgcactccagcctgggcgaccaaacgagactccatctaaaaaaaaaaaaattagctgggcatggtggcgggcacctgtagtcccagctacttgggaggctgaggcaggagaatggcatgaactcaggaggcaaagcttgcagtgagcagagattgtgccactgcactccagcctgggcaacagagcgagactcggtctcaaaaaaaagaaaagaaaaagagggttacagatcattgcacatggaaaatattcccagcagtaaacacttccattaatgtgatctacagcttttaaaaaggagcatctcagaataagatggtggtacaatttgctgattgagaaagggaaaaaaaaaaacacatgagtatattacaaagggaaaagaaggaatgtgatttctcatgattgaaagcttgatttagattgcatacagcttttgctacccaagaccaggaggctctggcaagacagggttgttttccgaatgccagaccgaggtgccttatgaaggcagctgccgatggttccagatgtagagagataggtgatgcaggagggaaagctggattggaaaagggagagttttgtagacgggctacgctcattgtgcctttgaaagagcggagccggcagcctctagtcatcattttgatatacaggactagagcatgaatctgatgtagagctacagaatgaagagcaacagcagctgtttaaataccaagaaagtgtgtagaatgaaatgggacaagccaagcatggtgttttcatgcctttagtcctagctactttggaggctgagatgggggaattacttgagctcagcagtttgagtccagcctgggccagatggtgagaccctgtatcttaagaaaagaaaaaataagaccaggtacagtatctcatgcctgtaatcccagcactttgggaggccaagttgagaggactgctcgagtgtaggacttcaagaccagactgggcaataaagtgagacccatttctaccaaaaaaaaatcaagaaattagctggacatggtggcacatgcctgtggccccagttacatggcatggcaggctgaggcaggaagttcacttgagcccaggaggtggaggctgcagtgacccatattcatgccactgcactccagcctaggcaacagagtgagaccctctctcaaaaacagataaagtggacagaaaataggtcagtaaggactaatcatttaagggacaagcccccagaagagtggctactagagtgggaggaggaaaagcagaaggagaaagagttgaagataggcgaggctgtggtcccagtgctgaattctgccaagcagtgacttgattcatgaacactcactggatgctgactctgttgctcttctgagtgctggggtagaggagaggagaggtggagcacagttcttgcttttatgagcttatgttctaggaagttcaaacaagtattttttcaggtagtatgaaatagcaggaagaggaagcaggctaaagggacacagagtgattgggggctattttaagtagaatgataaggaagagcctgtctagagagctatttgaacagtgacctgactgaagggacaacagaaagcagtgctgacattacaggtagcaggatgactgccaagacagaaacgcatgtcatatgtgtttgaggaacaaacagcaaggtgaccagcatggggagagtgaagaatgagggaaaccttgaatgagaataaagcaattccatgttggatgctaatctgccatgttctgattaatcccagttccaagaattcatctacgatttctattttatctttttaacaaaattattttttattttttattttttgagactgagtctcactctgtctcccaggttggacttcagtggcacaatctcagctcactgcaaacttcacctcctgggttcaagcgattctcctgcctcagcttcccgagtaactgggattacaggcgcctgccaccacgcctggctaatttttgtatttttagtagagacgaggtgttaccatgttggccaggctggtctggaactcctgacctcaggtgatccgcccaccttggcctcccaaagagctgggattgcaggcgtgagccaccgtgtctggccatacacatccctgctgaagcccgcattaccctttccctatgctatagaagccctgggtcgggggggtgggggtgatggcacagggatccaccatcttatcttggtgccatccctgacttgccttctgttcataaacgcctattaaatgtttctttctgagaaactggatttgtcagcctctttctttggtatctcaggttccttggcctttgcagataggtttatatagacctgctcagcacaggacaggcagtttctcaaaaaattaaaaatagaattaccaaatgatccggcaatatcacttctgggtatatagccaaaataattgaaagcaaggtctcatagaaatatgtgtacactgatatttatagcagtggtattcacactcgtcaaaagatggatgcagccgaattgtccataggcagatgaattgataaaatgtggtatatacatacaataaaatattcttcagccttaaaaaggaaggaaattctaacacatgctacaacatggatgaacattgaggacattatgctaagtgaaataagccagttagaaaaagacaaatacggtgttccttcacttatgtgaagcgtccagactgagtaagcaaactaatagaaacagaaggtagaacgggggttgccagggacatggggaagggagaaaatgggaagttgcttagtggatatagagttttggttttgtcagatgagaaagttccggagattggttgcatggcaatgtgaatatacattacccaacccaagggctctccttgacccctgttccaactgccacttagaagtggttaaggtagtaaattttatgtgtattttaccactattcaaaatagaattattatttttttattataattttttgagatccctcactctgctgcccaggctggagtgcaatggcaccgtctcggctcactgcaacctctgccttctgggttcaagcgattctcctgcctcagcctcccaagtagctggaacttacaggcacatgccaccatgccaaactaatttttctatgtttagtagagacggggtttcaccatgttcgccaggctggtcttgaactcctgacttcaggtgatccgcctgccttggcctcccaaagtgctgggattacaggtgtgagccaccatgcccggctgtcaaaataggtgttttttgtttgtttgtttgtttttgagatggagttttgcttttgttggccaagctggagtgcaatggcgggatctcggctcacggcaacctccacctcccgtgttcaagcaattctactgcctcagcctcccgagtagctgggattacaggcatgcaccaccatgcccagctaattttgtattttattttagtatagatggggtttctccatgttggtcaggctggtctccaactcctgacctcaggtgatccacccaccttggcctcccaaagtgctgggattacaggtgtgagccattgtgcctggcctttttttttttttttttttttttgtgggtgtgtgtgtgtgtgtgtgtgtgtgtgtgtgatggacttttgctcttgttatccaggctggagtgcaatggcacgatctcagctcactgcagcctctcctcccgggttcaagcgattctctttcctcagcctcctgagtagctgggattacaggcatgcaccaccatgcctggctaattttgtatttttagtaggtatggggtttctccatgttgatcagggtggttttgaactcctgacctcaggtgagccatctgcctcggcttcccaaagtgctaggattacatgcgtgagccactgcgcctggcctgaaaaaaaattttaaagtttgagaaaatacaaaactttcatagtctccaagtatttctcctaagatctttccccctatgagggggaaagatagtaactttacaatggagaaatccagcagaaacctgaaccaaatgaacaagttcaacatcatcagtaagaagaactatcaatgccataactctgaaggaatgcactgggaaggattccacatcatttttgtgctgtaattgccaaaagtgtgtaacttcagtccaatcatggaaatacatcagacacacccaaatcgaggaacatttgacaaatagtgatcagtactggttcaagatgtcagggttatgaaagataaggaaagattgaggaactgttattgcagtcctacaaaacggcgagagactgagaaataactaaatgcagcgtgatcctgggtggaatttgggaacagaaaaaggacattagtggaaaaagtggcaaaactccaataaggtctttagtttagctaatatgttcatttttaaatagttaaataatttaaatacatttaaacgtcatttaaatgtatttaaattaacaaaattggttattttgtgaaataattttaatatagttaaatatgagaatgtggatttcctggttctgatcaccgtactgtggctatctaagatgtgaatgttcagggaggctgggggaggaataaatggaaattatactattgaattggaaaagagaaacctaccccatcagtcacgaaaccctcacattcatggcagtgtgtcggaggttccagtatgaatggcatttcccagatgtcagcgcaaggtccctgtggagggagtgggactccctgggaatctagtggagagcattcggggctcccttcctcaggagcctgcccttcctgcacagaagcgtcggcctcacctgtaccactgcccctctgcctctcagaaccaactcggcttcaggaaggttctactgccagcttcctttcccggatacagcctccagggactcagccctgccttcccaagtgttcctgcctctcttgggaagggacgctgtcagatcccgcacccctggacttccccgcacaccacctgttccttttttcttcacttctccagctctgcgttctcactctgagggtcctctcttgctgggagtgtgtgttgctggcaacagtgaagattccccctgggtggccccccatgccctgttcttctgcacttccctggcttcctgtgttggttctgctggtgtcacctgcttttgggtttacgtggcttcccagcttcctaatttctctgaagttgagtttgatgtgtatgttgatgatgggctttttcttcctccttctcctcctcctcctcctcagtcttgttgttgctctatatagtttccagaaggagaaaagggacactgtaaaattgagctgctgcaggctggacacagtggctcatgcctgtaatcccagccctttaggaggcccaggcgggcggattacctgaggtcaggagttcgagaccagtctggccaacatgttgaaacctgatctctacccaaaataaaaaaattagcaatgtgtggtggcatgtccctgtaatcccagctactcgggaagctgaggcaggaggatctcttcaacccaggaggcagaggttgcagtgagccaagatcacgctactgcacttcagcctgggtaaaaagagtgaaactccatctcaaaataataataattaagctgctgctatgtttctatcagacccagaaatcccgcagagtgagctggaattctctgtttctctgtttcccctccatacccactggctcctctctgcccactccctcttggactgcatcaccaaggttcctcactgtctggccctagtggaattcagacagtgggggatgtcataggaggtgggagagagaggagaggtggttattcactcagattcttccttgctggtttgccagtggccacatctttctagtgatggctgcagctcctgatgatcctcccctacagccacagctctcttcggggtctgtggacacctttcctgtccctctagacccagggagataacagctcccactcttgctggtccagggcatttctcatctctcattggttcccttaactctgtccacacttctgtgaacagccccttttcctcaagtacccattcgaatatgtcctctggcttccaccaggagcctgactgatacccacaggtgggtgaatgctggcgtgcttctgggccgaagcatgttttgtatgcagaggtcagcagctgtgtgtggggaggcccagccaggccccactcatgggtcatcatgtgaaaaacagccttgcctgagtttgtgtcctctttctacatggcagcagatgtgtattttgtttttgactctgcagctggtgataaccacctgctttaacctttcactagcctctgagttttctatgattcctgttgggagaaaagctgagtgttggtagagaagctgaggcagggcttgcatgtctgctagacttgctggcttcttgattccagcattcccattatctcaagtagccatatatttctcattcacttgctacactgtttcctttcaacctccacatcctcaccacctgtttctttgttagatcaccaataaatagcatgggctcccagagctcagtgcctttgcagcctccacactggcaatggccccctggtcccactttctctcttgaactttttctcattcttttgactccgcgggactttgttgcccccacgacctggtgttggctctgatcatcccaacagattcccattctaaagatgagggaaccaagaggtggaagggagagttagaataagaaccatttcttctgactccaaaatctttcagttctagcacactaccacccacactttaaaaaactctgaagtaggcagagaattccctcttgttggaggaattgctttgagagacatggttttactggatgaggctttggaaattaacctgaggcaggcgccagcacatcctgagagggatgtaatctggcacagaggcctagcctggtctccaggtctcagctggcaagacagtctgatcattgacattccaggctgggcagggccaaggggcttcaggggcccatgccctcatggggctcactgagcttgtctcccatcagccagtgtcccggcatctccaaatgaaggcagctgtgggggaagttccttctaatgagccagtctgtcctggctgggggtggcatcccggagccccaccttggatgtccagggacgtataggtccattgtgaggataaatgggtcagcactgagccctcaccctggactcaggggacatgagcctgctctgagccctctccctggactgggagggcattgggcttgctctgagccctcaccctggactcaggagggcagtgggcctgctctgagccctcaccctgggctgtgggggcagtgggcctgctctgagccctcatcctggactcgggggcagcgggcctgctctgagccctcaccctggacttgtctcctctgttcagttcatgccatggaggaagtggtgaaggaggtggtgggacatgccaaggagactggagagaaaggtacagctggctgaggtcgggcatggaaggagggagggaggaagggaagctaggtgctgggccaacctgttctttgactaaccgggtcaaactctgcacctaatgttgcagcctttcagagcctctcggctgggacagttatctatgttcatcagaggccacagactgtactatgttagggcactgtctagatggttctctccatggaatgataagaagacaaagtcacaaaagactatgtgacagcacactgggacaaaacatttaacatgtaaaattatatgttaaatgtcaaattgatgtgtgtgagctatgagtagaactatgtacaagcatgtgtatatctcattcctcttcaacaaaatagattctgggtagatgaaggactgaaatttacatacatgaatttattaacttataggagataactatcttagctcaggctattataaaataccataggccaggcacagtggctcatgcctgtaatcccagccctttgggaggctgaggcaggtgggccagctgaggccaggagttcgagaccagcctgaccaatatggtgaaaccctgtctctaccaaaaatacaaaaatcatctgggtgtggtggcacatgcctgtaatcccagctactcaggagtctgaggcaggagaatcccttgaacctgggaggcggaggttgcagtgagctgagattgtgccactgcactccagcctgggtgacagagcgagactctgtctcaaaaacaaaaacaaaaacaaaccataaactgggtgacttagaaacaacagaaatttatttctcacactcctggaggatgggaagtccaagatcaaggctccagcagatttggcatctggtgagggcgtcttcctggttcgtggatgggcctagttgtgtcctcacattgtggaaggagctagctctctgtggtctcttttatgtgggtgctaatttcaacctcccaaaggccccacctctgaataccatcacattagagctgaggatttcaacgtatgagtcttgagggggaagacatcataaacatttagacatagtaataacataagagactttggcctaatcttggagaggggagaatctttagaactatggaaaaaaaacccagcagccataaaggaaatattaaataaatttgacaatccaaaacttcaaaattttctatagccaaaaaaaaaaaaaaaatactataaaccaagccaaaagaaaaatcacaaactatgaaaaatatttgtaatagaaatgataatgcaatataacaacccaacataaaaatggccaaaagacataagcaggcattttccagaaaaaaaggataagcaggcaatgtacccatgagtagatgctcagtctcagagttgaagaaatacaagttgttggggaaattaaaaccaaattcaaattcattctgccaggagtcctgctccccttggtcccattgggccactccatggactaatccattaagatggccacatcccacaggccactcaaggggatacaagttcagtgggtggatcactaggacattcttcttctttctttccaacagccattgccgaagccataaagaaagcccaagagtcaggggacaaaaagatgaaggaagtcactgagacagtgaccaacacagtcacaaatgccatcacccatgcagcagagagtctgggcaaacttggacagtga

SEQ ID NO: 38720 - DNA, 34325 bp, Homo sapiens
gagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggtgagtgtgcgcgggcccgggcgcgcgcccgtgtcctgcgatccgggcttggtgctgtggggctccggggccgggaagcagcctgggcgcctccgccttggcctgcgttcgggccagacggcctgggttcggcgcggcgggcagcctgcggggggtccttcgtgcgccctggggcccctcccccgcgtgccggccgtgggagcggctctgacaagcctcctgggggcccgcggttggggagggccagactgatttatggggagaaggagatcccccatcctcagccgacctggacagttccagagggcggagactgagactgggacgagacagctgcccaaggccaaggccgtgtatggcgagacagctccagctggcgtgaaggagcctgggtttcaattctggcccagtccaggactggctccttgaccttggatggtacactttcttttctgggtcttaacgtcctcacctgtaaaatggagagctcggactcattgtgtctcaaggtttttccgccccgaaacttctgtaacaggccctcttagggtctcgtgttgtgtttttcacaaacaaaacaaaacctgacttaggaaactgacgaatctcagtgctgcacatagttcccggggaggctgggcactcggtgtctgcagagctgggggcctttgcgcaataggacttaagagtatgttcctttgcagatgctctctacgggctgaaaaagaggggagttgaccttgtgcaagatggatatctggaagttctggttaaaatgcagaatcagcagaggagacccagagaagctctagttttcctgcttagttgcaggggcctcaaggctgtgctcactccccctgctctgcctccaccctgctgtctgtctgaccttctgtgttatcctcgggctggtgcagggctgagctggatggggaaatggggttcaggacatatgataggcatctgcccttgaggtcttgccagcacccctcctgccctctgcagcttcctggttgaatgaggggctgcaaggtgaccacacaggctgccctgatgggcatgtcctggcctctggtccatatccctttctgcttggcactggcctctcttggctctcacctccacctttgccaagcccaggagcctccttcctccaggaagccttccggagaacccttcccccaccccaaccaaggtgctccctctcactgccttgttgcaattgtttgttttgtaattgtctttccctgagtttgtctttcctaccagatggtgatccctagcagggagggctgagtaggaacttcagattttatttccagtttcgtgctcaagatagcacagggcctggcctgagaaggtgcttaggaaatgtctgtggagtaaaaatgatggcagctatatttcttcaatgattcctacttgcccagtgctattttgagtgatttacatgtgtgaactctttaaacctcacaaccacctgaagttactgtcgttatccccacttacatgtaaggaaactgaggcagagaagtaacttactcaaggttacacaggtgagaagcggcaggacagggccggttacttttagctattacaggaaacagcctccaggtgaatggaataaagcctgctgattagtactttgtgagaggctgatggggccaagtagagtgctgtggtttcttctgaaagacattgcctcatggggggattttgcaacaaatggaaccttccacgcagtctgaaaggctacctgtgcaactccagcctgggcatggtccctcgtggctgctcggtcccccaggcctttttgagactctagtacagcttctctgggctgtaggcccctagctacgatgtcccttcgtttcttgtctggaacatggatctcagaattatatctgcctcaggggcctaagagatgatcaaatgaaggagggaagggcttcagtgattatcaagtgcagggcagagatccttgtggctatttttgttggtacaggaagaaagtaaggcgtgatgagagtgagaaacacttagcatatttaggagagtctcctgctgtgggccaggtgaggaggagaaggcccctgccatccccagagtagcatctcagggctgacttgcatttgttgcttgatcttgcctgggaaatgcagtctcccttgactcactcttttttgttttgttttgttttgttttgtaagggtgatttcatgaacattctcagagacagtcacactagagtgcagaggggcaagggcatggaaattatgggcttggaccctggagccagatggcttgggtttatctcctggctccatggctggtagcatagcctcccaaccttgggcaagtcactttacatctttgacctgcggttttttctcctgtaaaataggaaaatcatgttgaggaaaggggcctgtctggtgagccgagtactggatattatgcttgcatttccttctgttacatccccacagcagctataggaggtagacctctctatccccattttacagatgagaacagcaaggttcgggttgttaagtaccttgacagctaatgtcaaagagcatgtatgtggcagagtgggaatttaagtccaggttttctggctctaaagtcttcaatgttttcatagtttgctgctttgtagccttagagcccagtgcagggcagatacatgataattgttaaaggcttgtcttttacatagtcttggttgggagagggggctcctaagtgatcttccagagctgaaaatcggggccagcttcaggtgcatgcaatctgtgcagtcacacagggtcccccacttaggaagcccctcccatttggtttaatgctgtgctgtcgccatcttgaaattcttcattatttttgtagaagaggccccacattttcatttcgcattgggcccattctgtagctgctgctgtttaaagtattgagagaagtgaaaaatggtgagggcatgagagccctgttccccctctagggggcctgatcagtggccatcagcccttgggccagcttggaatcatgaagatgtgtgctgactggccacttcatatcttcacaaacatctagaaccatggcagcaaaagacgattctagtagacctttcaccaagatggttagttagcagggctggtgtgtcatcccaggggacataagcctgattttccttggtgaggggtgattttcaggcctgctggaggacacataacagaggtaaatgtgcaggttgctgctggagggagtggcactggaaactcagtttctcattaaggaaacacccatgacaggtgtcactgccttttttttttttttttttttttaagatggagtctctctctgtcgcccaggctggagggcagtggcgtgatctcggctcactgcagtctctgcctcccgggttcaagtgattctcctgcctcagcctcctgagtagctgggattacaggcgcctgccaccatgcccggctaatttttgtatttttagtagagacggggtttcaccatgtttgccaggctggtctcaaactcctgacctcaagtgatccgcccgcctcagcctcccaaagtgctgggattacaggcgtgagccaccgtgctgggtggtgtcactgcttttgctgatgaacgtgactgagtggttcctgctacgcctctcaatgacctggctgtaggggctttggagagtgtcctttgttcagatgctgttgtatgtcctttatatgtgtcatccattgatcctttgcggcaaccctgtggggagggtacccagatttggagagctgaagctgtctaagattaaaccacttgcccaagttgacataactaagaggtggtagagctggcttaaaaacatttcttttttgaggctagtcaagtgcagtagtgagaaggggagaaaagagtagaacaaggagtttggtctgtaactgactgtgaacacacaattgagataatgcactactttcagagcagcctagaactggcgtttaaactggttagtctgactttggagaccatgttcttcaaaacaaaccaccactgtctctgctagggagcctgattgcttgaatatctgggtatttttgttctctgtggctgctacttttttcttttttttgagacagtgtcttgctctctcaggctggagtgcagtggcacgatctcagctcactgcaacctccgcctcccaggttcaagtgattctcctgcctcagcctcccaagcagctgggattacaggtgcccaccaccatgcctggcctaatttttgtattttttaggagagacggggttttgccatgttggccaggctggtctcaaactcctgacctcaggtgattcgcccactttggcctcccaaagtgctgggattacaggcatgagccaccgtgctcggcctacttttctttttcttttttcttttcttttttttttttttttgagacggagtcttgctctgtcgtccaggctggagtgcagtggcgcgatctctgctcactgcaagctccaccccccgggttcacgccattctcctgcctcagcctcccaagtagctgggactacaggctcccaccaccacgcctggctaattttttgtatttttagtagagacggggtttccccatgttagccaggatggtctcgatctcctgacctcgtgatgtgccagcctcggcctcccaaagtgctgggattacaggtgtgagccaccgcgcctggcttctttttcatttatatttcctaccatctgattttgtttgtttgtttgtttttgtttttgtttttgttttgagacagggtctctctctgtcacccaggctggagtgcagtggtgcaatctcagctcactgcaacctctgccttctgggttcaagctgttctgctgcctcagcctcctgagtagctgggattacaagtgtgcaccaccacacccggctgatttttgtgtttttggtagaggtggggtttcaccatgttggccaggctggtctcaaactcctgacctcaggtgatccacccacctcagcctcccaaagtgctgggattacaggcgtgagccaccgtgcctggctgattttttttttttttaatgtgtattttgcagtgtcttacaggaagctacttgaaatcctgtgtgtaaacaagactccctgtaatgaatatacctgtcctgtgcctggttgcctggggcatcctctgtaagggaacagaaatcccaactgcctggcagtggggcctggtcagctcttgagttccctgtgggcccctggctgtgcctgagctggagaagacccaagaccagaagggaagttctcagtttgggccttggaaggttttagtttctcttcctcctccttctcctcctgggaatttttctcagcatgttcaaaaaggccaaagttggcaaaaagagtccgggtaactctccctggcctttggtgactttggccctggagacagcccctaggaaccccggcttgcccaggctcaggcctgaagttcttttttgtgctgttttctgaaggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaaggtaagatcatgacctttcattttccaccttctttctacctcatgctgaactggactcacagggcacagaagttcctttagataaggtcagggggaggtgtctttgaggccatattctgtcatttttaccagttctgtctcttggccttagaccaagccaccatcactctctgctgagcccctgctgtagcttgcttgttggtcttctcttttccatttattctttacatggcagccagagagctctttattatttatttatatttctgatttatttttacttatttagagacagggtcttgctctgttatcctggctggagtgcagtggcgtgattgtagctcactggagcctggaactcctgggctcaagtaatcctcccacctcagccccctgaacagctgggattacaggcatccaccgctacatcctgctaattaaaaatgttttttgtagagttggggccttactttgttgcccaggctggtctcagactcctggcctcaagcagtcctctggctttgccttcccaaagtgctggggttacaggaatggggcccagaggtttttaattttttattttttttattttttgagatggagtcccactctgttgcccaggttggaatgcagtggcatgatctcggttcactgtagtcttcacctcccaagttcaagcagttctcctgcctcggcttcccgagtagctgggattacaggtacccaccaccacgcccagctaattttcgtatttttagtagagatggggtttcaccatcttggccaggctggtctcgaatttctgacctcaggtgatccgcccaccttgggctcccaaagtgctgggattacaggcgtgagccaccacacctggccccagatatctttttaaaatacacatttagtccaaccatgtcagtttctgctcagtgttttccatggggcttagtgtgaaggcctgccttcatattctttgctgtgctgttttgcctcaggacctttgcacctgcattcccttctgcctgttgtgcttttcccttgcctcctttctcctgatgaatttctattcatccatcagacatggtggctcacacctgtaatcccagcactttgggaggccagggtgggcagatcacttgaggtcaggagttcaaacagtacttgagtacatgtttacctggccaacatggtaaaaccctttctctactaaaaatcagctggatgtggtggcgggcgcctgtaatgccagctactagggaggctgaggcaggataatcacttgaaccagagaggcagaggttgcggtgagccgagatcacaccactggactccagtttgggtgacagagtgagactccatctcaaaaaaaaaaagaaagaaaaagaatttccattcattcttcagaacttagttcaatatcccttccttgaagaatcttcctggtggctcagcctaagtcaggaccctctgatatattcctgtttctccctctagcatttatcatagtctgtaaataattatgtataaagtgttgaagtctggcttcttcactagagtgtaagctccctgaaggaaggggcttctgtctttttcatccctgtatctatagtacctagcacagaccttggcccatagtagatgctcaatcaatattttgttgaatgaaagaattaatgagtagctggatatgggcaaggggaaacagcatccagaattgtgggggcccacgggaatgtggagggttttttagaggctttgaaatttgactgcttaaaaacaaaggcttcttttgttactagtgttgttaggaaagcaatgtgtgtgtatatatgtaaggaaagcagtgtgtacacacacacaaaagtagaacaagatggaatgaaataatttttctatcagaactttgaagacattgcttcactgatttttggcacgtcagttcttgttcctttgtaggaaactgcttccccctctgcgcgtgcgtgcacgcgtgcacacacacacacacacacacacacacagacacacacatttttctttggtagctttacttagcctaggtgtaaaaacaagtatttttaagcggaggacttgctgttctcactttaaggaacagatgagagctggtattgccaagaatccaggaactcttggttcgaaaggcaaacaaagacatcctgaaggatctttgcattgcttgggcaaacacgtaattcagtgtacaacgacctagacctgggaatggttctgagtctccatgcgtggagtccaaatcaacgtggagttttcattcttgctgtggactggagagctggtctgagaccggatctgcttgactgcctgcatttttgcactaccttcccttcttgcttcttgttctcactttcattttccctgtttacaagggagtttcttcacttttcaaaggctcagttttcttttccatgctgatggtaccaagcttcgggggctcttggaggatgaaatgaaatcatgaatgaagcccaagcatagtgcctggtgcttagtaaatggctccacatccagaacctgttcttattgtctgcctttttttttgttgttttttctggttttcctcatttgcttattttaaaatttatttttaggctgggcatggtggctcatgcctgtaatcccagcactttgggaggcctaggtgggtggatcggatcacctgaggtcaggagtttgagaccatcccggccaacatggtgaaaccccatctctatgaaaaatacaaaaaattagccgggtgtggtggcgcacacctgtaatcccagctacccgggaggctgaggcaggagaattgcttgaacctgggaggcggaggttgcagtgagctgagatcgcaccattgcactccagccttggtgacaagagcgaaactccatctcaaaaaaaaaattatttttatagttttagttacttacttattttttttgagacaggatctcactctgttgcccaggctggaatacagtggcgtgattttggctcactgcagccttgacctcccaggctcaggtgatcctcctaccctagtctcccgagtagctgggacgacaggcacgtgccaccacgtctggctaattttttgtatttttttgtagagacggggtttttcaccatgttgcccgggttgatctcaacctcctgggctcaagtaatccacttgcctcagcctcccaaagtgctgggactgcaggcgtgagccaccatgcctggccagttttatcttttcatattttatttttatgaaataaaatatggaacaaggtgtgggagggtaaaaacacaaataaatcaatgttgcttgattgtaacttttgagttgtgacaagcttgcttttaaattatgaaaatagcagccagttattttgtacccatcttgtgctgagcactttatttttatcacgttaattatttgtaaagtcctttgcagtggatgtgtacgtcctctaagcaaggaaacaggcccatgggtttaagtttcctcctcaactttaccatgttagtgagaggccgagctccaatttgaactccaaagctatctagcttgtgttttcaccactcaccacctcgcctccttgtcccccaccacttccaaaaaaaaacaggagagagagaaaaaaagcaaaataaatttctttttggcaggaggtggaatttagaattctgtggaacccttgagatcagagatgatatcccagggtatgaaaaaagaaccttttcctctctgggtgcagtggctcaggcctgtaatcccagcactttgggaggctgacatggaagcattccttgagcccaggaatttgagaccaggctgggcaacatagtgacctcatctctacaaaataaaaaattaaaaaaaaaattagctgagtgtggtggtgcatgcctatgatcccagttacttgggaggctgacgtgggaggattgcttgagccttgggaggtggaggttgcagtgagccatgttagtgtcactgcactccagcctgggtgacagagtgagatgctgtctcaaaaaaaaaaaaaagaaaaagaaccttttcctatcttattaatttgtttatacaccaaacgtgtatttaatgtgcctcctgtttgtatcagatcaggggattcagtgatgaacaaaccagtgtgagagtgtatagtctggtggaaaagatagattttattcaagtaatttcatgcatatgtaatcaaataattgcatacataggtatttagcttgggcgagtattaaggagaagagcgtcagttatggtaggtttagcagaggatttgatcagttaggagtttagagtgtcaaggaggcctctctggggaaagtgaatcatgagctgggatacaaatgatgcatgggctgtaactgggtgaagctaggtagacgtgtcctagagagaggaacagtatatgcaaaggccctggggtgggggagaacatcatgttcagggactgaaggaggcgggtgtggtgagacatagaacgaggctgaggggctcaagctgagtctggcaggaggctagttttcctaagggctggaagaacgtggtaacaaggttggcttttgcaaagcaacaggaagcgattgaaagttttctcaaggcattggtgtcatctgatctgcaccctggccactgtgtggaagatgcattgtagaagtaaaggtaggtttgcagcagaagccacttaggaggctactgcagagggccaagggagaggtgaggatgccaggagggcacagagtggacagatgttttgtttgcctagttggcagggcttggtgatacattgggggagcagggagagagagggtttggataggccaggaatttcctggaaagtggagtgagtcatttggctttgaagactcaagtactgttcagagctagactggggtgacaggagttttggatcagcagacaacacacttatgctttaatctcttctgtcctgcctcattgtctaagcagccgccatagagaatatgccaaaatatccagtcctcagcagtgcatggctgaaacctgggatcctagaatcccagggctggaatctctcccaccccccagacctcctggctgctgaccagtggctcacagggccttgtactgtggtgcaaggagatctcgatccttttgtccagtttctctacttggaactgcaggcaggtaggtttggctttgtgctgctgccattcctccctggtcttgaggggatttcagtccagacttttctctccagctggtctcatggtctggcttcatcctacccttggagggcgggggctttggtagcagttgtgagcagcctgggttgatgcgtgttttttgagggaataaacacgtattttatgcttttgaaatgcggagtgtgttgcagccatacgtaggagggattacagtaaatcagtgtattagttttctattgctgctataacaagttaccactaacatactggcttaaaaccacggatttgggccaggtgcagtggctcatgcctgtaatcccagtactttgggaggccgaggcgggcagataacatgaagctgggagtttgagaccagcctggccaacatggcgaaactgtgtctctactgaaatacaaaaattagccaggcatggtggtgcatgcctgtaatcccagctacttgaaaggctgaggcacaagaatcacttgaacctgggaggtggagattgtagtaagctgagatcgtgccactgcactccagcctgagtgacagagagagactctgtctccaaaaaacaacaacaacaacaacaacaacaacaagccaaaccaaccacagatttgttatttatttatttatttattttgagatggagtttcattcttgttgcccaggctggagtgtaatggcgtgatctcggttcactgcaacctccacctcccaggttcaagcaattctgcctcagcctccccagtagctgggattacaggcacgtgccaccacgcccggctaatttttgtttttagtagagacagggtttcaccatgttggccaggctggtctcgaactcctgacctcaggcgatccatctgcctcggcctcctaaagtgctgggattataggtgtgagccattgcacccagctggatttgttatttcatagttctgtaagttagatgtctgacactgatctcactgagccgaaatccccttggtggcaggactgtttttctttctggaggctctggggagaatccatttcctttccttgtccagccccttggggccacccacattccctggctcatggccctctccctccatggtcaaagcgatcgatgccacatccctccttgcctttcatccatagtcaaatctccctctgactctacttctgtcccgcttttccacgtttaaggttccttgtgatttcatggggcccacccggatgattcaggatagtctccctattaaaggccagctaatgagcccccttacttccaccctttgccatggaaggcagtatatttgcaggctctggggattagggtgtggacatctttggggccattgttctgcctactgtgaccagttatttcttacttagactctctgagcctactgggaatttaacttattcagctgagcattctttgcaatgcttaaataaaggtccactgcatcacccccctcaatgtagtttttcagtctctgtttaaatattccttgtgttggggaacatttttttgtggggacaaaaaatgcctattttttatggggacagcttttgctcttggaaaattcttccttatatggtctcacattgtggtcctaggagcctcctccctctggccttaattctgcctcctgggggcttcccagtcaaatccagtccttctctcaagaggatttgaggatggccaccgtgtccctccttgttgcgaggaggttctcatggccagaggtgtgatgccgccaggcttcgggctcaccccacgagcctggtatggttatcactcagccagatgaagcttctggtctgcttccagagctccacaatggccaggtcctcactgttctccggattgacaatacctgtgcacccatctccttcgacctgggagccgcagaagagcaactgcaaacttggggcatccaggtgagtgctgatttccttgaatccctaccattttctctttcatccattcatccctctatcttttcatccagtttttcacaaaatctttatgaaacagtctgtaccagctgtcgtagggtatataaggaaggtatattagaagtgccctctctttcctctcttcccggttaactcacttaacaaatgtgtatttttttgggtgcccactctgtgccaggcacttaactggctaaacataataggggtggacaggacacagtacctatgtccacagatcccagcggggaagatggacgtgtgtgggagaaattgggacagtatcatataaatgccacagaagaggaatgcacaggcagtgaagacattcacaggagaaaatgagaaacttgcctgggggaagagggcagtggttgtgaaagctttgcagaggagcagatgcttgatctgggatcttgaataaataggaatatgctgggtggagaggaggaagggcattttaggagaggggactgcatatacaagggaaagtccatatgaattcattagataatgatgcagtaccttcaagcatagtgatttgaggccaggcttcacagacctgtggaactggatgcagatctagctccgatgctcactacctgtgtgactttaggaaggtgatttaacctttctgagcctcagttttatcatctgtaaatgtggataatattgatccctattacaaggggtttttgttaagattaaatgcaataatgcttgaggaaccctggcattgtctctagtatatagtaaatgctcaatacattgtagctattattgttatgaagtacctatatgtatgggttttactctcttcccaaagcccccaacatgatcaggcctttcctgtgctagccaaggccaaggaggattaaggattaattatgaatagggtagatatactgctaattttagcctgaagattttagaatttacttcttcttcttttttttttttttttttcaagatagagtgttgctctgttgcccaggctggagtgcagtggcgcaatctgggctcactgcaacctgtgcttcctgggttcaagtgattctgatgcctcagcctcccaagtagctggaactacaagcatgcaccacggctggctaatttttgtattttttagtagagacggggtttcaccatgttggccaggctggtctcgaactcctgacttcaagtgatccacccgcctcggcctcccaaagtgctgggattataggtatgagccaccacgcctggcagattgggttttcttatgggtgaacagtttacgtattgttctaccgtgttcctaaatataatttttttcaattcaattcaattaattaattaattaattttttgagacagagtcttgctctgtggcccaggctggagtacagtggtgtgatctcggctcactgcaacctctgcctcccggcttcaagcaattctcctgcctcagcctcccgagtagctgggattacaggcacgtgccaccatgcccagctaatttttgtatttttagcaggaacagggtttcaccatgttggccaggctggtctcaaactcctgatctcgtgatccgcccgccttgacctcccaaagtgcggggattacaggtgtgagccaccgtgcctggcattcttttttatttttataaaaagagacagggtcttgctatgttgcccagcctggtcttgaactcctaggctcaagcagtccacctgccttggtctcccaaagtgctgggattacaggtgtgagacactgcacctggcctaaatatcattttaatggttaagttctgttttcttagttctactctcacggggcctttatattctatagacgcttttgtttgggcaggaagatgtgagtgttcagtcttttggacagcattaatagatattgatattgcagtattgatagtggcaactctatattgagtgctcactgagggactggccctttgctcagcactgtacatgtattatttaatatgtaccttagttctacaaagtgggtacttttattatccttattttacagaggaaaaaacaggctcagaggagtggggttacttgctccaggtcacacagcacatgagtggcagggccagagtttgggcccagggctgtctgactccagggcctatgccttaaccatcaggctgccctgtgtctgctgcaaggtactgagtctgaggctgtgtggatccttctccagatgtcatgatgcctgttcttccctgagctgagagctgcaccatgtgacttccacccagtgctccaagctcctcattctgcctttgggacagcccagaatgtgcctaatcccccttccacatgatagtcacatgcactggaaactggctgtcctgcggctgattgatctctttccctgggttccaagcaggtcccggctgaccagtacaggagcttggctgagagtgccctcttggagccccaagtgagaagatatatcatctacaactcgaggcctatgcggctggcctttgctgtggtaagggggaggtggcccgcacactgaccctgccctgacagcttatggcaccaccaaattcagcaccgtgtcttggagcctgttggtgtgggtcaggggcttgggggctgttggcccaggtgcctggaaacgagcagtacatatggacattgatttgggatcagaggaaatttatgggagagagttgtaaccaggtcgttgcataaaggatgggagtcagggtttactgtgggcagagcttgggattgggagtctgcagatccacccaggctctgggctcaatatctggccttggccaagactttcctcctctccggaacttggtttccccatctgctcaacagatgggttatttcagctctattcatatatacatgtacatatatatgtgtgtatacacatatgtatatatatataaaatatatgtatacatcttcatattgatacatataaacacttacatacataaatgacagagccaggatttgaacccaggcagtctggtttcagcgtctgtgcttggaaccactgtgatttgctgctgttttgtatgtataaatggtcaaatagcacacctgactcccaggtcccacttctagggagaagggaaaagggtgggaaccagcattgattcattccctggtgagtgctgggctgttacttatgttgccttgttaacccttattacaatgccgtgaaataggtgttattatccccattttacagatgaggaaactgagacttaggggagttataaattgtccaaagccatatagtgcttgaaggatcattatggtctttgaactgatatttgtctcacttcagatccacctgcctttttctgttttatttaaaattaaggtaaacaaggattaggagtagctactaaccctttttgtctacttttgcttataaacaaggaacattagctcattctcacagatccaggtgactgcatcaatctcttactggtgctgtgagctgtctgaatccaaggagggtatcagtagtgtctgaaaggtgtccctttgaatggagctgctttatgcaaggactgaagttcctgaccatgctctctgtctggcatcttgcaggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggtgagatgtctggagatccctgccacactctctccagaagagcggtgcaggcgtgagaatcagatttttcccttttgcctccctcaaagaatttccctggccatgaaaattcacactagcccgtaagcccagtgactaaaagaaatcaaattgtgtatgtgattgttctctctgcttttcctgtctaatccctgtggattgtttttctggaagcaagctgtgttttgggaatgtgagaggagagcagtaattgcccgtatcctgacagtactttagttaactgagccctctcatgcacttcctctccctgggtgctcacaacagccctatgaacaagggaggattactgaacccaccctgcagcacagggtgcctaaagttgacgtctggggagaggtaatttacattattccctcctgtgacgggcagatgccgacctggtgctctattgacagtcatgtctctaatcccagcaatgacctttgaggcaaggtgggtggtccgagagtttaggtaacttgtcctggatcccactgttagtgacagagccagggttcaaaccctgagccctctggttcctgatcatgttccgaaaggaggtggatacctcccagcttgatgtatgattttaattgttttctgtctcttcagtgtctgtcttttgatatgtactgagcacatcatatgtagtaggtcctctgttaaatgcttacacattaactcattaaatccttcgacattaaatctgggtagaggctgttacactcactttgcagtcgaggaaccctagactcaggctcatagagtagccctggccatgctgctaataaatgccagagttggaaatcaaggccagggcctcagattccaagccatgttcttagccacaacgctagagaaaactgttggttttccaaagctgctgtaacaaattaccatgaacttattggattaaaacaacaccaatttattatcttccagttctgtaggttagatatttgacataggtctcactggactaaaatctaggtacaggcagggctgcttccttctgaaggctctgggggagaatctgttttcttgcctgtttagctcctagtggtcctctgcattccttggctcgtgatccttttcttcatcttcaaagccagcaatggcagatccaatctttttcacatctccttctctggctcttttgcctccctcttctacttttaaggacccttgtgattacattgggccagctggataatctgagataatctcctaattttaaggtcagctgattaacaacataaatttcatcggtggctttaactcccctttgctgtgtaacaacatttgcactggttttggcgaataggatttagacatctttggggaccatttctctgctaccacacctatgttgtctttccacctacttgggaagctcttgttcctccatcccccgatccctggcacagtgctggactctgatcttgcctgactcagaaagagggggcaggatgttgggaaatgtaaatcagcatttggggtgtgaattccacttagtgcgtgtgttcacgagacaaacgggaactatatggtgtactcattctgtaaggatctttgttgggctttgccacaagactgacaaaataatgctgcccttggggtctgttgaagctttcatggcccttgtgtttggcctataaaacaaatcgagctggctactcctgcagcaagaactttgtcttggggaggggaagaagcaaagtgttttgttttagttagcaggagcaagcaaaaaagattggcacctgacaggtgcttcgaggatgtggatgtaattcacatggtggagggaatgcctgctttggctctctgcctctgtctcttctttcctccttttattcagctggtatttatgaagcccttgatagtaccaggacataccttgtcagggccgcacagccaggaaacagcagagctgggctctggcccaggactgacactattgaatttactgttccaacaatatatatctatccatccatccatccatccatccatccatccatccaagacaggtcttactctgtgccaggcacagatcccagaaaatgcgcaaggcttgtgtgcagcatggaggtctcaggtgcatcctggcaatgccatcatcactgtctgctcatttaggagactccttattttcttcctaataatgtccatcatttcatgagcacctattgtatgctgtatgcttggggcttcacgtctatgcccaacaacaaccttataaggaggcaggataccgccgccatttgctagctctgcaacttggggtgagttacttaatctatcagggcctcagtttcctcatctaaaacatgagataataattgtagctccctcatagggttattgtgagaattaaatgacttagacacacaaagtgtttataatagtacctggtgtaaagtaaatgctttgtaagtattaactgttattaactctgtttgccagtgaggaaacggaagttcagagaggttaagtaaccagtccatggccacacagcccttctcaggtcttcttttgggtctcagctccaggacctcctcctccctggatcccttgtcactcaggactatgcagatcccctcttcctgaccattgtcactcttactgttagcatcctctctgttgttacttgatgtctttgagagcatcaatgtctggcataactgtcttgttttccctttggctcactgttagcctttctcaggattggaagatttgggccgggcatggtggctcacacttataatcccagtactttgggaggctcaggtgggaggatcacttgggcccaggagtttgagaccaggctaggcaacattgtgagactctgtctctacaaaaaataaaatcagcggggtgtggtggcacatgcccatagtcctgggaggctgaggtgggaggattgcttgagcctaggagttcaaggctgcagtgagctctgatggcaacattatactccagcctgcctcaaaaaaaaaaaaaaaaaaaaaaaagattggctggtttgtaaaggcaggcaagtcctggcacattgctaggacacatgagaagttccaagttcctacaaatatttgcggctaatatggcacagtgaaaacacaatgatttaagttcactgtcatcctcactgtgatattatcagctgacatgtgttaagtgttcaattctttcaattattctacatggattaactcatttcatccttattatactcctctgaggtaggggcattattatctccatttgggggtaaggagatggaggcacagagatgtttagtaatttgcccaaggttatatgggcagtgagaggtacgttaggaattgaactattggtgatacagatttctagaaggaagaaatccacatcaaatccaaatccacatccaaatcttcttactacagatctaggcaaaacaaaatataattattcctcaattttcatagtagaggcattcctggaaaattcagtgtacattaaactcatgcaaacaatcacgttaagtggctgggcgtgatggctcatgtctgtaatcccagcactttgggaggctgaggtgggagaattgcttgaacctaggagtttgagaccagcctgggcaacatagtgagactcgatctctacaaaaaatttaaaagttagctgagtgtggtggcatgcatgtgtggtcccagctgcttgggaggctgaggtaggaagatctgagctcaggaggtcaagcctgcagtgagctgtgatcgtaccactgcattccaacctgggtgacagagcgagactaggtctccaaaaaaaaaaaaaaaaaaatcactttaggtataaatgtaaactggagttaggttggctgaccagagaattctaagtagatttttttttatctgcatgtatgctcagtgggacatttggaatccaggcagcccaggggacagtcttgaacatgcagaatggtttctaataggacatgtctttcagtggaaggcatgggttcagaacccctggccctcatccactaagtgccagcactgtccatcccatccctgtgacaaccaaagggtcctccttgcatttccaaaatctcccttacagggtgctgccccttttgagaactattattcttgatcaggctgctctcttctaactgagtctgaaagtcctcttgtgcttacttccccaaaccagcatttggggtcctcttgtccctcctcttctcccccacctgtttagcatccactctcccagctgaatgcgtggcgtccattggtttgggtaggagagcaggaggctgattcccagagccccacctgagggccaggcgctgtgttaggtactttaaagtaggtgctttctagatggagtgagtgcttcacttacacaacagatttgatgtgtcagctcaaacagatcaaacccatttgatctcccatcttccgcaaatatcttatgaaccttgacagagtcccaggccctgggttaagtactttacacacaatctcagtgaaatctcactccattcctaggaggcagacacattcttttattctacaactgaagaaaataaggttcagggaagggacataccttgtccagggccatatagctaggaagcagcagagctgggctttatcccagggctgtctgacactattgaatttactgttccaactatcccccatctcattttatttttcttcccttatttttaagagatagagtctcactctgtcacctaggctggagtgcagtggcacaatcatagcttactataacctcacactcctgggctcaagtgatcctctcgcctcaccctcccaagtagttgggactacaggtggatgctaacatgcctagttaatttttttttttttttttgagacagagtctcactctgttgcccaggctggagtgcagtggcgtgatctctgtgcactgcaacctctgcctcctgggttcaagcaattctcctgtctcagcctcccgagtagctgggactacaggtgtgtgtcaccacgcccagctaatttttgtattattagtagagaaggggtttcaccatgttggccaggctggtctcgaactcctgaccttgtgatccacctgcctcggcctcccaaagtgctgggattacaggcgtgaaccaccgcgcctggccccacgtagttaatttttaaacaattttttatagagacggcatctcgctacattgtccaggctggcctcaaacccctggcttcaagaaattctcctgccttagtctctcaaaacactgggattacaggcatgagtcactgtgactgcctccacccccgaccatttaataggggaggaaatgggacagtcctgagggtggggattgtcccttggcatctgggggtgggatggtgtgtttctactgcccagagcctgggagctccccagtagcatggaggtctggtgatgggcctggcgtttgtcttacaggccaacaccaacacggacctgaggctggcagctgccaatggagccctcctgagacaccgggtgctgctgggggtgacagacacagtggaaggatgccagagtgtgattcaggtgctgtgtctcatagttacctcttcctgatggcccagttttatgttgggctaatggagagcagtggcctcatgttctcccagcctacacagtgtttgcagtagtctgctaatgagatggctgttggcagccctttccttcctccctgccctggtgtttcttcctcaagacaccttctctgtgcagtaaccagtggcctggaacctccacgtggcagggctggaagggaagcacagataatgtccacaccttgctgctcacctggcatttattcagcagacggagcctcctctgtgctgtgccctcggttggacactggcgacattgaggggcccatgcaaggtccctgtcctggcagaggatgacaggcatacagtgagacagtcaacagtagcctctctggccttatagcaaacggacagcccccaacaaggctgagaggcaaggtacacagggtccctttgaagggctgcatggagctcaccatggctggggctataccagagtgacacagcggggagagatgaggccggagaggcaggtcagatgctgaaggccttgtttgcctggcttggtcattctctttgccccgaaggttggggggagatctgaaagtgactagtatggcgtggcagggtgggtcagaacacagttaggccagatctcctgatcctggctgaactctcctgttcctccatccatgcctgatctgcccagtggaattgcaaaacctccttggcaccacatctgcattctcaccagtcatggccccttgcctggtgggagcccagaggtaggtgtgcacgggggacctgggaagaggctcctcatgcacctgcctcagttcctccacgaatgtttattgagagcctattgtgtaccaggcactgtcccagggattgaggctgcagcagagaacacatgcaggtccctatgtttgtggagcctatcacacccaagatggtgtaggtataagatgatcttgcctatcattggagtgaagcagatgacatcacaagattctcggcagttcaagtgtgacattgtagactgggagctcctggaatgtgggggtcctttttagcctcgtttatctttgaatctcctttatccgttggcacgtaggagtggcttgacatgtgttagatgaatgcacggatggatagatgactaaagaatgggctgggcgtggtggctcacatctgtaatcccagcactttgggaggctgaggcggatggattgcctgagctcaggagttcgaaaccagcctgggcaacgtggtgaaaccccgtctctactaaaaatataaaaaaattagcagggcgtggcagtgtgcgcctgtagtcccagctacttgggaggctgaggcaggagaatcacttgaacccgggaggcagaggttgcagtgagctgagattgtgccattgcactccacactccagcctgggcaacagagcgagactccatctcaaaaaaaaaaaataaaaacaaaacaaaacaaaaaagagacacatcaggtgggctcagtggctcacccctataatcctagcactttgggaggctgaggcaggtggattgcttgaatctaagagttcaacaccagcagcctgggcaacatggcaaactctgtttctacaaagagtacaaaaactagctgggcatggtgtcgcatgcctgtagtcccagctacttggaaggctgaggtgggaggatcacctgagcgcgggatgtcaaggctgcagtgagctgtgatcgcgccactgcgctccagcctgggtgccagagtgagaccctgtctcaaaaaaaaaagaatggacacatctttttagacaacttgagtctttcagtttctaaatagtatcttgggatgaggtgatacactatctggcatgtccttcagattcactggggggtgcagtggaggttggggtgttggggacgggtaccgagtgaggatggagatgaaccaagagtggccatgaggtgacctaacagttgcagcgggaggatgggttgctgtcatctacttctgaatatgctaggaaattttcatagtaaaaagctttaaaggaaccatttgagaaatcctcccttgtgggtatgacattgggagactagttggcaagaaggctgtgactttgggtctcatgggtcagtcagtgggaggaaggaggtctgggaaccagaggaggtggccagtggatgggagtttggggcaagggccaccagtttctccaagaacttcaattaggatgtgtggcagctgtggtcttgacaggttgtcgtaatgtgaatgtggaagatttcagcctggttaaatttagcttggccggcccctggggtggaaggggaggcacaggtggggtacggacttctcaccctgcttctgtccccacaggcaaccaggttgattacctcagacctggttgtgggccacaggtgtcagctctgaagggtttcactcatttgcatgttcacgccccgcccattgaggatgaaggtagcctcaggtggacaggtgatgtccaggagggttcggagtctgtctgggatgctcagcagcttgtgggaaatggggccgcagccattttgaacagggtttaactttttcttttcttttcttttctttcttttcttttcagacagagtctttctctgtcacccaggctggagtgcagtggtgtgatcttggcttactgcaaccttcacctcccaggttcaagtgattcttgtgcctcaggctcctgagtagctgggattacaggtgtccaccaccacacccagctaattttttgtattttttgtagagatgggtttcaccatgttggccaggctggtcttgaactcctggcctcaagtgatctgcctgcctcggcctcccacagtgctgggattacaggtgtgagccactgcatctggcctagggtttgaccttttctaaacgtgcacacaaagccatttttctaccaaccatacaaatgagacattgtcatggtgccaaatggcaccttcctgccagacagcaggctaaataggactgtctcagggaggaagagttcagggttgggctgcccttgagccacggtggtcactgctgcttctccccacagctttggtttgtctacttcgacctggagaactgtgtgcagtttttgtctgatcatgttcaagaaatgaagactagccaagaggtaagatatcttcagtgaaaaaacaaaacaaaaaccaggaggccaagttgtatcgatttcattatcttaagggtgggaaaatgtctgagaaaaagttacttggaagaatacctacgagcaatcagtggttgttttgcctagggaattatggctgcttttctgcttctttttaatgcctcgcttcttctacatttcctatggtgagcatatatttcttctttttttttttttttttttcctgagacagagtttcactcagttgcccagactggagtgcagtagagtgatctctgctcactgcagccttcgcttcgtgggttcaagcgattctcctgcctcagcctccggagtagctggaattacaggtgcctgccatcacacctggctaatttgttgtatttttagtagagacggggtttcaccatgttggccaggctagtcttaaactcctgacctcaggtgatccgtctgccttggcctcccaaagtgctgggattacaggtgtgagccaccacgcccggccatatatttctttataattataatattaataaattttggtggattccaaagtatcatgcattgaggcaacttttacttgttcacagtgcctttctaccgtttattaagaaaatcagagggatcttgctctgcttctacagaggaggaaacaggctccgggatgacctgttaccggcctgtggtcatggagctggctggtgatgcccaggtttggaggccaggcctcctgtctccaagccctgggctccttctctaggattagccttttctgagccccggctgcagtgagtcttgaagtcagagttgtgacttagccctgaatttggctcattagttcctgtgtggcctcaggcagggcctttgagtctcagtttattcatttgcaacatatggataaagatacccacatcccaggctgctttgagcaagtgagagcatgagaggaaaaatatttgtttgtttgttttgaggcagagtcttgctgtgtcacccaggctggagtgcagtggcgccatcttgacacactgcaacctctgcctcccaggttcaagcgattctcatgcctcagcctcctgagtagctgggactacaggtgcgtgccaccacaccaggctaatttttgtatttttagtggtgactgggtttcaccatattggccaggccggtcttgaactcctagtctcaagtgatccctctgccttggcctcccaaagtgctgggattacaggcatgagccaccatgcctggttataaaaggaaaaatatttagagctattaatgaccatctgtagggaattatgtaatatcccgaatgcgaccagctttttctgaggtcatcatctgagtctgagacctcatcttctgctcggtctgcagcttggggagggactcagcctcgcagataccacctgatttaggcactcctgagccccttctctgtttcctttgcagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggtaacaggcactggggcttgttggggccatcttccctcgggggaatttgcatagagaaagcctatgtgggggcttcttagattccccaagacatgcttctctcagttagtagacaccacacaaatctagctcaggagttttcaatcttttcattcttcaccctagcacttaaaaagatagttaacaggaagcattttatatttattgggactttttgttgcattatttaatatcttggatattctttttgatggttgcattggatgggtagttgcatgttgatagattatagcttacttaaccatgaacatactgatgaacatttgggtctcagtcaatcaattatttattcatctatccaaccattcatccatctactttaattgcagttagacagttgactcttctttgaatttttttttgtttagaacagggtctcactcccgtcacccaggctggggtgcagtggtgtgatcactgctcattatggcctcaacttcccaggttcaagcaatcctcccaccttagtctcctgagtagttgggactgtaggcatgtgccaccacacctggctaattttttgtatttttattagaggcagggttttgccatgttgcccaggctggtctccaactcctgggctcaagagatctacccacctcaacctcccacttctttgcatttctgttgaatttcagttcctgcagccccagagttctgttgggtcctgccatccacactgtctcttggctatggctaagcactggcagaccagaattctgaaaatgtgcagcttgtgcttaccttcttctcatgatgaggacagacccactgtcagggagacaagcagtgatggtgacctcaggtgacatttgaaacttcagaagagcacttatatcttttcagccaagagatttggggattcaaggtccaaaccagtccaggcttactcttttgtgctggtgggcagtaggaagcctgcaagtagtactatttaaaagagaaaatgacaggaacatgcggtggctcgtgcctgtaatcccagcactttgggaggctgaggcgcgaggatcatttgagtccaggagttcaagttgatccttccgcctcagcctcccaaagtcctaggattacaggcatgagccaccatgcccggcctctattaaaatcttttatctttttatattaatttttaaatttttatttagagacggggttttaccatgttgccaaggcttgtcttgaactcctgagctcaagcgatccacccgcttcatcctcccaaagtgttaggatcacaggtgtgagcactgtgccctgccaaaatattaaaaaaaaaaaagagagaaatgataactgtattaacctcttcactttatcctattgactttttttttttttaaagagaagagattgataaggttgtgtactttcttgtgacatgcgtgtgtgggtttttgtgcaatagccctttaaatatgggtcttttaagtgattatttttagatttactcaaaccaatagtaatataatttcctatcatgagtatcaagtgtgtgcacatgtttttaaagtagctgcccttataatttagttaatgaaaatataatcgatgcccaagtctcaacctgggccagatggtcacatttcagtaggaacctagtgtctgtaaaagatggaaagatagcgataatgacctcttacatttttacagatttttctcatgcataaaattcattagcatactcttcgaggtatgaattattttccctttttccttggtgggtgaaataaggttccaagaggtcagctgactggcccaaggttgccagaaagggagagtgcagtaagcccatggcagaagccagccctgctgattctaagtaggccagtgttcttgctacagttccttgcttcttacattattgattttagagtaaactggcgagaagaccaatctgagttagtgagtggtaaactatttgaagtgttttatattttctagcacaaaggataacttgaaacaaaagctaatcttatgaaccatgtggggtttctgcttttttgagtgataatgatggaaagatattgatgccatttgtggagcactaggcactgggctcaatgctttctgtctattagtctctctctctctctttttttttttcgagagggagttttgctcttttgcccaggctagagtgaagtggtgtgatctccgctcactgcaaactccatctcccaggttcaagcaatcctcctgcctcagcctcccaagtagctaggattacaggcgtctgccatgatggctggctaatttttgtatttttagtagagatgggttttcaccatgttggccaggctggtcttgaactcttgacctcagatgatccacctgcctcggcctcccaaagtgctaggattacaggtgtgagccaccgcgcccggcctctattagtctctttaatcctcactgtaacttagaggggtcagtgccactattttccttattctaccaatgaagaaatgggctcagtaatgtgaagtgactgctctgggttagtcatagagtggctgagttgaaactccctcttggcctttttgactttaaagcctatccttaattactaactctacagacatacctagcgtaacccacacttcatttcattacattcagagtggacacaagtattgcaaaagagcttcaaccccatgcttaaggaagttaagcatttcccctgagatcccatcttctagaccagtgaatggatctttacagaccaactgtgttaataagaatgtgcattaaggcctagcgccgtggctcacgcctgtaatcccaacactgtagggaggccaaggcaggagcccaggagttcaagaccagcctgagcaacatagtaagatcacatgtcttttttttttgaaacggagttttgctctttttgcccaggctggagtgcaatggcgccatcttggctcactgcaacctctgcctccgggttcaagtgattctcctgcctcaacctcccaaatagctgggattacaggcatgtgccaccacacctggctaaattttttttgtgtttttagtagagacggggtttcaccatgttgacaggctggtcttgaactcctgacctcaagtaatctctcctgccttggcctctcaaagtgctgggattacaggcatgagccactgtacccggctgtactgtgtctttaaaaaagaaaaaaaaaagtacattacattcaattttttaatccttttttacttaaaattgttttattgtggcaaatatacataatataaaatgtaccatcttaaccattttaagtatatagttcagcagcatgaggtacattcacatcgttatgcaaccatcaccatcagccatctgcagaatgttttcctcttcccaaattgaagctctgtgctcattaaacactaacttccccttccctccttcctccccaccctcaacccctagaaaccaccattttactttctctccctgtgaactgattactctaggtgcctcctattagtggaatcatacagtacatgtccttttgtgataaacctaatttttataagcaatctcttttttcccttttttatgtttttctttctttttttttactgtcagtgatcatatttaaatgtaagcagtttcttttaatatgttaggagtacttgtgtaaagaaatctaccaggtaccttgtatgaattaactaattctgctataatgggaatattcctctccccacctccacatttaactagtaattttcttcaagtgagtcactttgatctcatgtactttacagactcatagacatttgaaagtggaaaaaatgtatttgtggctggctaggtttactttctttttatatttttaaaatatatttttaattttaattttatttttgtagagacagagtctcgctctgttgcccaggctggtctcaaactcctgacctcaagtgatcttcctacctcggcctcccaaagtgctgggattacaggtttgaacaaccatgcctggccagctaggcttaaaaaattagataattagaaatttggtaatttctctagggcttcgaggttgcatattttttttgtgcgtattattattgccattcagcagttagttactcaccttggcaacgaggacattgaggctgcaggagccccacaggccatgagttgcagaactgggcttctggaccaggctggcatcttctgagagtcctaggtgctgacctggcctggttcttcctagagagcatcactgctgggtccaggggcaagaaagcagcatgtccttcccctggtgcctaagccctttttcctcaaggggctcccctgtggtattcaatctgcttccctgcctcttctaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttgtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatg

SEQ ID NO: 38721 - DNA, 2375 bp, Homo sapiens
aagaaatgagtgaggtggatgcttcagcgctgttagtctcctccccatgcccctcctcacttcatctagtttagtccctttatcctgtgaagtaggggtcatcattagcccccttttacagaggagagaattgaggcttcgagagagagaaacttggccaggagtttccactcggtccgacgccctcggtgccccgccgggtacggtggctgggcgcggggagcggggggcggcgccggcggggccccgggcaggggcggggtcggggcgcggacaaaaccgccgcggggcggcggggtggcggacgcggccatggaggccgagggctgccgctaccaatttcgggtcgcgctgctgggggacgcggcggtgggcaagacgtcgctgctgcggagctacgtggcaggcgcgcctggcgccccggagccggagcccgagcccgagcccacggtgggcgccgagtgctaccgccgcgcgctgcagctgcgggccgggccgcgggtcaagctgcaactctgggacaccgcgggccacgagcgcttcaggtgcgggtagccggggcgcgggagggacttctggtggggggctcggtgagcgtgctttaggccacggcaactcccgagaggccaactcagaggtcaggcggagggcgaggtccctgccctgggtcccgcccggtccactggggccagaacctcccctgctcggagtcatttttcccacgaacactgcggggtgggtcgagtcccagagaccaggaacatccctggctttgagctctggactctggagagatgctgagtgatactggccccgggtgctgagagctcaggggaacagagcgggaagtgtcgaggagatgtggaagggagagaggatcagcaggagtttgccaggaagagaacagaggaacgaagacctaggtcagggcagcaccaggccttctccaagaatgagggattcaagtcacgcttgctccctaactggagcacccagacttttttcttttcttttttttttttgagacggagtctctctctgtcgcccaggctggggtgcagtggtgcgatcttggctcactgcaagctccgcctcctgggttcacgccattctcctgcctcagcctcccaagtagctgggactacaggcgcccgccaccacgcccggctaatttttttgtattttcagtagagacacggggtttcaccgtgttagtcaggatggtctggatctcctgatctcgtgatccacatccacccgcctcggcctcccaaagtgctgggattacaggcgtgagccaccgcacccggccagcacccagactgttaggagagacacagacaccgaggcagagaaccacggggccgtgtgaagtgagccctgttggggtgtgaggcattctgtggatcccagggggaggaggtcctgcctctgggggtgtcatggaggcatcagcctctcccagcttacctttccacctccctgcctccccaggtgcatcaccaggtccttttaccggaatgtggtgggtgtcctgctggtctttgatgtgacaaacaggaagtcctttgaacacatccaagactggcaccaggaggtcatggccactcagggcccggacaaggtcatcttcctgctggttggccacaagagtgacctgcagagcacccgctgtgtctcagcccaggaggccgaggagctagctgcctccctgggcatggccttcgtggagacctcggttaaaaacaactgcaatgtggacctggcctttgacaccctcgctgatgctatccagcaggccctgcagcagggggacatcaagctagaagagggctgggggggtgtccggctcatccacaagacccaaatccccaggtcccccagcaggaagcagcactcaggcccatgccagtgttgactctaggagagaaagggttaaagcagtcccagccttagcccacctggtgggatggggagtgttaatatctctctggaggacaaatgacagaagggttcatataaacagtatcctgacacagtcatgcttcctggattttggagtcgaggctttctacagaaaagaaagttctgatggccaggcatggtggctcacgcctgtaatcctagcatttttggaggccaaggacagtggatcacctgaggtcaggggttcgagaccagcctggccaacatggtgaaaccctgtctctactaaaaatacaaaaattagccaggcgtggtggtgcatgcctgtaatcccagttactccagaggctaaggcaggagaattgcttgaacctgggaggcagagattgcagtgagccaagactgcgccactgcactccagcctgggcaacagagtgagactctgtttc

SEQ ID NO: 38722 - DNA, 35377 bp, Homo sapiens
tttccgcgagcgccggcactgcccgctccgagcccgtgtctgtcgggtgccgagccaactttcctgcgtccatgcagccccgccggcaacggctgcctgctccctggtccgggcccaggggcccgcgccccaccgccccgctgctcgcgctgctgctgttgctcgccccggtggcggcgcccgcggggtccggggaccccgacgaccctgggcagcctcaggatgctggggtcccgcgcaggctcctgcagcaggcggcgcgcgcggcgcttcacttcttcaacttccggtccggctcgcccagcgcgctacgagtgctggccgaggtgcaggagggccgcgcgtgggtgagtgcggagcgacgcgccggggcacgcgcctgcctgtccgcgcacggcgctgggaggtgacacctgggtacgcgcgcctgccggcccaacggatggtccgccagggaaggtgcagtgcgcacgacgcccggggagatcccagctgggcctggcgcccctgaagtatcccagggcgtggaaggggccccttcggtgcacagcgtctgcagaaatctggctcgttccttccagcatttatgaggtcataggtttttcacagggcagcgctcttgactgctcccacacctgggaaagagatgctttgggaaattgaggaacaggctgaaagggcaacatttaattttgtccggaggtacccagagttggttgctatgggggtgcttactgtgcctgcgccctactagtggctgcagccaaagttttgggcgggatttccaaaatctaagccagtagccataccataccgcggacgactgtctcttgttaattgcagtccaccacgctagggcttcggggtaatgtggttggaatttacacgtaggcctgggcagaaacctgctaatgctggcgtctgatttgatctaattagaagtgagtgaatccgagcccagtgttctatatgaaccgaatgaatgagaactttgcaacccgttgtttggttgctgatttcaaggcattgactgtaggaattgtctcgtatgtgtgaagctactttgcgttcttcatcctatagattacaaaagttacagaactacactaagtctgtcccaaaagcaaagttgctccttctacaacctccagatattccacaaagcctgcagacacacggcctcaaagaatctggaattgagtatcgcatgtatttaataaataggtcgagttttaaagtgtagcagcaggattttcatttaacagtgccaaacgcctggaagcaaacaccattggaaagtccttcaagaagctcagcctcggttcttcaaaacttattcctgtacccggcacggctgtatttattgaatgattaaatcaaattgttcctagaaaaaggcaacctggccaggcacggtggctcacgcctgtaatcccagcactttgggaggccgagacaggtggatcacctgaggtcgggagttcgagaccagcctgaccaacatggagaaaccctgtctctactaaaaatacaaaattagctgggtgtggtggcgcatgcctgtaatcccagctacttgggaggctgaggcaggagaatcgcttgaacttgggaggcggaggttgcggtgagccgagattgcgccactgcactccagcctgggtaacaagagcaaaactccctctcaaaataaaataaataaaataaaataaaataataaagaaaaaggcaacctgctggggcatggtggctcacgcctgtaatctcagcactttgggaggccgaggtgggcaaatcgcttgagctcaggagttgtagaccagtctgggtaacatggcaaagtaccatctctgccaaaaataaaaaaaattaaaaattaaaaaaaaattagccgatgtggtggcgtgggcctgtggtcccagctactcaggaggctgagatgggaggattgcttgagcccaggaccccaggacctggaggttgcagtgagcagagaatgtgccactgccctccagcctaggcaacagagtgagaccctatggggaaaaaaaagagagagaaagagagagaggaaggaaggaaggaaggaaggaaggaaggaaggaaggaaggaaggaaggagcaacctattcttgtcacctgtctttgtttttttttttttttttttgagacagagtcttgctctgttgcccaggctggagtgcagcgctgcgatctcggcttactgcaacctccgcctaccaggttcaagcgattctcctgcctcagcctcctgagtagctgggattacaggcacgtgccaccacgcctggctaagttttctatttctagtagagacagggtttcaccatgttgggcaggctgttctcgaactcctgacctcgtgatctggccgcctgggtctcccaaagtgctgggattacaggcatgagccaccgtgccgggccatcttgtcacctgtcttaacaatccttgctgtctgagatacaaaaaagttcagttttcctagtccaacagagcagtgagataacggaccttgagaactttctatcaaggtagaagagtagtagccaatgcccagagcctaaagaaggggcgtctaaggatttgctccctggttaccaggggcaggattccctgcagaaaaccaagctcactcagatttctaaggtacaccagttttcaatcccagagattttttttccccttccaaaccattttaaaaaggaataataggctgggcgcggtggctcacgcctgtaatctcagcactttgggaggccgaggtgggcagattacaaggtcaggagttcaagaccagcctggccaagatagtgaaaccccttctctactaaaaatacaaaaagaaattagccgggcatggtggcaggcacctgtaatcccagctactcgggaggctgagatagagaattgcttgaacccgggaggcagaggttgcagtgagccaagatggtgccactgcactccagcctgggcaacagagcgagactccgtctcaaataaataaataaataaataaaggaataataaaataacttgcattatcatgcacttagtcacccccttgaaaataaaataagatatttgacatccttcataaaataatcaaactagctctcaaaacccgagtgaataaagtaaaaattcccagcccctgcattgctccagtgaggatgcaggggctgggaattttatataagttacataaatcttaaagaggtcttaaacatcatttagtccaatggctttgggaaaggttatttaagtcttttctggctatttccctgtttggaatggaaataattcatgttctgccaacaatgtcaggtggtctaaggagtcatataagatatgagtgccaattagaaagtataaaaatgtgagttcaggggtagtctgttcatccattagctatgtattgaatgcttactctgtgccaggaactgggctagaagtgtggcctaattcatatttagcatagggtcattagggaaggcctctttgagattccctcagttttgaagcactccactgcctgagtgaagagtgtagacacacctacatggagctttcagtgtagtcataagaaattcctgcctccattataagagcagtcatagcactggggagaagtaaaacatgggccaggcgcagtggctctcgcctgtaatcccagcactttgggaggttgaggcaagcagatcacttgaggtcaggagttcaagaccagcctggccaacatggtgaaaccccatctctactaaaagtacaaaaattagccaggcatggtggtgcgtgtctataatcccagctacacaggaggctgaggcatgagaatcacttgaacccgggaggcagaggttgcagtgagcaaagatcatgccactgcactccagcctgggtgacagagcgagaatctgtctcaaaaaccaaaaaaaaaaaaaaaaaagaaagaaaaagaaaccacgattgatccctccaaactcaggtttgcactctacccaaccagtgcattgttggactgagtgctcagctgctgcacaatgtctatcatccatccagaactgaccctgaggggcgagcaggtagccaggtaaggaagagaagtgtagttcatgggtatccctcccaattctaggggtcactgcattcctttgtaagatgagaggctgagatgaagtcagggtttttcaaactaagggctcactagggttataaagccaatttagtgtgggatccggttttttttttttttaaacgaaatagtatagactacaaacgattagagtgtattgcgaaagcaagggtaagtagtgtctccaaatgtgtttcagatatatatgtatgacctaggtcataatgagaaattcagttcttgctgtgggctgcagctttaaaaagttttgaaagcctttagactaaatgatgtttaagacctcttctcgcgctgaaattctttgattctgtgagctgttggcgcgtcaagttatctttcattttaaaaatactgttgccctctggtggtgaaatgcagcaatagctgtggtagtaaattcaaggaagaactaagtgctagctggaggtgggtggagtggagtggaggaagtgttgttttgttttgttgctaattgtaggcgaaatcacagaccacgatttgtgttccctcactgcccccacctgatgcctttcttacctggccttacactacctttccataaccaatgaggcttttacttttctagtattacatggcataggctcaggacccacagttggagtggtgggagattttggatggtgctgagcgatcttatgcttcccagggtttcctggatcatccccacaatgtttgccccgctcctgactattcaaggctgtcccttacttgaagacaagtctcctcttgccactcagcaagttctgggaccactggctctgcgtggagcatttggtgagaggccggccttttactaacattttgagagactagctgaaatcttcaagtgcacacactctgtaagaaagtcaacccattctggaatccactattgtttaggaattggccacttaaacaaaacaccctctgaccaggccaagaccagtggttggaaacatactttaaacacttgatcaaagcatatggggagaggggagctatgcccatatcttaattgcttctatttaaaataaaatctgtaagtgtacatttatcatctatcttttgatatagggccaaggccatttaactggagctccttccagtctgcactggtcatttcttacattgttataaaggaatatctgagactgggtaatttataaagaaaagagctttgattggctcatggttttgcaggctccccaggaagtgtggtgctggcatccgcttctggagaggcctcaaggagcttacaatcatggcagagggcaacagggagccagcatgtcacatggcaagaacgggagcaagagagcaagtggggagctgccacaccctcaaacaaccagatctcagagcaagaattcacgtatcaccaaggggagggtgccaaaccattcatgaaggacccacctccataatccagtcacctcccaccagggccccctcatctccaaattggaaagcacatttcaacatgagatttgaagaggacaaacatccaaatcatatcacagtctttctagcaagaaaacacacccatggggaatcgtttgtggtttccatttttgtttacttatggtggaatgagctctcaaagaatatgctgaacaaccctctgcttttacttttccttgcctaatctcagcttattaacaccaattcaacagctaaatttctaaagcatttaacttgacttcatggacatgacatctttgtttgtacccgctcttcaccagtttacagaatatttacttatgtaatgaggtactaagtacatctgatatatgcaagtttgggagcaaagcagctggctttgggtaagcatcaggccaggcccatataggccactaggcaggagcccgtgctcgggggttcagtccaccgtgggtctgacagcaagcatggagccctgtccactaggccacaaggcagttaggagagcacttactctactatgaaaacctttattcctttgtgatttctcaatctataaagcacattaatacaacataatttaattactgctcttgaggtcttctctccattaatgtcaataattttgaggtgattcaggagactaggaaagcaaaacattaaattgtccattgaaacaaaaactggagaattaaaaaggctgcaatgaacatagagggagaagataagtaataaaatactcaagtgaactaagggagaagataagtaataaaatactcaagtgaactagtcttaattttcatgtaaggaaagctcctaagggcttttataggcattaggaaagaacagcagggagggggatatttgcaagataaactaggatctcttcagtgccctcacactgccctaaggatgaaacataacaattctgaaagcacagaagagacaggcaggaatctctccttccaggcaatgtttgtgctgaaatagcacagatgtgcctacggtctccaccccatcacccaccacagcagccatccggtctgcagactctgatcgcagagtctgggtctagcatggggtgagaaaggccactaggtcccggggttaaagctttgactttgacctccttggcactttgcctcaatctcctaagctaactacacccggatgagctagccagtaggaatgttttttttaccattttataataaattgtttttaaaccacaattttttttttaccagcccacgacattttccacttggctttccacatgtggagtcatagccaaggatgcatgtaatcacagagcattagtaatgtcccacatcaagaccggcagtggtgggtcatgactgttaactgccagaagtctggcttggctgcagactcatcctttaaggacctaggttgttctgctggagactgcatgtaaataatcagcccacaacgactgacattgtgaggcatggaaggttatacatacacacacactcgcccaaatccaacctgaaacttgatctcacttgctgttaagcagtgtatcgccccagagatgtatgacacttatgtgacctcggcatttatttgcctttttggatggtgcctcagttgaagaatgtttcacagagatagtcccacagtggctggagacagtagccataacaaatccactctggctgacttgctatggttgttcaggatgtccctagccagaaaaatcaaattacaaaaggaaatcttcgccgggcatgttggctcacacctgtaatcccagcactttgggaggccgaggttggaggactgcttgagcccaggagttcaagaccagcctgggcaacgtgatgagaccccatctctacaaaaaataagttagccacatgtggtggcacgtacttgtagtcccagctacttggaaggctgaggtgggaggatcacctgaccctgggaaagttgaggctgcagtgagccctgattgcaccactgccttccagactgggctaacatagtgagaccctgtctggaaaaaaaaaaaaaagaaagggagtcttgtaccatggctgtgtataggatgtatgtgatccgtggtcatcccaagggcacatgcccacacagaacatgacattaaggatcacagtaattctgtattggtattgtgtcctattgctgctataacaaatgacctcagatttagtgagttaaaacaacacaaacttactcacttatggttctggagggtagaagcctgaaatgggtctccctgggccaaaattaaggtgtctgcagggctttgttccttctggaggctctagaggagaatccatttccggcttctagagaccacctgtgctccttggctcatgactccatcctccatcaaagcaaacagcatagcatcttctgattatgacactactgtctgcttctcataggacccttgtgattacattgtgcccacaggaataatccaggataatcccatctcaagatccttaatcacattggcaaaatcctttttgccatgtaaaataacatagtcacagatgccagggattaggcagtggacatcttcgggcaagggctgtgggggggcattattcagcctaccacaccccgtgtccaggctggctgtgagctcctgcaaatatttaccattctgcccgacatatgccggtacccagaaaatgcagctcttgctcccacctcctgtcttgctgacctctgcagccttgctaacctcacatgtgaacccacctgccctctcctctctagctcagtactcgaccataggctgctttgtcaaagctcctgaacagccaattttctttccactctgcccatgtgcttgcctatcccaaacgagacggtcagcttctacagggcgcaaggtattatatcatgtctctatctccttcattgcactagcacatggcctgctagagacaaatattagatatttgttaaattaaatgaaggtagctggaagggtgctgaaatcactgaggcacctggaacagggagacaggccaggacccagcccattcccattgctcccagcaggagaaaaggagacctgaagcctcatgtcctgctctcaaccagccttttctgattatccccacctgaggccagaggggacctggagggggcagctgcctctggccacttccactcgcttcctaccccaaatcaagaacgtgggacccagggttggctgagagagaggacacacagtattctggctttcctctccattgctacttagcctgagaaagcaaagcattcgcacgcaaagagctccttgggccccactgcctgggcctgatcagaaggtaactgacttctgttccataaactgtatttgctttatctggccttgcccgagagaaggaaaatgcaataaaatgattccagggtataatataatatactgatgctgtctccatctggaacataaggatagcacagcaatttctatgcacaaatgagttgtttacttatctccaaccaagcctgactcataaaagtaaccttataaaatgacgaagtttgcttttactggaatagcctgacatttatgttttcttatcaaatgtgaatgctggaggcgacatttaggagctgagtctgttagaccagtgagtcccaagatgcgtggagggagactggaattacctgtgagctcgtccccacccacccactgccagcctgagaacaggaaattaacgttgtcacaaccggcactaacacaacaggaaggaccagcgcttagcaaccaatgacagacactgcagagagggggaaaaatgggaagtgttttctgtagagaagctttgggcagaatcatgtctttggagactcctccatggggtggtgcacagcgaggtttctccaggacaccatccctgctcttttatttgctccacgtttttgtggtgttttgagagagtttaaaggggatgttagattttttttttttttttttgagatggagtctcactctgtcgcccaggctggagtgcagtggcgcgatcttggctcactgcaagctccacctcccgggttcaggccattctcctgcctcagcctcccaagtagctgggactacaggcgcccgccaccacgcccagctaattttttgtatttttagtagagatggggtttcaccatgttagccaggatgatctcaatctcctgacctcgtgatccgcccacttcggcctcccaaagtgctgggattacaggcatgagccacagcgcccggccaggattgtttgatgttttaaatgtgctcttagaatacataaatacccattctctgtccctcatcaagttccttgggttcatttctaacacacccaatatttcaatgactttacccaatctttcaaatattggaaaatatttaaatattttaatatttcaaattgactttatgcaattttggtgattttatgcaatatttcaaaaaaagtgggtagtgcctaatgtaaagatagtgcagacacctactggaagaaaaatctttgatccattaacatgaaaacaaagctttgtggtttagtataaacagctttcactgaaaacaggacatgacattgtagaggtgctattagaatgaacagttttaacttcttggtgcatatacaaatgtcattataaaacaaagtagttatccatctaacaggaagcaaggagggaattttctttaaaaattattttagtccaaactgccttcttcgtgttccttctggatactcttttttttttttttttttttgagtttcattcttgttgcccaggctggagtgcaattatgccatctcggctcacccgcaaactccacctcctggattcaagtgattcttctgcctcagcctcccgagtagctggaattacaggtgtgcgccaccacgcccagctaatttcgtatttttagtagagatggggtttctccatgttggtcaggctggtctcgaacactcgacctcaggtgatctgccccacctcggcctcccaaagtgctgggattacaggcatgagccaccatgcccagcccaagtgttccttctcaaagaatagcacatactgtgtcaccatggagtttatcagttgcacctgcagaagcagagggtagacctgccacatgcactttctaaggtatcataacctgattcaccagaaactccagggtcctgaagtcaccacactttgaaagaacactcctccatttcatttggtcctgatgatactctcaggcatttgaagagaatagtctcggcgtcaatctcctatttagtggtcagctgtatcctagtgattgtcatctgatctacatgtcacttcctacctgcaacccttagaccttcagtggttccactcagtagctagagagttctccaagtgtggtccctggaccaacaggatcagcatcatgtggaacttgttaaaatgcaagttcccaggccccaccccagacctcctgaatcaaaagtcggtgtagatccagcatgctgggtcttagcaagccctgtaggggattacatggcacactcagatttgagactcactgctctagaatgaagtccctgtaagagaccatctctaatcagatcccccacccaccattgtaacctcaaccccaagtctaccctgacttaatctgctaactgccccaggctggtctgctcgcttccatgccctggcacacacactacctttccagagcaccctctccctctctcggcttgtctaatcctagtccttcctggagatgtccccacctgcactgggttatactttcatttataccttgtctgaaagggtctgcatccaggggctccttctaaagtcttggatcacctttacttccatctgttacgggttgaggtgtgtcttctaaaaagaaatgttatatccaaaaagttctaaccctcagtgactaagaatgtgaccttaagtgtaaacagagtctttgaagatgtaatcaagttaagatgaggtcatactggattagaatgggccctaaatccaatggctggtgtccttatataatattaaggccatgtggatatgcaaacagactcagaggaagaccaccatttaaagataaaggcggcccggagaatcccttgagcccaggagtttgaggctgcagtgagctatgattgcaccactgcactccagcctgggtgaaaagagcaagacccatctcaaaaacaaacaaacaataatagaggcacagattggagtgattcagttgtaaactaaagaatgccaagatcgacagccaccacctaaaactaggaagaggcaaggagggattctacccagagtctcagaggaagcatggccctgctgacacctttagattggccttctggcctccagaactgtatgagaataaatatctgttgttgtaagccacctagtttgtggtactttgttacgggagccctagcacactaatacatacatcatgcctggcagtctcccttccagaggaaggtttgcagtggttcttgtccacagggaccttggttacaagcagtccaagagcatcccagcgctctctctctctctctctctctctcacacacatacacacacacacacacacacacacacacacaccagcagccagcttttattcttccttttcttagagaggttgctgggctctatttttctgtgcagtcctgtgcggtatttgggaaaaacggggctctgcaggccagttttcctgcttcctgtgttgtgactttggccaattccttaagtttggtcaagtgcctccatttcttcatccttaaaatggtgataacaatcatacctactaaagggctttagtgatataataggttagtacatgggtactatgttgggtcgggtgaggcacacagtaagagtacaacacgtaatcacttttatcatgattccctccaatgatgcttcatatgtaagcactgaatgaatgcttaatattgatttgctaaggatttgaggatcatttaccaaaacataaataaataaaatctagtgtgatgagttcaggtctttgaaagcattccattgtacattctctcgaacaggtctttgaaagtggcctgtttccctccaaactgattgcaaatcaaaccaaaatcaaagtgctgatcagtcactaaagagtacatgatggtatggcatatgaggaaggggaggtggaaggtatatggggaaggggatgggactgcctcttttcactgtccagtggggccaaaaatcatctataaaataaacacacaaaaagtaagggccgggtgcagtggctcaagcctgtaatcccaacactttgggaggccaagacaggtggatcacctgaggtcaggagtttgagaccagcctggccaacatggtaaaatcccatctctgataaaaatacaaaaattagccgggtgtggtggcaaaagcctgtaatcccagctactcgggaggctgaggcaggacaatcgcttgaacccgggaggtggagggtgcagtgagctgagattgcaccattgcactccagcctgggtgacagagtgagactctgtctcaaaaaaaaaaaaaaaaaaaattagagcataaaccatgttattagtggcccatgattatgaagaatttagttccaggctgtagtacacaagtcttttatacataattttttaaaaatctacagtgaagagctactaatttattccttcaggttatacagtcatatggtcatttgcttgctttttcttattaaatagcccttttcggaaaaatattggaacaatgtgctctgcctttgactgtgtttaaagaaagggatgtcaagtttcctgatctgtttcacagatgggcagttctggcagtgtgttggggaaaggaatgaaatcactgtaatctatattacaggaatccttctttcctcaggaaagctagaattgttggtcacctttcctcgtgtcagatttggctgtttcaaaaaagtctacttacttttttcacggctttgaatttaatggattagctttacaccatgtggctgtagcaacctgctgtgtaagtcccagagggagcatccctgggcaagaccagaggtctttataaggtgagtgcctctaaagccccacctccccacagggtgcctcagggaacatccttatatgagtcagtttcttcacagacctccatcactatttctctgggatgcatgcccagagtggtatttctaggtcatagggcattcacacataagcttgatttgaccacatacgccagattgcatatgccagactgcagtcgtaaagccccaaaccccacccagcaatgggccctgtccactttcttgattgccagtctactagtggtactgtattaactcattgcttatttaatttgcatttttgtatttctgtaattactaatgagtttgagtaggccttcagagctttgttagcatacttaatacatgtagggtgcttagaacagtaccaggcaattggcccaattattgggctacttgcattattctgtacacacaagcatcttttaaatgacacaatgttaaaaatgttgttttaaggccaggcacagtggctcacacctgtaatcccagcactttgggaggccgaggcgggtggatcatgaggtcaggagatcaagaccatcctggctaacatggtgaaactccatctctactaaaaatacaaaaaattagctgggcctggtggcatgtgcctgtagtcccagctactcgggagactgaggcaggagaatttcttgaacccaggaggcggaggttgcagtgagctgagatcatgcaactgtgctccagcctgggcgacagagcaagactctgtctcaaaaaaaaaaaaaaattgtcttaatataaaatgtattctagtgatgatttctgatcttgaattacctgcttattttttactttctgataggacttggggtttggtggtttatgactgctctcacatggctggtgggagggtggcctgccgcagcctggctggggggcaacctggcatacttggtccaccatatgcttctctccatttccactgtcctcaccttggctccaagccctgctccctctccccgccccctcagccagcctcctgctctgtctacattaactctgcacaactcctcactccagcatcattctccacactccagctagagggatcttttcaaaatccctccttctggtccctggctttccatttctctcaggacaaaatcctctttgtagcctgcaggtgtggcccttgccacccagtcagcctcttaccgggtcccagctccagctccagtctttctgccctggggccccatggctgctcctcaggcccttgccagctctcctccccacaccaagaccaattccttcttcatcttcagagttcagctcaaatgtcgcttccctgatccctagactagaccaattctctagccatcctctcatagctcttaagtcagccacaatcaaataatcaatcctacaatgctctatttaaggccctctcccgctagactgcccggagagtggctgctgctgttttgctctgtctttcctgcacccagcacagtacttggaataaggtaggagctgaaatcatggagtgatgttgttgaacatcaacgacccctttatcacagaacattttaaatcaaggacagccaaagttcaacacagtcctaaaaccactggagagcaagtgcagacactgcatccagaggaaggtggcctggctcccgcccactccacacacaggcctgtggctgtgcggctcatctcaccagagcaaaacagcacggggctcttgtgactcagaggaagggagaagggagaggcctttgtgagagataaaagcactgtgtcttgatacatgataaagtacaaccaaaaatataaacattttattttggatgaaatgtggacacttttaagagtgcttgttaaccaggcgcagtgagtcacgcctataatcctagcactttgggaggccgaggcaggcggattgcctgagctgaggagttcgaaaccagcctgggcaacacggtgaaaacctgtctctactaaaatacaaaaaattagccaggtgtggcagcgtgcacctgtagtctcagctatgcagcaggctgaggcaggagaattgcttgaacccaggaggcggaggttgcagtgagccgagatcgtgccactgcactccagcctgggtgacagaacaagactctgcctccaaaaaaaaaaaaaagagtgcttccttaaaacaaaataaatcaaatcagcaaagaaaataactctttaaaaggacagactccacaccagctcagagcccttctcactttgcctccatgtgtttccagagcactgttgcgtcaaatcatatcttaagtcctgtatttaaaatatgcacaattatatcaagaataaggaagactttagtgaatctttttgcatagcatataaccatgcccgaatgtatcactggcgtgaaggctgatgttcctcaggattcttattctacacatcttccctgggggactacatcaaattctatggctttcaccactacctctgctgatcctacttctataaccctcagcattttccgagacatctcaaatttccccatgtgccagagaatgaaccctcccaactcagcttcttcctcatctcatgaatggcctccgcacccacccctgcccacctcacagctagaaacctgagggtgtcgctgactcctctgcaggaggctgtacccaggaagcccctactcaacaggacaggcagactcccaggtgctgcggtgcacatagcaggtgcggggtgcagcgacccattcaaggcttagaacccactggcaagctgaagtgtcgccttctgagtgttagttgtttgcgggtgcccatgtggctgggagtgtgagaggcagcaagccacagccctgtgttcctcccacattggcaggtactaaggatgctgaacttcaggaatctttgagataagaggtcatgggagccttgtccagccactgtcaggcatgtctcatttatatccttccactactcattgggtgtttcaggagtaaccctgatgggagaccatgttatataacatcccctatccttgaacttgggtcagtctcttgtgtttagcccagttcttctgctttctcatgcctatagattttagtaataataaaaatagtaaacagacattgaattttatgctgacccaggcactgtcctaaaccctgtttatgccttatcctactgttcacaacgccctgtgtattgtggatatgtttaatgttactcttccagactttgggatcaagttccaagtcatctcaaaaaagtgaggctttccatgcccttgcacccacctccccagacaccttttctccagcttcactgtcccctggaattccaacccctacatcccactcccacacctttgtctaacactggctcctcaaagagttagtttaggcctcacccactctagaaagcctcccgcaggctgcgatctgccacactgatcagctacactacaaaactgtttccaagatagaagcaggtttctggaaaggccgggctggacatcatatttctttatatctccccaaggcctggcatagtaggtgattaacagcgaatgagtgaatagacagacttgtgtgtgtgcgttgtgtaaaccaaaattagtgcctcagcttacaacagaactcgtttgaagactgacgatgagccctcagcaaactgctctgtgtgcagtgctctcgggaattctctctccttccccagcaacatctgtacatgtacaagcttaaatattccctacataaataaccaccaaggaatcctttccttcccttctccagtttcccagcattttttaagaatctataataggaatggatgctatctggtctatttaaaataaaataatgctgtttgtttattgaattgctacgctaagatgcaaaggaaactggtgtttccagagtccaaccttaatcaatgctatgtgaaataacttcagctctatacaacagcaagttccctttcctctctaggaaatatttcttttactgatttatcattttgctctcttaaaaaaaagatggcaaacaataagaacttcttctaaacagtttaaattgcaatgacatagatatgtatattctaaaatatgcattgaaatcaattcaacagttttaaaggctaaacattaacatttctgaagtttaaaagtatgcttgcctataaaaactgcaaacgaaagaaagagcatagcattggaagacttcttcagtgttggtgattcatcctgttgcagactgaagttccacctcacgcctgtgcttgtgggtcccctctgcctgtaccgggtgtcccccacctagatctgggatggctgcttccttcctgtcctgctggtctcatctttgagatcgcctcgtgccaagcaagcaccttcctacaccaccactgtctttcttcattcatcagcccctgaaagcataattattacttgttgtgcgtttgttgccagcatcccccattgggctatgggtggcaggagggcaagtcctcgtcagtcctgctcgctgatgtggccccaggacagggcgtggagcaggcactgaggagttggggatgaaggaattccctccagctccctgcacactcctgttcttttctcctttagctgctctcacaaagtcactccagtcagaacgcaaccatttccctttctcagtctccctctttgtgagtaggtgtcaaactagcaagcagaatggcacaatcagaacaaaatttgagatctttcttctaagccatcaccaattttattcaggtataaatgctacagccaccatttgcatgccatgttatcctaagagtgtgattcctggatatgaggatgtttaagggagcttctactatactaagattcagtttctgtgttccagattaatccaaaagagggatgtaaagttcacgtggtcttcagcacagagcgctacaacccagaggtaagctgccacaattggcaaagtatcctattagcaactgctataaatatggctttgtaaaaaagtgagaatcttaatatatagtgatctggaggtttgcttttgttttttcctgatctgtttcctatttgttatcaagaactaaagaacagaactaggcaagagctcaatatttaactacttcaacttcatggtcttaacgcagggttgcatttaaaacaatccatataagcgatcacctccctcttccttgggacccctgggagagaatttcacagctccctctggtatccctcctagctcctcagagtcctcagaatgactcactttcaaatgccaacttactctcttcctgtcagagggtgacatttctggttagcaggccagcacagcgtgagaccaaccccatgagctaacgtacacagaggcactctgtaaaacacgagcacgtgctccagccgttatcagcctcactacagctttgaccaagcggaccatgttttgccaagtttcctgttccctgttttcaagaagagagtaaagagaaaactcgtatagaaattagagccagatgaacttccttgtgctaggccaagctgaaaggcggcaatcagagcatgggcggagaggagaccagctcaaatgctctttgtcttgtgctgagaagcagcctggagcaggcagcatccaggattaaagtgttccagggtggcagagtttcgggagttgaaggcatgactcccccaaccccatgcttctggaagaatgctcaccagtactcaagttccaacaagtatccaacatgacagcagtatgctctttgcttattaacctatgaattaaaatttccttaaagtgtacgaaagatgcctttgattgttagtgttgcaaactgaaagtgttaagctagagggaatacaattactagattattttcaccaacaatatgcttccctggatttgatcctgtagatgcattaagaacagagtgagctaattgaaaccttccatttcagggggtgaagagcagttcttttatcctcaggcaacggctttgattccatggagatgttttgagggggaaatgaaaaggaaaatgaaagggggcagtacctggttctttttctcttctctggaaatgactttgacaacagaggaggccatgtactaggttccttctgccctttcataagcctcttcctgaatgcttccttcaccttttttctatgttgcaccaataattaacatcttaaagcagtactgaaattccctctcactcaaaaccagcactcacaggaggaaaaattgcctactggaaagtgtttctcagttttttgaggtagttttagaaataggcttattaagcagatccaatttttttatttttaatttttatttatttattctttttgaggcagggtcttgctctcctggctggagggaagtgcgatgatcatggctcactgcaaccttgacttcctgggctcaagcgcagagagaattttgattacaatttgtttcctcatggacttttttcatttttggtagttgttttcactgggacttcacccagtttaaacaaccacaaaagtaaaaagaagattatcacctcaactatgcaaccagccaacgagagttggatttgggcagggccaagactagtggcccatgaacttcctcaaattctaggcccagtgctgatctgtgcatttttcagggaataagttccctggcttctcttatttggttaaggaatctggggaattccttaaaagggggaagaaccactatgctagaaatgagtcatacatctgatgtctagttgaagctccagatgtttctggattataaaataagtgagggagatcccagaatatccaaaacatctacatttaaacatgaatgctgggggtggtggctcatgcctgtaatcccagcactttgggaagccaaggcaggcagatcacgaggtcaggaggtcgagaccagtctggccaacatagtgaaaccccatctctactaaaaatacacacaattagccaggcatggtggtgggcacctgtaatcccagctactcagaggctgaggcaggagaatcgcgtgaacccaggaggcagaggttgcagtaagccgagatcgtgccattgcactcccacccaggcaggactccatctcaaaaaaaaaaaaaaaaaaaaagatgaatgcaaataaacatcactcaggtagttgaatgaatcccatgtggatgatcagtggatcagtgcccccatttcttctggattagatcttggcatagagagatgaagttagtacagagagcctgggcttcggtgttagaagtgaggtcaagccctggcttattagctgtgcgacatggagtaggtacctccttaaacctcagtatcttaatctttcaaactggaatcagaggacctaattcataaggcagcatgaagatgctgttgttatttttgtaaataggagccagctccatcttttagttcaagttagtaactttgaggtccacctaagtattatgttggtccacattcaagagtaaagtggccactactctaaaggtttgagccaagcagtgctcaatggatgtcaatgatatttctttggaaatatgcccaatgtcattttataaagtcacaatcagaagacaagagtttaaatgatagcaaagagagaaggactgttgtattcagctgtgagcacaacccacaataaaccaaaacccactacatctattgatgccagagcctgcctgccttgtacaatgaactcttctcaatcttgtgtgtgcttgtgtgcactggggtgagtgggaggtgataaagtatcctgtttaactccacagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctggtatgaatcagcatttggaatttctatattcaggaatgtatgtaataactaaatccttaaaagaaagatcatttaagtttttatccctaaagtggcactttcattcaactaaatattgtggtatccctcataatttaaacaaaactcagaggtatcatctttctgttcttcatctctaatccaacacagtaactccaccaacagcatgtatccctttcatctcattttccagctgggcgcggtggctcatgcctgtaatcccagcactttgggaggccgaggtgggcagatcacgaggtcaggagatcaagaccatcctggctaacacggtgaaaccccgtctctactaaaaaatagaaaaaattagccaggcgtggtggtgggcgcctgtagtcccagctactcaggaggctggggaaggagaatggcatgaacctgggaggcggaggttgcagtgagctgagactgtgccactgcactccagcctggacaacaagaatgaaactccatctccaaaaaaaaaaaaaaaaactcctcattttccatcccagaatgaggggcacagtaagaactgaacccccaggtaagaggtacaggattttgaaataggatatgcatataggggtgctgttttcagggttgagtccaggagctgaggtgacatctctatttttggcagtggctttggaaactttaggcgacagcctccagagccactactctgctcatcacagccttacactccaaggccagatgagccctctctgggatgctgcaggggagtcatgtttatctcatttcaagtcagtggttaatgggcagtggtgctgtctccaacaaaggagccctgccctctgaagtgactcagctgaagggaagcagagctcatgcgttcctgcactcaccagaatgtgtggagagcagttgagactcagcaaatttactggcaaatccaattttcaaaaccacgaaagtcatctcttgggtattaagcttgatgtctgaccgctacagcattcatggtcccaccctctcccacagttcactcatttgcccagattctgtggcaaacccatgtcaacactggaggctctgtagtctccattcctgaatgtctctgctccccatcgatttactgagactaaatgtccttaaaaacctcgaagtggaatactgcttcttccatttctaaaattctgaaccctgaatgattctcacatgatagttctctgacaactcagatcaaatcctgtgccaagcaatcaaggggagcaattaaaatctcatgttgtagcagaatttgtttatattgagtattgcttgaaataaatgacctgatgactgatacttataaatctacacttatttaggaattgttttcctttagttgggaaaatagggcttatctgtactccttaaaacacaaattttagaaattgtattggatcttttctttgaatatttgccacagggtcacgagactttagacactctttaatagtgcaggctaactgtatgtttagttaataagtcctgtatatccatagggaccattctataataatctaacttaatgtagctactgtgaaacttcaaaaaacttctttaatagagggcaacttttcatcgaaaaacttgtaagttttgctgtcatagtaaattcagcagagacatttaatggtgctatctatagcttgtctgtgtatgtaaaattatctacttaaaaccaaaaaggtttggttttagataaggtaaattttacccagttaaaatctcaggggggccaggcgcggtggctcatgcctgcaatcccagcactttgggaggccgaggcgggcggatcacgaggtcaggagatcgagaccatcctggctaacacggtgaaaccccatctctactgaaaaatagccaggcatggtggcatgcgcctgtagtcccagctacttgggaggctgaggcaaaagaatcgcgcttgaaccagggagtcagaggttgcagtgagccaagattgcgccactgcactccagcctgggcaacagagcgaaactccgtctcaaaaaaaaaaaatctcagcagattcctattcagtatttaatggatccaaggcattggactgttgtagtacaatgggtaagtgagaagatctaatccattttggaatatccttgctccacattgttttttccccttaagttgtctgttttttatgagtgaaagtttcacttctaatgaatttacaaacttcctagcaatgaatccaagtacactacatacagagggaaagattgaagacctgggaataaccagctaaagttgtgtctgcccaagtggttctatagcactgttgccagcacttaccctttcaaatgttcttactattcatggtatttagtataactggtttatcttctagggtgatgggttttgatctcacaaatctgaactcacagcagcaccataagatagaacacgtgatgatgagctggatcaaggaagttttcagtcaatgaagacaggaatgatgggaaacctcttaaaagcaaaataagcaaaaaagtttatatccaagatattgaattcagagtcttgtattacataatgttctgaagttcttatggttcagctgctcatagcaatgaggaaaaaaaaattcattcgtgaaatgctgatattcttgtcaggaagtagaagtccgaaacatactttctacaataacatctgtaaaaatagtcacagctccctattgattacttatcatatgatgacaggaaaaaatgacattaccaggttaaagaaattacacagaaaagccagtgaagagtactggaaatcctcagttccaaatatgaaggcacttcgatattaacaggaaagcattatggaaccaaaaaacttatacatgtcacataagggtgatatgatgacaatgaagggcaacaaataccttttgctttattctcaacaggtattttcttctaaaagatttctccaagtgctgagtcttcaatgctgctatttatttctaacatcttactgcactccacatgacagctgtgttgaagcttttccattttttcaaggcccacatcccagcctcatgcactttcaggagacggtcttgcctcctgctttactgagactgagacatttgattctgtcatttcttcccacctcacaaagtcgctacatcttccccaaccctctctttaattctaagactccttttatacccttggttctagtttatctggttctttcataattttgccccatcagtatccttcccaccttgagaatctccgtcaaccagttccttctcttgtcctataaagatcgtcaagatcagagttctgttgaccagtttcttcatagacccatcaccccctctttttccttattctgtctacttttcaaaagtagattctatacacattgcctcaacctccaactcttcctatttggcttctactctatgtacataaagggaccacccagatcaccaaaaaccctaaccagatcttgcttcttatccttcttgatttatctgtagtttttttgtttgtttgtttgtttttttgagacagagtctccctctgtccagtgtgtggtggtgcaatcttggttcactgcaacgtctgtctcctgggttcaagcgattctcctgcttcagcctccagagtatctgagattacaggcgtgtgccaccacacccagctaatttttatatttttaatagagatggggtttcaccatgttgtccaggctggtcttcaactcctgacctccggtgatccaccccccttggcctcccaaagtgctgggattacaggcgtgagccaccatgcccggcctatctgcagcactttacatcatccaccttcatgactttcttgacactgtatttaatacacctaataacaaactcaacttgttttcacccaaaacgttcccactttctgtcctacatttaatggtattactattctcctagagttggctagaaactttggtcattatcaactaatctactaacatttaataacttgccatttcctatcaagcctgcattcacaaagtattttggactaatcttttcatctccaaatccactgtcaccatccttcatgcctgggattcttctccctgagaccaccgcacccagcagtcaaagtcatcttccacacttactactcaactgcagttcatacccactctggcagcgctggaaacaaggcctttcaaaatctgctgccagtatactgtatattctatcaagaacagtcactgaggctgcccctgcctggtgccttcctaccttcacgtgctcactttctcactcagacccccacacaaatgacagcaattcaaggcgcagccaaaatctcatctctgtgaagtttcccctaaccctctccagcccaaagcccaaagaaacctgtcccttccctgctgtccctcagctttctgatcctccctctcttaaggaatgtatcaactataaccccaccatgtcaacatgtggagggtggggacccatcttggtatccttcacagatcccaagaaatcaatgaatgctgtttgaattacctctgagtataaactagccaagttctaccaatacagaatagaatttatgctaaggattactttacccagaaggattagtttcctaataagtttgttagtattcctcatgtactgtgctattattaggccttaatatagtatccctacaaaactgcataaaatgatggttcatgaacagtcacctcataaaatttgagctcctaaaagtcacaaacaataatttattagtcattgtatccctaacctctcacagtgtctaatattgtttaagttttaagaaagatgtttgccaaatttaaaagattttaggtccgaaaacaatgccacagaaaaaaatctacctgatttcttcacgtgttaaacaagagtgacagagatgctgccaacacattgattagctttaaagccaatgattagagaagcacaaagatattctggcagactgggaagcaaagaccaccatcacattgactgtagacctaaaccagaaggtaaggtgaagaatatcagtgacagacttttgaacctaattaaaaatgcttcttggccagcacagtggccttcacctgtaatctcagcactttgggaggccatggcaggaggatcacttgagcccaggaattcaaggctactgtgaagagtaattgtggcactgcattctagcctgggcaataaagcaagaccctgtctcttaaaaaaaaaaagcttcttaactaacaagactaagttaaattgaatgtcatctttgagtattcagtaatgagtatggaaaagtcactttagctgctaggtgtgcgacagttggaagaaggagactgaaatctgagagatttggtagcagactgtggctgtggtctcagggagaagcagctcaggcctgaagggtggtggcagtgggttcggagaagacaagatgggtccaagatactttgtggacataggcttgatacaacgtaggcttcatagctcttactttgcgtgtatacagtacagcaaatggccattgatttataatagatttactcagtttggcaagttgaagaatataaatctacatactaacatagaaacagatacaaacaaatcacatatatggctcaaggtcttgctgtgagagagatgactggtatgactaagtttaaaccctatttcatttctgcaacttctgagattttgtctcaaaaatgcattaatacaaatgtgctttttttgtctctctcagataatcatggacatattgatccctctctgagactcatctgggatttggctttccttggaagctcttacgtgatgtgggaaatgacaacacaggtgtcacactactacttggcacagctcactagtgtgaggcagtgggtaagaaaaacctgaaaattaacttgtgccacaagagttacaatcaaagtggtctccttagactgaattcatgcgaacttctaatttcatatcaagagttgtaatcacatttatttcaataaatatgtgagttcctgcaatgggccaagtattgtttcaggggctggggatacagtcgtgaacaaagacacaatgttgctgccctcattgagattaattctagtgagagaagataaaaagagacagtgagctaataaataaatatgtatcatatgatggtaaatgctatgaaaaaaattaagtagccaaggtggaaggatcacttgaggtcaggagtttgagaccagcctgggtagcatagcaaggccctatctctacaaaaaaattaaaaattagccagatgtagtggcacatgcctatagtcccaggtactcgggacgcagagttgggaggattgcttgatccaggagttggaggttgtaataagctatgattgagctactgtactccatcctgggcaacagagtgagatgccatctctgtctcaaaaaaaaaaaaaaaaaaaaaaaaaaaaaaaaaagtattgcaatattctaggcaaggcctggtggtggcttggaccagggtggtggcaatggggctggagagatgtttggattctggcagattgacagtatttgctcatgggttggatatggatatcagagatgagaggagttaaggatgatttttaggattttggtatgattaactagaaggacacagttttcatttaccgattggggaagcttataggaggaacagaattgagggagaattatcttgatttggggcattctaaattctataaccaaacagagaatttgtataatcttctggacagaagagtctgaagttcaggggagaggtctcggctgtagttgtcaccatatagtatttaaagccacaagactggatgagatcacagataatgagtgtagacaaagaaggtaagttatgtaaggactggatcatggaacacttctgacttaagcagttagagatatgggaaaagaaagtatttcaaggatgaggactggctggtagtactaaatgctgctggaaagtcaagtaagatgaggactgagaactgcccatttcattgagcaactggaagtcaatgaagggagagcttatcaagagccctctcactggcacagtggggacaaaaggcagattggggtaggttcaggaaaggatgggaggagaggaagtggacattccatcctttcaagaaatttagctataataaaggagagtaaaaggaaggaagaggactacagctggatgatgggtgagcatagggctgaaagggtttttgcattttttttggttgggagacataacagcatgtttatatgtcgatgagaaaaagtccagcagagagaggcaaagtaggaattgcatgaaagagagggaaaagttgttagagttactatctttgagtaggccagagaggatgtgattaatccagatgatattagaaacacggagagttcacatagagggaaagcaggaaacagtggccccagtgctaggagggcagatatcaaagtaggagcttgtggaagctctattctaactgcttctgtcttctcagtgaaaaacgaggcaaagtaataagctgagagcaggatgagagcaaaggtgttgggattattagagaggcaagctgaactaatcataagcaccaatttaaaaaattcgttttgttcataggtttacccagggatggatcatcagtgagtatcttctgagtacaggatttacccagcattaagtcatcatttttaatgtcaataatacatagtttggtttgctttccaaagaccacatgtacaacacacatcaactaaaaacctagattttgtctttacttatcaaaatgaacatgtctttccccatatagaatgcttttaaatagaaattatcatctaattgattgttgccatataacaagtcaagatacagtactagttcttttgctaggtaagtttctacctgtttctgacacactctcatctaccaagataaccacatcctcaacaagaggcttttactgtacctgattttaaagttagggggaagaggttgttttaagcgtagaaaatggtgtcaagataatatagaactaattgtagtaaatgtgagaggaaaacttaataggaatagagcaacacattgagataacagaaaaaactaggacatttaacatgttcccctttcttttgcagttgcatatgacacatttttaccactaggacatactagggtacaaaaatagcaggtgtatttccctcccattctaacccgtctttcatgtccatcatctgtccactaacatctctcaaccaaactgcacgtacgaaagcgaggacatacaagtaactagaaagttaaaaagcagaaatgcaggctgggtgcagtggctcatgcctgtaatcccagcactttgggaggctgaggcaggcggatcatgaggtcaggagatggagaccatactggctaacactgtgaaaccctgtctctactaaaaatacaaaaaaattagccaggcatggtggcatgcacctgtagtcccagctactcgggaggctgaggtaggagaatcgcttgaacccgggaggcggaggttgcagtgaggtgagatcgtgctagtgcactccagcctgggcgacagagcaagactctgtctcaaaaaaacaaaacaaaacaaaacaaacaaaaacaaatgcagagggagaatggtcattgactaagagttttagatttttttttccccctgcgatgtctgggtgttagataaataatagttgaatatgcagctgagtcatccaaggcaaatcatttcatctcttagggcctattaaatgaggactcacaaacggattgaagttaaactaatacaaatttaaatccctggagcaattaggatatttggtttcaaggctgacacgcatttcagcttagagttcttttaaagaaaagtatgcacatatccacaaagattttcaaattctgctattcagtggccactaaggtctcctgtgacccttcatcaaaagaagcaacacaagcaacaagcaatgatttttaaaaagacactatgagcagaaggtctaaatactgttctgagagactagcaacaggacactagggctgagaaagccagtatggcacggaggcaggaagtgactggaggtgctcttggcccaaggtagctcaaaaaaagtatgaagattataatttttccaaaaactttctgggaattactatcttgatactcagggctaatttcaccttttaatgcaattgtgtaaagaagtacaagcttataaactcacagccccaaatgaacaaggcctgagggaagagtgtgcaaaaaaaaaaaagaaagactgaaatgcaaatataaagtaagacacatcttactggcacaactctttccttagaactgaagaatagatgtcattcccaatactatgaggacagtgccaagaacacgggatatatgctggctagggaaaaaaatggataagcccgtacctttagcctttaatatgaattgagaaacgtcaagctgagtattgttctaactcttatcaatcagtaccaggtttgtaagcaccccaaactatctaacctgcagcacatcactatcagtcagctcatcttcacattaagtagaagtctccattagccaaagctacatatagaaaccatcctatctaccttatctattatgctgaaatctacttttgataacttctattactaacaaatctaattcttctctactaaaaccaccctagttctgttagagatcctttgctcccttttgggggaagcagggtggaggggcatggggtgggttgggttatgaccaagtaaaagggaacaaacaaaacacttccagtctgtctgcaacaagattaagtgctgagttaccaggaaatgtaacaacaaatcatcatccatttgggctacaagatttggcacttgtgatgatctgaattgaagccaaaaagataatttctgaataatattaaaaataatgacttcttggcagagcttgacatggggagggcagtccaatcttggcatcctttgccaggctgggatgtgcaatgtcctcttctgcatttttttaaataagctgtgctttttggtttggtttaaaggtggttcctcctaaaggaggaggaatctataaaaacaaaaatgtaaggggatgtttcgataactttattgaggaagttctcaatcaaatgatagagggttttaccagcattatcacgactcacattttgtatttaaaaatgggtaacactctttgtgcttttaccaaaatagtctgtcaaatggggctggaatcctaacatttgttttaagctctgcctcttttttgcctcaatggagactgccatgatttccttcagaaatgccattttcaaacgcagaataaggcattgttctcaaaaaaacattttaagtgtataagtaaaaccaatttatatatatatatatacacacacacacacacacacacttattattattttttaaataaagacgaggtggtctctattaaaaaataataatattgcccatgctggtctcgaactcctgggctcaagtgatcctcccactttggcctcccaaagtgctgggattacaggcatgagccaccatgtccagcctaaaaccaatttttaaattataaaaatacatggtaaacagtcaagacttgaaaaatagtgcagacagcacaaaagtctgagacaaatatccagctggtgtgggacatcttgggatagataatcatgtccttccaaggtcaagacagccaccaaatgaaggtctaacaaggctaaacacaccctcaaagcgacaatgccagactgatcactggaacctccagtaactgttcccttaagaaagagacactgaattttctctcatgaattctctgactttccagcttgtgcctcagatgtttgctttgaacattcgtgggtacactgtgagagacgagggaaacctactgactattgccaagaagaatcatagaaaatgcagttgatttctgatttatccaggccctctggggaaggaaatgcctcctttccttcaggcatttctgaaggaaatcatggcagtcttcagcgaggcaaagaagaggcagagcttaaaacaaatactaggattccagcctgtatcttccctccagacttcacctactggccatttcacggctggtaaaaatctccatcaatgtaggcaaaggggagtctaaacttttttggtggggggggggttgcttttttgtattctttagtattcttaatagaaacctggtaatgtaacgaaaatacaagtttaatcacttgctgcttgcagaatccaattcacaagagtgaggtctggtacgaagaaagtgactttattccaaagctagcttaggggaagaagtataggctcctgcctttaaggtactgtttcccttctgggacaaaaaacaagggcttttacagggggacttggcataaatggcatgcagaagagggtgcaagcaggtgcacggtctatgtgacttcttgggtgccttatctacccgatggtcaagctgacgccattgtgggcagagctagattgtaaaatggccattgtttcaagacacttggacagagttccctcatgggcctaactgaggttgtaaattgactgttgtctcttaaggccttctcctggtgggagagagtcccagctctcaagcattgaagtgagcacatacataagcttgccatgcagggagtgtctggtaaaagggaaggtaaaagttatgattccatttctaaagagctaagcaggaagtagagaacagggaaaaaggctgaaagagaaaagaaaaaaattgttttttaagtaactcattctctttctcttagaaaaatggagtactcagttatagtaggaaaagactcaaattataatccaaattaaggtatttttaaaaaatgttctttcttccatttttactagtgaacagataagcactcttgcaaaaaaaaaaaggaaatgtcagaaagaaaatatggagttggtttagtcactagtaaaatgtacagaaacgatgtgaataaaagagatgaagacaactgcctgcctactgaaaaatatccaatgcactggttttagaaacagcgtgtatagcttcatgtggtatatatgaagaatgtgggtgttggagtcagtagatctgggttggaattcccatttgtcccttcctagctgtaatctcaaattacctctcctgtaaaaccaggctcataatacacagattgtaaaggagaattagatgagaacatgtagaaggtgcctagcacagaacccagcccatggtggaccttctagaattactgattgcccctccccttgtcttattgcctgtcatatcagggctaatatatcagcttgaggtatatatacagtatctagatccttaaggttgttaaaagaatctccctattcccacagactttggtctccatcagaaaaagtgacagacattcaaccagactttcatataactcagtgacaagacaaaaatgaggatccatgacttccatatcttgaagcaaaataccaccaaaaaccgtgaggctgaaatcgaaaaggcagtaggagacacaaggcacccattcaaaacaagaatgtattgtatagttattacactaaataccaccatatttattacactaactcttttttctccctctagaaaactaatgatgatacaattgattttgattatactgttctacttcatgaattatcaacacaggtaaaacataacattgtatgtagaattgtttttaccataagtttttgcagattataatattttataactctatttcctaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaaat

SEQ ID NO: 38723 - DNA, 38357 bp, Homo sapiens
gcgggctcttccgggcgccgcagcttcctgccaagcaccgcgcagccgcctccgccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccgccgcccgcgccagcagagccgagtccgtctccgcgccgtggcccgaacccgagcgcgagtcgcggccaccgcccggcccggggcccgggaacaccacccggtttgggtctggggcggcgggcggcagcggcagctccagctccaacagcagtggcgacgccttggtgacccgcatttccatcctcctccgcgacctacccaccctcaaggcagccgtgatcgtggcgttcgcctttaccaccctcctcatcgcctgcctgctgctgcgcgtcttcaggtgggccctcccgccctcttccttcccccgccggccgacagggcggcatcgccaacctgctgtcgccgcgcgcccgccccacctgcacgcacaggtgccctggtgcgccccagccagccgtgtgcctcctgccctgcccgggagagtgggtggggggccggggtgtgctcgtctggattttcctggtacatgttttaggaattttctttcctctctttaactatatatataaaataaatatgtggttcccatttgttggctttctgctaatgctgaacactaacaatagcgctctgaattctgacagcgtttcccataatttatttttataatcatttcacagatgaggaaaacattttcagagaggcaaaatggctcatctaaggtaaactcagtggtggaggtaggacttgaacccaggcctgtctaactttaatctcgctactccctctcccttctaccatctgcagctccctcacgccccgcctactttttcttcttcttcttcttcttcttttttttttttttgctactgaaagaagcagtttctagtgtggggggtagtagaattgcctccagaattacgctggaggggtgctttgcaccaggggttggagctgagcttcaggattctaggcgacccttggtggcctcccttattttctgttggtgggggacacagacggctttcctaggctcctgcctaagttgcgctagatgaacattcacaggggcatgagggatcttggagagccttttgtaggttgctcacgttcagggataaagtgtctggtaaattaggaaggatgtcccaggtccttgatccctgtccatcctggtggacagggctaagaggaatgcaaggacatttcctttaatgcctgggaaatcctgtttttgcaggaaatgaaccaaacctgtcctgttactgaggcccgcctggaagtctgggtgtgtgtgtcagctgttcactgctgcctccctctgcttccaagcgtacacacagtgctttggtgtttgatcagctgtggcaggttgggcttcagggcttgctctcctggtagcattttcagtgcaacagcagaaaccagaccaggaaaaggcagagttaggagccatctatgtattgagctttgctgtcagttgtgtgtgactttgagtccaggtgttttcttctgtgtctgtaggattagatgccagtggtctgagaaaatggagaaaggggaagtatggtcccacgctcacctcaccattccctgccttgtctcaggccacatcgttcctcactctgctggtctccttgatgttctctgggttgaaatgctcctgtcttcttcccactctacccactggcctcaatcctctgtttacaaactctagcagctctctgtggccactacctaggcatggcaatacctgggtgtggcatttggggcccttgcaagctggcccccgtctgcaacgcagacatcaaccagcgcttctgagcctagtaccttgtcacttgctccttatgctctgtggtttcccgcttctagcctaattcttgcctctatattctacaagtgcgtgcagccaccaaggcccagctcccatcctccttcctctgtatagttttcctggacatttgaatgaggctgtcactattttctgacctcctcatccctaatctgtgcatccttcagtccaaccatgccatgctggcttctgcactcagcagagggcccttgaggttgggaagtccagttcatcttcgtgtctccatgcccgatgcgggcctgccattcagcagaggtgccattgtcatctacggacttcctgattgttcagttggagtgaaggttaatgcctagagcagctctgagtctggaggtttgaaacatttagctcaaaataggccctggagtccacaaggctgtgtattttttttagaaggtatttgaacaattttgctagtctgctgtttattactcaggagtaggggagaaaagaaggcagcatgcacccagatgtgaggggtgcgagactcatgttggagtgggtaagccagcactctagcctggaagagatgggtctttagtagcttgggtgtggagtgttgaaagaagtttacgacttcataggagaagctggttatggacatgatctgcgtctcttcccaggaaggcaatcttgttagggtgagttttcaggtggacagctgccaccccagattctgatctagagaggactttgtaatattttacagcttgcaagggccctgatggtgcacagtccccatgtgtttctttgcagttgagaaagttgcatcccaggaagtggaataagtcattgctagattctagaacactctgcaagtctgtgtagccaaggcagggccagcacctcatctgtgctattcggtctgtactgtggcctttcccctgtcccacgctcccctgtaaccttggttagtcagctaaccaaatgcctgctctgctggctgggggccctccttcctttctccctctgcaactccttagcctgcgggcaccgagtcctggaaattccaccacctgagtctccaagagactgtctcacctctgcccacaccaccttccccagtgaagcttcgccacctgccgccgtttctaccttgtcgctcctgaattgcaataatatctgttaagctggggttcgtgcctccaaccttgtccctctccagtctgtcctccctcaactgcaggaatgcctgtctcatccttcttctacccctccctgccaattctccctgcatacagactccttgatgtgtgggcaaggctgactcttcagatcagggtgctgcctccctcctgagcccccatctcggctctgctcagtgcgcctcctgctttgctggacttcctggggttctctggaggcactgcgtggcctgagcatcttgtcccactctacccctctgcctggagtcccctctgtcactaagactgcgtggtcagttcggtgctgtttgacctcgttgctgttgcctcctctgagaagcctctgcagctagggcccctctgtgcttccaaagcacactcgatttttgaattccctcttcagagtcaagtgccaccgaacttcttctgagcaggactaggcattaatcttctgtgtttccctaatacctagtgtggttccaggcacaagctggcatttaataaagatatttttagcaaaagaatgttgagctctcaaggattttacattgctgatgtctctcaaaatgtgctagactagctgcatgactgatgctggatacctgcgaggtaggaatttgtacaatgtagataaaggagagtgtagtaagtatgattgcgtataaaatggcagtcctagcctatttctctgttttctctgaaggagtcaccttaccagacaacagaaaaaaattggatccaaggaaattagaagcaaagaatgtgtcttttaatgaaaaagatgtatacttttaatcaagtgattccattcttaaagtatgtacattttccactgcactatatattctttgcttctaatgtgaatgattagaagagaaagccaagatgcaagtgcaatgatattcagagaagctctgtttgatagtgaaaaggtttaaataatccaagtgtccaacaactgggcattggttaagcaaatcatggcaatctttatggcagaatactgtgcagctgttcaaaatgatgacattgagataatacttgctatatatttttgagtctgaaacaggtcacaaagtgacatgtatagtattagctcatttaaataaattataaacatgtatatacgaatgtgcagataaatctgtgtgtctgtgcatgtgggtgattatcatatttttttattattcacgatatgtttctgcatagtttgaattcttttacaatccagaagcatgtagttatgatgtgtgtatgttgagtatccctgtgtgtatactcagctcctggccgcattcttggatgtgtctttctgaggaccagtatgagagcatctggggtgtacacctgggagtggggcttctggatcctagggggtgctcattcttgatttccttgagcaggcaccagtgtaggtttccatctgcagagcctgagggttctcagattctcacatcatatccaacacttagtattatcttactttctaatgctttccaatctgatgggtataatttggtattcattgctttattttgtatttcttcattttctaccatagttgagcctctgtctcttccaaatgttctccttaatcaatctgatttccccatctgtagaatcacgtccacctttttaaatgtatttcatcattaaggcaaaccatttttagacaggagacaaaaatcggaaggagggaaagctggctggagaccgagggccctttgttgggtaccttcacatgtgtgagagtggtcctacaggtacctggtgtggtgaaccccctgggtctgctacttggcaggtttatgggagctgaaagggaatcagcaaagaggctgtctctaggaagtagaaagctgtgattgctcctaattttttggtattgggaaacaactggtgatgttgcatggattcaggataatacacataagccaaggactgctggtatcagtaccttttgccccctacattcactcagaacactttattgtctgagttctggaaggaatctgactttacgctctggtgtctcatgagcagagcgggggcaagtcaggaaaaccctgccacctcgaaaccacaacgttcctttcatcctggggatcctttcccagtcttggagagtctccgaactccacggtgcaggctccagttctctagatgtctgttggctgcatgcccagccacttcttacttcaaaatctctgtaaaatcctcttatctgaaaggaggcttctttttggtgcttcccgagggatcgggaggttgaattctaagcggtctgacattgcccagctgtcagtgggaaaggtgcacactgctatgccctgaagacattggaaccacagatgctttgttaattttactaagccaggtctttgaaaaggaacgagaactttcctacttatcttgtatttcctaaattctctattgtgtgtgtatttacatttgttataagaaaagttatttaaaagaaaatataaaagcttaatacttttagcatttagggaaagttaccatttaaaaatttttttgtcattgcttattatttcatggtatatcaatattattttagtaaattggagttttgggtggagccatggttagaaggtccagccccattttgatttgagagaggttgtgggacttgttagcatcagtcggtcgtttctcattgcttccccaaggctttgaattgaaggaaaaaactatagaagtgacaaatgttcatcttctttcatgtttgatattatatgccacagtgaagaagtgttaagcaaatcggatacagccaaaatccagattctttaaaaaagagagtagagagcaagccgaaggattttgcctcctggtgttatttggtcatatctggagacattttggattgtcaggatggggagccccaaatgtcaagggtgccagagttgagagatgccgagaatctcggcttcaaggcctgctggttgtctgatatgggcagtttattgaacctttctgggcaccatttctcatcattaattagagtacatgcttccaagggctattgcaggtttagaatgagattgtgtcaactaagtctctggctcccctttaagcagtcaagtgtcctattatattgaaaaatacgattctgaaaacagatgtaatttacacccaaccttttggtcttgcttctgtccataaatgaggatgcagccatatggccacaattatcaggcaggtgcatctgtttctgaggctctttgaaatgaaattgctgactctttagcccaagtgagcctccttgactactcaattccctgatgaaggaggcgcctcatgactgcccccattaacaggactgtgaagacctggcacctgacgtggattccttctatcaaattggaaagggaagaaaatccctctttaatttaagcctgagcctcctgacttatatggcattacccatagactttcatgcccatgtaggctttgtgtatgggtgtctttgcaaatgcaggttcttcttgagacaccaggcaaatctagggtaagcagtggggactaagggaactccaatgtcagtatctgtagagcatcctgtagggcgagtgtcaagagagggaaacactcctggatttaagcaaagaagccttcatggattgtgttagtactttagttttatgactgaggttttgggtctaaccatttgcaaagggaaatcctgggaccatgaatttaggatcatgttattattgtttcacttaaaaaataaactatacttaatctaagggcaatctgccaggaatctagatttgctatttattttcctgagggtgcggggaggaggaaaccctttctcacgggcaggtgtggcacagaggagggaccatggcaaagtgcttgggcagggctcttgtaggcctggcagagcccttctagacccctccctctcaggtaggcgtttctttgcattcagagctccttccgcctacctccctacactcattgtacagatgagaaaactgaggcccagagtggggaggcttggtgaaggtcactgagtgagtttgtaggaaaaataggacttaaacctaggggcttggatgctcagcttggccctttttggacctccaagatgtggtgggctgagtttggccctgtccagcgaggtctccccaacactgaacccagcacctaggagcaaacacggctgagtaaacagtgttcttcccagggtgtttaattagcacccactgtgaacatagaggtgccatggaacacatcagaggtcaaggaccatccagctcaatctaaggcataggataatgccctttgttgacaaaaaccccaaactctacaaatatttaaagaggtttattgtgagccaatatgagtgaccatattgacctggggaacaatatcaagaggtcctgagaacgtgggcccgaggtggtcaggtttcagcctggttttatacattttagggagatagaagttacaggcaaagacatgaatcaatatatggatggtttactttggttcagcccagaaaggcagggcttcttgaagtggggcttatagaccataggcagattcaaagaggttttgattggcagttgcttgaaagagttaagctttgtctgaagacttgaagtcaatagaaaggaatgcttgagttaagataaggggggttgtggagaccaaggttcttgttatgtagatgaagcctccaggtagcaggcttcagagagaatagatggtaaatgcctcttttcagatcttaaaaggtgccagacttttagttaatctctcctagatccaccaaaggcctagctgcattaatgaagattctctatagatgcaaaaattttcccacaaaagatggctttgcagggccatttcaaaccatgtcacagacatttttgggtaaaatttcatttccttcagggcctgctgtctgtcatgtgatgctacacagaatcaggttggaatttggtatcttattgccacaaagagccttgttttgccagtcttatgatctctatttcattattaatgctggtcatttgtgcctaaactccaaaagggaggggtataatgtggcgtgtctgacctcctttcttgtctaggcctggaatttagtttttcaggtttctctggggtcctcttggccaggtctcttcaactggctggggggcttagaattttatttttggcttatggcttgaatgattctacttggcagataaggagccgtccaatcccacaggggagccatgtattaaaagcaatgctaggtaaactgagaaaggatgggtcagggaccagaatggtctgggaaggcatggtggaggaggaggacgattaggacttggcaggatgggaggaagaagaggttcttccaggaccagatgggtgaagcaagctttgctgagggtagggtttgtgaaatcacttggaaattgtgatgttgatgacaataatagcaactagtatttattaagcccttactgtgtaacggactctgtgataagcattttatatgttttcctcactcctatgagtggtgcactgtcagtcctgtcgacaaaaagagtcaagctctgtaaaatatttaaagagatttattctgagccaaatatgagtggccactggcccatgactcagccctcaggagatcctgagaacatgtgcccaaggtggttggggtacagcttagttttatacatattagggagacatgagatatcaaatacatgtaagatgtacattggtttggtccagaaaggcaggataagtggaaggggggataacttccaggccataggtagattcacagattttctgattggcagttggttgaaagagttaagttattgtctaaaacttagaaatgtctgggttaagataagtgggtgtggagaccaaggttttattatgcaggcgaagcctccaggtggcaggctttggagagaatagattgtaaatgtttcttgtcagacttagagggtctatcaataaatccaaaagggaggagggtagaatcaggtatgtccaaccccccacccttcccatcatggcctgaattagtttttcgggttagctttggcactgctgagattccaaattgctgtcaatagccttgctgagaggaggggttcattcagatggttggggggcttagaatttcaattttggtttatcatccccatttcacagatgagaaaaccaaggctcagttgttgaagtgtcttgctcaaggatgagcagctggggaaggggaggagtccgcctcacccttcccattgcagctggattttggaagccaattccagctggaggactaggagatttgtagtgggtgagaggagcaaatggaggattttaatacaagagtgaagtaatcacagggcttctctagaaatgttggtccagatcaggttgtaccaaggatttaccaagaatgcatgaatagtgacgtggctggtgtggggggtgcaggatgtctggggagacccgtggaaggtgctggaaggaccacttgggaggactggaggcctgaatggatgaagaggagaaagaggaaagtgtcaggctgtcctgaagggcatagagaaggggggcattgtgaagggggtgaccaggcagggaaagggataggtttggtgaggaagaagaggactcacaggtgaaacttgctcatgaaaactccagccatgcagctgggccttggggctgggtggaggggcattgggagcatctgcctagaaggagtgggtggtgaggactgacattcccaccctcccctacctgggtggcagggataagtggtactgaaagggccccttacgacatgtgccccaaagcactgtgacctcagagtttccaggtggtggtcaggtcccctgggtccaccaagggcccctctgggtcatcttgccgctgtccttgaccccatggggctgcccctaggggctaccttctctgctttaaacctcacttcccttccctggccccttatataaaaacaaagcagaaccaaccctttgcaaacacacccgagagctggaggaacaggtcttggggcatttgctgttgccggatttactgtgtgctgcttttgtcttggaagagtaagcattggatttatccctcagggactgagagagggaaagagaaacaggatggggagcagatggaggctaaacactttagtgtaatgaagaaaaacctgaagacttgtcattgagctcttcagggttgtctggcccatgctggatgatcctctatgaagcgtaagcccccaggggcacggtctgtgctgtgtgctgcatgcccatcctggggtcaaccaacagtgctaacacttggttaaccccaatgggatggtgcccaggaggtagaggaagcagctagattatataaataatggtcaatactccttagtcatggttgaactgttggtgaacagagataaggaaggatttagtggaacgtgcatatcattacatctctctgggctcatgattttgagctgagttactaaatatcactcatgcttggcacgtaggacctaatgaaccatggtcagagaaccaagtcagagatggtaaactgatggcctggggctgaaaaatgtggcccacagacatttgttttgttttttgatctgcacagtgttttaaaaactaagatagttgagaacacttaaaagttaggagcctttatataaaaatctagatttcctccttcttttgacaggtggggatacatggaagtgcaagacctctgttccggggcagccgggcaggagcttggtggctgccactccacctaggctgggcagggtgccgctatttgtgcctttttgacttgaagacagagtattgtccaccacttgtcactgttgtttgttcccttgtttaggtctcagcagtcctgctgctctggtttcttttgtctacaaggccttggggcatttgagttattgacctggtatgttgagccatggtgcttgactggtgactgggtgctgggtgctggaactgaggggctgcagcgtggtggggagggggtgccctaggacaggggtgaggcgagggtgcatccagggtctccccagcctctgtgttggggagggttctgccggagctggatggtgttggagcttggctgctggagatctggaggctcttgctgcactagaggaaaatgcttttgcctcatgtgacttatttgtctgaagtggcccatctgcagtggagtaagatgagatttctatcacaccggtgtttgcctctcagtggcttgtcgaaaatgctctaggtggaaggtgtcgggtggagctcagagggctgtgcccagggcagaaagggaggtaggctggttattgggaatgtgtcttggtggcaggccatggtggtgagaccctggctagcctgttgattgtccaggggcctccaacacctgcttccttacagggtggggcagaggctagggctgaagagtgggttctgagtcatgttcttcatttcttcaagtgtagctggttttctgggggaagctctgttacttcttatgtcctgaggaggaggtgcagcgtagagctcagagggtaaaagcgaaacaggtctgtgtcctcagagcattggagggaccgcttggctcagggtcgcctgctagtcctcctgtctacactggcggcacctgtgtgcttcagtcttcctctcccatgatccattttcattttcttgattactttttccaaatgtcagagttcacgtgtgctgttcattgacaagtaatatggttttggcagaacgctggtccttgggctacagaactactttagtgggcttaaaaatggaaacagcccactatttccatttcctccaggtggaggaaaggtttgagtcactgagtttgggttctgaagtcaccaggatagccgggcaaagccacatggagtcagccatgggtgggccctgggagaagggtctcctgccagaggggcagcctgacacagacttactccatttcaaaatttattttaatgatttacattgaattgtatttatatacttggttttaaattaggtcatatattcacatggttcaaaattcacaaagaacaaaagagcatatagcaaaaagtattcttaccttttagccacacagttttcttcactttgtgttgtcaatttcttgtcaaatctttccagggagattttataaatatagaagcaagtgagtgtaatatatacatgcatacacacacacacacacacacacacacacacacattccttccctatttcttataatgactttggtgagatataacttatatactatattcactcatttaaagtgtccaacccagccaggcatggtggctcatgcctgtaatcctagcactttgggggccaagatgggaggattgcttgatgccaggagtttggaccagcctggtcaacatagccagaccccacctctcttaaaaaaaaaaaacaaataaagtgtccaactcaatggtttttagtatatttacagagttgtgcatctatcactgaaatcaattttagaatacattcatcactccagactgaaaccatgaatccatagtagttaatctctatgtgtctctgaattttctttctgtgtatagatttcccttttctggtctttcatatacatgggaccatacaatgtgtggtcttttgtgaatagcttattttatttagtacagtgttttcagggttcatctatgtgtggcatgtgtcatttctttttattgccgttatgttccatcgaatgggtataccatcttttatttacccattcatcaatagatagatattgtagtagcctgttctcaggggctgctataaggaactgcctgagactgggaaatttatgaaggaaagaggtttaattgcctcacagttaaacctgcatggcaggagaggcctcagggaacttataatcatggcggaagaggaagcaaacatgtcctcatggtggcaggagagagaagtgcaaagtggattggggaaaatccccttataaaaccatcaaatcttgtgagaactcactatcatgagaacagcatgggggaaccacccccataatctaatcacctcccacaaggtccctctcacaacacatggggattatgggaactacaattcaagatgagctttgggtggggacacagccaaaccatatcaggtatttaagttgtttcctttttggggctattatgaataatgctgctctgaacaagtatatgagtttttgtgtggacatgtattttgatggctcttgggaatatacacctaggagtggaattgctgggtcatatgataactccatgtttaaccttttgacaaactgccaaatggttttccaaattgctgtactagtttacatctcactagaagtgtatgagggttatgatttcttatatcctcaccaacatttgttattgtctgtctttttgcttatagccatcctaaggtataaagtggtatctcgttgtgtgtttaatttgcaatgcattgatggctagtcatgttgaccttgtttgccttcgtgtattgtgcatttgtaaatcttcttttgagaactgtctattcaggtcttttgcccattttacattgggttatttgtctttttattattgatgggtaagagttcttcatatattctacataaaaatactttgatcagatgtatagtttgcaagtgattcctcccattctatgggggtgtcttttcactttcttgattatattctttgaagcacaaaagttttaaattttgatgagtccaatttatctagttttttcttttgttgcttttgcttctggtgtcatatttaataagccattgtctaatctagtgtcgcaaagatttatgctatttttttctaaaaatttagctcttacatataagtcttacatacttatatgtaagttccattttgaggtaatttttgtatattgtgtgagttaatttttttagatgatttataggagtccaactttattcttttgcatgtggatatcttttctatctcttacacatacactatgctttttaccttgctttataaaaatatcttgtgtgtctgagtggttattcctaaaaagctcttcattcatttatataggtgcttagtgttcattatatggatgtaacataatttatttaatcagtcttctgttaatgggcatgtaggtgtcatttcacacatgtggaaacatacctgtaggacaaattcctagaaatggaattgccgactaagggctataccttttgtaactgatggatattgtcacactgctctctgtatatgttgtaacaatttacatgtccacaaacaagtaatgagagagtgtttctgtacatccttgccaacagtgtgttttcagacatttctatttttgctaaattaataggtgaaaaattgaatctctgtgaagatcaaaattacatttatcttattgaaagtgagattggacattttttcatagttaagaatgcggagccatttaggtttgtgtgtgtgtgtgtgtgtgtgaactgcctgtgttatgttctttaccagtttttcaattagattattgatcttttttattggtttttagggactatatatatattaaggagattaaattttaaaacatttataatatgttagccaggcgcggtggctcatgcctgtaatcccagcactttgggaggctgaggcgggtggatcacttgaggtcaggagttcaaaaccagcctagccaacatggtgaaaccccatctctactaaaaatacaaaaattggctgagtgtggtggtgtgtgcctgtaatcccagctacttgggaggctgaggcaggataaacactttaacctgggaggcagaggttgcagtgagccaaaatcatgccactgcactcctgggtgacagagtgagactgtgtcttaaaaaaaaacaaaaaccaaaaaacaaaaaccaaaatttatgatgagttggaaatagttctcccagtatatcatttcctttgacttttttttttttttttttttttttttttttttgagatggagtctcactttgtcatccaggctgtagtgcagtggcacgatctccactcactgcaacctatgtctcatgggctcaagcaattctcttgcctcagcctcccgaatagctgggatgacaggtgcccaccaccatgcccggctaatttttgtatttttggtagagatggggtttcaccatgttagctaggctggtctcgaactcctgacctcaggtgatctgcccacctcagcctcccaaagtgctgggattacaagtgtgagccactgctccccgcctatttaccttgactttaagacatttttatgtgtttacatttatcatccttttttaaaaaaatggattttggatttctcccatgttttcttctagtacttctatggttttattttctacatttaagtctgatccgtctaatttatgctgatacaaagtgtgagatatgggtggttatcaacaaaatatttaatgagttacctttttctcactcatttgaaatgccatctttatcctatactagattccagtgtgtatttgggtgtatttctggactttctattctgctatagcatctgattgttagtgtgggatgccactgtgtattagtctgttcttgcactgctataaagaaatacctgagactgggtattggctaatggttcagcatgctgtacaggaagcatagcagcttctgcttctggggaggcctcaggaagcttccaatcatggtggaaggcaaaggggagcaggcactcacatggtgggagcaggagcaagagaaagagcaaggcgggaggtatcacccacttttaaaccaccagatctctcaggcactcacccactcactatcataagaacagcgcgaagaggatggtgccaaaccgttcatgaaggcccacccccatgatccagtcaccttccaccaggccccacctccagcactggggattacagttcaacatgagatttggttggggacacagttccaaaccttatcacactgtgttcagttattgtagttttacagcatgttttactaatctaactcctttatagaattttcatggctattccattcttgctgcttctcccatcctcatgaattttggaatcagctcatttagatccccagcagaaattggtcggtatcttactgcatttcactgagcttgcagattaatttagatggcttgaaatctttatgagattgaaacttcctagtcagaggcgcagcgtgccctccttctgttgacacaagcttgttttggttgcttttggttatcgcgggagctggctggcaaccaaaagaacttgcaggggcacctctgggtcctgagaagtgtctgttgaatgccgagtcgtagggttggggcacatccagaggtccgaggtgagttcctaccctcttgttggagtgtgaagggctcatgttgtggagtgtgatgcatctggattcgagctctgcttgcttcctgggacaggtcactcagtgccttctggccttggtttccttgccttgataatgggagccctccttgcctcactggcgggaggctgtgatgagatcacatgtgcattagctggcactcagggttgtcgcctcacagtgcctgctggtaccgtcaccccagtgctgtggatgacgcaggaggggcctgtgtgcctggaggtcatgtgtagacagtgccccgtggcagggatgtgcctatgaagaggggctgcaggattcggaagaaggagaaaacccagcctggttgcgatgtcctgcaatggcctcaggagaagtgagaaagcctgtggccccctggagtaagtagagtgagaagtgttagaggctgtgtcatcagaacccggaccacacctggcaggaagtagaaatggatgaagaaattcgggttcatgacgagaggcttgctcagaagcacaccaacaggggaattgcagggctgacccctgaacctcagtcgctgcactttgagttggtggctctgactgtcacactcaaaactgaactgagtctaaagggtttagtcctgttttattctcttcgtgggtgagggcgaggaaggaaggcctccccctctgtaggctgccagggcctggtgtcctccctcggcctccttgtttgtataagtgggacgtatgagcactcacacgaaacctgtttctgagcagctggtgaacagtccattgagtaaacaaaccctctggcttcaggattatatttcagactaaaagaattttgaacctctcctctctcttgttagaaatgagttttggttcggatggaagggtgctttatctcttctagaaattatctggccttgcctattcctgtgaagacaatatggacatttatttattaataaaaggaccactttacatctcaaccaggttgaggcctcctggttaacagtagcctatctcagaaaagaaagattcctgctgtggaagatgggccagcagtcttttcacttctttatttcccaaagttcgttctttgatggggagtgctagctggtctgtccttgtaggctgccgtcccactggcccccagcaccacccagtacacagctgaggggacaggctctggacgtgggggcactgggctgcgaacccaagtctgattgcaaacctgggctctttctagaaccaggtgctttgtccttgagctgcgtgtgtctttgagtaaaatgagggccctgtccccaaggctggcccactgcccacgaatggacccaggggatttcagcttcatcacagccgtgtagtctctgcctttgcctcaggctcatggcagttctgggaggtgcagttgccggttgtttgtcctcattgaaagcctgcttacaggtagccctaagcaaaaaatgtcaactctgcttctgtgtgtgtggttcattgtttctataaggggcagagtcctggggtttaaacaggcttgaggatataggaaaattatacttacatatggaaggctaactattaaaatgtggaaaaagccccaggaaggtgttgtgattacagtggtggtttcccttcgtgcagtgccttccctgagacctcgaggcagttaaggtttgctaggttgtgtgtgtgacagaaaacctggccccggctggctttggtgaaagagagagtagccttgtagtttttaaggagagctggcttggtagtcgatttaggacttggtctctctctttccaatctgccctctaccatattgcctttactttctgtttctagatggtggcatgatggcttatgtcatctgggcctcaaggccagtgggagggacacccacctgccctgttccagccttcacagcagagagtcattggctcgggttggtcgtgccttcccctgcccactgccctgctcctctgccattgccatggcctggggggtagcaatgcctggattggctcaggctccaggctcacgtccactcctggaactgggggtgtggccaggcccatgtgggaggggcttcacccagggcacagaggatacagatgccaaaaggagggaggaagtgggcgtgggctggctgcaaaccagcacacctgagggagtcacagtttaggaagggtttgttagaagtgtgtccagattagtgtggaatatgaaaatgtgagctgtgcaaagtgacacattccagagtgtgatgagggagggcaaagagttttttggcgctaaagtcaagtggctgcgaactccggtgaggcgtggagtggggctcttggatgggagtgagtgggggtgacagagcagggcataccagggatgactcaaggcgacctgttggggaggtctcagctggagcaccccctggccctctcaggggtcatatgtgctcactatgccctgtgattttcccgagttgcttccagtctatactctcaagccccatgcagcctatctccgcggcacatttcagaccatgggtagttgtgcggcactttcactcacccacgtgggaaggaggccccactgaaagtctcctggtcactggactgcctgcttcaaaccctagctctgccactgattagctacatggctgtgggcaagtcggcttccctgagcctcagtctcctcagttgttagacagggataccagcagcacatgccttgaagcgtgctttagatgttttacatttgatcacaaatttaaatcgcttagctggcacccaggaaaagttaaacttttagggactattattattattattttgagtcagggtctcactctgtcacccaggctggagtgtggtggcgagatctcggcttgttgcaacctccgtctcctgggttcaagtgattctcctgcctcagcctcccaagtagctgggactacaggcgtgagccactgtgcccagccttatggactattattttaaaagacacgttaaagaatctacacttagagaagagagagccagacttggttagggtttttaggcttcgaatgcactctattttcccattttctcacgttttctctctctctgaggcagaactgcactgttctctgagcccactgttcagacaggcttgcggatctgaaggtatgtggaaaatgctgattggctctgttcctaaatttcccggcttctgactggtgcatagttagtaaaggaagaattctccttttaatttgagaaatgtgctgggtgcggtggctcatgcctgtaatcccagcactttgggaggctgaggcaggcagatcacctgaggtcaggagttcaagactagtttggcctacatagcgaaaacccatctctactaaaaatccaaaaattagctgggcatggtggcaggcgcctgtaatcccagctgctctggaggctgagcagggagaattgcttgaacctgggaggtggaggttgcagttagccaagattgtgccactgcactccagcctgggctacagagcgagactctgtctcaaaaaaaaaaaaaaaaaaagaaagaaatatgtgaagatttcctgcaccctcaatcccacttccctgtccctgcaccctcaactccatttatacgctatgaggtttcctgctaccatccgcgaagacccttgtcaacacagccggtgcaccacagctgggaacgtgtctcgatgtctttaaacttctcagcagtctcagttttatccctattaacacacccagcagtggaaacagcagaaattgctcttcttttgtaaagagagttgtgtttcagagagttgattgtttgaaatgtaatttctccagctcattatgtcaaaactggcatttgaagcatacatgaggactcttgctaatagccttttgtatttggattcttcagggaaacagaatcaatagggtgtgtgtgtgtgtgtgtgtgtgtgtgtgggtgtgtgtggagagatagtgagcgaaagagaggagagagagagagagacagagaaagagagagagagagaggcttatcgtaaggaatcagctgatgtgattatggaggctgacaggtcccaagatctgccatctgtaagctggagacccaggagggctgatggtataaggtccagcctaaatgcggacaagctgcagactcacaaagagccgatgtgttagtttgagtcccaaggcaggaaaaaaactgatgtcccagttggaaggcagttagacaggaggagttctcccactccttgagggaaagctgtgtttttttgttctattcaagccttcaactgcatggatggggcccacccacattagggagggccatctgctgtactcagagcccgttgattccactgttaatctcatccagggccatcctcgcagacagtgtgaccaaacgtctgggcaccctgtggcccactcaagttgtcacagagcattagccatcacacctttggtatataatcttgggattttttatttcctggggttgcttggctgcagaggctggcattaaagcatcatgggccacagtgttctggatgctagcgtagttttcctccttctcctatgggttggggttcaagggccttattttagctcagcaggctcattttcttattgtaagactctatatacgtgaatgataagattatagagaaggaaagtgattttataggtgtcagggattcactcccatgaggcagggctagggctgaagacagagcctccggagctttctcccagggtcagccatcagtcctgccccagggccaatgactacacgaggcatcaagttccaagtatgcaatgaggtttgctaatccaattttgcattttctgggctttgtggtgcctgaaaaagagtcacaaacatgactatgactcctcagcctgaagccgtctgggtgtgtccttttgagggtccacaggggactttctcatgtccttgggtttgaaggacatttcttttctcccgttccagatgcttgtttagctgtgtgtcagaaatggacagcccagccttgtccctttgcagaagccaagctctcctcccagacagccgcaacttgtccggagagagatttagggctgtctttctgagaaaggcgtgtagatcgggagtttgaccctagtctcaaaggcttgaggatgggtggtttttcatgtggttttgtcttggattgcttgtggcatttggatccacttctgggcttaaatttccccctgccagtgttgagatggaattggtctggggttataagtcatctagggcagaatgcagagatttattttactcctttggagggaggtggagagaagtatctcttgggggagagaatgtggatccaactgtttataaaggtagcatttaagtcccacacaaagcttgatttctaaatactgttgtcccagggctactggcaaggtgactggcagtgtgcccctttggtttatcctcttatcaccaggcttggcatttgcaccatgctttatcctgtgttcagaatccgggtagattcacacccatgcctgtgtgtccgtgtgtgtgcgtgtgtgtgtataccggtgatgaaagcagagacgaaaaatgctttgtgataaggcttgggtatcatcagactttacagctgattgttccccctcttccaaaatcttactccttttccgtacccaaggaaccatgagaagtgggtgctgtgggttgtataggttgctttatgccaaagacatgacgtgacactttggtaaacaatgtttttggtaaatcatatcagttaagagaagaccaagttgctgttgctaagaaatttttagaaaatctgaaagtgaagttttgttttcattcattttgccaacttactggagagtttctccgtgctgaagacaaagagatctcgcgtgtgtctttgatgtggtctccactcgggaatagcgtatggtcagcaagaagaatgtgtagggaacctgattcttcagtgccccgtttatgactttctgggttggctggtttctcatagacagtattaaatattctgaaaaaggagggacatcagtgaatataaagcagttaggaaaaagttcaagagagtggaggaacaaacacaaagaacgtcagtcatcacactaatagtgttattcccagtggcgtcctagaccttccagccatgttctgatacatatcgcagccttcgtgcagagagtcttaggctagaggctgaagtggcttctgtcagtgctttccctgcagcccacagtgaccctctaccatcctaaaggtaaaaacatagtgttaggtctggcacggtgtcccacgcctgtcatccccagtattctgagaggctgaggcgggaggatcgcttgagttcaggagttcgagaccagcctgggcaacataacaagacctcgtctctactacagatagaaaaaaaaaaaacaacccagccaggttgtggtggtgtgcacctgtagtcccagcttctcaggaggctgaggcgaaaggattgcttaagcccaggaggttgaggctgcagcgagctatgattgcaccactgcactccagcctaggtgatagaatgcgaccctgtctttattttattttgagatggagtctcactctgtcacccaggctggagggcagtggcgcaatctcagctcactgcaacctctgcctcagcctcctgagtagttgggactataggcacatgccaccatgcccagctaatttttgtatttttagtagagacagggtttcaccatgttagccaggatagtctctatctcctgaccttgtgatccacctgacttggcctcccaaagtgctaggattacaggcgtgagccaccgcacccggccgagagcctgtctttaaaatacaaaacaaaacaacaaaacgaaaccagaacactgtagtgttgtaaccattttcctcatgaatcctcatgatggaaacaaaattgactcattttcacaagcccttgacctaggagaaatgatgtagcgtatttaattcctctttatttatcatccctaatagtgacttttgccaagagcctgctgtgtgcaggcttaactgcatcatctcatgcaattttccctcacctggtttgtaagggaatggaagctcagggagatgaactgacttgcccctgatcacacaagcacagagcagcctgtttctgacccaactctcccgtggctggcctatagggcggcgccctcaagcgtcaggctgtgacaaacccggtcctcattggacatcttgatctttggggctttttttttaaagcatgtattttgccttcttaaaatattgcgtttgtggccgggtgcaatggctaacgcctgtgatcccagcactttgggagggcgaggtgggcagatcacgaggtcaggagatcgagaccatcctggctaacaggcgaaatctgtctctacaaaaaatacaaaaaaaaaattagccgggtgtggtggcgggcgcctgtagtcccagctactcgggaggctgaggcaggagaatggtgtgaacccgggaggcggagcttgcagtgagccgagatcacgccactgcactccagcctgggtgacagagcgagactccatcttaaaaaaaaaaaagaattatatatatatataatatattataaattatatataatatatattatgttatatatataatatattatattatatattatatattatatataatataatataatatataatatataatatattatatataatataatatataatatattatatataatatataatatattatatataatattatatataatatattatatataatatataatatattatatataatataatatataatatattatatataatataatatataatatattatatataatataatatataatatatgtaatatatataatatataatataatatataaattattatataatatataatataatatgtaatatgtaatacgtaatatataatataatatgtaatatgtaatacgtaatatataatatataatatgtaatatgtaatacgtaatatataatatataatatgtaatatgtaatacgtaatatataatatataatatgtaatatgtaatacgtaatatataatatataatatgtaatatgtaatacgtaatatataatatataatatgtaatatgtaatacgtaatatataatatataatatgtaatatgtaatacgtaatatataatatataatatgtaatatgtaacatgtaatatgtaatatatataatatataatatgtaatatataaaatatatataatatgtaatatgtaatatataaaatatattattattatatattattatataatataaaaaatatataattatataatataaaaaatatataattatataatatatatataaaatatatattgcatttgtgtattatttatcttgcttactgagtttttagtgctcagaccagggacctctgctttaagggttagcgaggtcggtcactcacttgaggtcccatgaccataagtggggcagcagggtgttaaccgaatctcctgggagcagtctcagcagccaggctggaggcagcagtgtggtttgccttccatcagatcctcacactctcagacagaggaaggaaacctgactaaacaccagctgctaagttgctgtcgggtcctctggggcttggggcccagtgactctttctctcccagctgtgttctcatgaatgtgcttcttctcctgcaggtcgggaaagaggttaaagaagacacgcaagtatgatatcatcaccactccagcagagcgagtggaaatggcgccactaaatgaagaggatgatgaagatgaggactccacagtattcgacatcaaatacaggtacagggtggagacagaggcttcctcctgggcttggggcagtgggttggtgggacctcgaggtcaggcatggtgtccatgtgttcttgttttttagtgaagtgttgggtcctggggtgttctgcacgtggagagacctgctctgatcttgtgttagtccattttcatgctgctaataaagacatacctgggactaggaaatgtataaagagaggtttaattgactcacatttccacatggctgcagaggcctcacaatcatggtggaaggcaaggaggagcaaagtcacatcttacgtggatgatggcaggcaagagagcttatgaaggggaactcccccttagaaaaccatcaggtcttgtgagacttattcactgtcaggacgagagcagcacgggaaggcccagccctgtgattcagttacctaccgagtccctcccacaacacgtgggaattgtgggagctacagttcaatatgagatttgggtggagacacagccaaaccatatcagatcccttcctagaacacactgcacccagaaacccagcagagaattgcttattacttttcccaaaggagaacacaaagtcacctttatagaaggaaaaggaggattgtgcttcagacaatgagctagttgtccactggttgtcaggggtccggcccaagcagccgtgtgtgccacacaccaggcacccaaacagaaacttctctttcagcctcgcttatgtcagtagctgaggacgtgggtggctgggtgggtggcgttcctgcttggatggagtttaccgatgagctccacaggcaggtgtgtttcttaaaggctttctctaggaaagtcagaatgactttgtgactttaggattgtagtgtgggttttcagatcattttgaggtgtactttgaatatgtgagcttcttaatggaagagctgaggatgagcatagttttgagacgagggctcgaagacccagagaaagggcattgcttggccaaagtcccaattagtagtaaaagtggaacagaaatgcaggctggtccctatcttggctccccggatcccatggcttctgcatgtctgggaaggcaagccttccacacctgtgttcctcagcacagccttggcggtccttggtccttctgcataaatcagttgtcagactcaacaagacaatgtttgggattttgattggaactgcattgcctgtggatcaatttagggagaatcagcacttttacattgactttgccaatccatgaatatggaatgattttccatttattaggtatttaaaaaaatgtttttcagtactttaaaaaatttatgtataaatgttttatacatttttgttaagatatattctcattggtgttttacattttgatatgtatattttttactttaaagtactatttatactcatgtctggagaaaatgactgtattatcatgtttacatacatattggttttggaagctcagtttgttagtgaatcacacctaaatcttataaagaacctgaaagcattaaaacggattggttatggataacagaatgggagaaaaatcccattagttgtaatttgcattttaggtaaagggcagcaccctttgaaaagaatcaaatcaattagtaatatttattcataccacaaaataatgcacagttggccctctgtacctgagggttccacatctgcaggctcaagcaaccacaaattgaaaatgtctgggctcgggcatggtggctcatgcgtgtagtctcagcattttgagaggccgaggagtgcagatctcttgagctccagggtttgagaccagcctggaccacatggtgaaaccccacttctacaaaaaaaaaaaaaaaaaaaaaagcaaaaattagccaggcatggtggtgcatgcctgtagtcccagctacttgggaggctgaggtgggaggatcactggagcctgggagatcaaggctgcagtgagccatgaacatgccactgcactccagcctgggcaacagaggaagaccccatctcaaaaaaaaaaattttgggaaaaaaacaatacaacaatgaaaataatacaaatccaaaagacaatacagtgtaacaactatttacattgtattaggtattaggaataatttagggatgatttaaagtatactagagaatgtgcataggatacacgcaaatactacaccgtttgatataaaagacttgagcatctgtggattttggtctttgcaggaggtcttggaaccaattctctgaggataccaagggatgtccgtgtacctaggaaagttagtgattgtattgattttatcgctaagccattttatctgtctcacattcaatacaaagaagtaaaatacaatgtgaagaaaaccatgtccttattactattcacagtcaaaagagtccgcttcctcctgcacggctgggaatattgtacaatagggagcgtttaatggttcgagtggatcaatgtactgttttgattctgagccagtgaacagcgtctcatcaatctttggtgactgaactaactccgtgggaagcatgatagacagaactatttttgtggtgtctccacatcccactgaataagagaagaccctaaacaaggaaatatgacaatcaatctgctcagaaattctctttataggctgtttcctagaaggtgggaaaaggggcctttccctgagggcatagacgtccatattattgtggcctggttgctggattgacattgtgtctggtatgatgaagataaggcacacgttgaaacgagtgtcacattaagaaacttccacagcttgtctcagttcttcaaataatggagcgagttccttttctaggctgacaatgactgccatattggcattgctgctggctgtgaaacaaacaaactactaaaggtaaaccacctggtaggtgttaaagttaacagataagtccaagcttgtgttttgaaagtccaggttggcttgctggctggcgtgttgcgagggcaaaagttagtgagacacctggtctccgggcacgctctgggtcattttcgttggccactttaatgatgtgcattccatctctatctgacacagcgatagtgcggggcccttcaacacttggtggttttttttttgtttttttgttttttttgagatggagtctcgctctgccgcccgggccagagtgcagtggcactatcttggctcactgcaacctctgcctctcgggttcaagcgattctcctgcctcagcctcctgagtagctgggactacaggcatgtgccaccatgcccagctcattttttgtatttttagtggtgacggggtttcaccatgttggccaggatggtctcgatctcttgacctcgtgatccacccgcctcggcctcccaaagtgctgggattacaggtgtgagccatggcgcccggccagcacttggtggtttttaatacaggaatagtgttagctccctgaagcaccttagtagtgtctcctctgcccctattctaggcagaaactcaggaccctgcaaatccctctgtataagtttcccgctccagaccatcggccgtaaagaacccctttgtcccactgaccagtctccatgcctgggtttctgcttctagggctgccagcttctctctgctgtcattctggggacagtgtcaaaaacagatttctctgcaagccgccatctcatgattcatgactttgatgtctcttaaaaaatattatttttaaactttttgtttattgcagttatttttaaaagatactgatttttttaaaaaaaatccagcaactggctgggtgcggtggcacgcgcctataatccagcactttgggaggccgaggcgggcggatcacgaggtcaggagatcgagaccatcctggctaacacggtgaaaccctgtctctactgaaaatacaaaaaattagccgggcacggtggctggcgcctgtagtcccagctacttgggaggctgaggcaggagaatggcgcgaacccaggaggcagagattgcagtgagccaagatcgcgccagtgcactccggcctggtctcaaaaaaaaaaaaaaaaaaaaatccagcaaccttgctaaacttttattaattcttgtaggataaatgtggaatctttgggttttctgtgtagatacgtcatctgggactaagaagagtccctgtccctgctcccaagtccttaaacgttttatctcttcttttgctttgcttttgccttttctgcttcccttccttgagaagtttgtgctgtttgtggttgaaataaaatcagaatgtgagtgaacttggaagtgagtcattagacacaagcccactgcagtcctcaggcctaaagatgactgactgttcggaaagactaagtagtgctggcttttcttattacagaggtaatgttaagctgtagaaaatacagataataaacaggaaagacacagttacttgtcatctcactacttaacagtaaccactagagtgtgtgagtatatagatgtgaaactttgttttttatagaaataagactgtattatacatgctgttttggcacgtttttctacccaaacaatgaatcatgagcaacttttcaggccaataggtgtgaaagaacaaagagtttcagacgttgcatgtttggtttagtgtttttgtgaacttctttgtctgcacatggctaatctgttcacaggtacttgtttttcccatttagacataactcaaccaaatgtttcagttctctctaggaaacagactacatttaaatcagatgaatcatggctttgggttattttgtgattgggtggaaagaggaaaatcatgtttttggcaccagggcagtaaggcagagtaacctgcttcttatttcccaggtaactctctggtaacatcttgtgacttagagcctgtgcctatcagacaggcttttttttctcgaagttttcagccaggtaggaaatgaaggaggaagaatacaggcagggtaggagataagaccttgagtgcgtagggccagagtttggggagggagggagggagttctatagaaatgaatctctaactctgtacttaaaaagactaattagaaagaagaaatgatagctaaccagagtacaagagtgccctggggttttgaaatggttctttcaagaggcgtttgggtttcggctgcatgtgttttgagctttgttgcctagtgtgcagttgtgtggatgctctgggcctctttgcattcccggtttattacagaagactttgttacaccctctaggcgtcctccaggaagagacagatgtgggcttttcctcccgtgtgtgtggcaggcggcccggcagctgtgacaggcgcagcccaaaggcacactgctgggagaacgcgctgctcctgccagccctgcctccccaccaagagggaggtccctgtcccggcttcttatgtgtggaaaggatgtggccccgtgggggtgtggacgttcattctagaaatccctgcttcccaccctcttgtgggtagggcttcctttgggagtataattagaaacccacgagatttccactgtaatgctgcgggctttggctggtgtcttgtcttggaaacaaagggcatttttgtgcagtttgcagcatgaggcctctgcagggtaggcagggagtatgggaaaacagacctggcttgctacccgggagctctgagtccccatggacgccctcatggcagttgctaagcacactcaaggcagtgacttcttggagctgcttctacttactgaggacctctgaatggccaggcaccccaggcttcctcgtggtcttctgagggcgaactgttaggagcatcggcagatggacagctgcctgggcggtgggtatagaaacaatgggcatcattagcttccaaggcctggaaggaaccagagaggagccggtgacctgcagggtaactgtatctgaaacagcatcagaagccatccccagaccagtgtgaataaacctctgccagtcctcttccttgcagaatgcagaggatatgtgttaaaaatgggcatctcatggagaatttttgtttctttggaaagcaatattggcagcctgcgggcaattttcatttagggtgtctcactcaaagccagggcaccttaaaaattcttgtgtctatgtctatgaggatggagcctacgtgaacaggaatctgatcaaataaacaaaaaggaaagagaaagaaagaaaaagaaaagagggaaggaaggaaggaaagatgaacaacacaaatcatcctaagtatcaatgcttttgcaaaagcaagccatgtttttcagatgttcttttcttgtgtgtccctggatggaagcagtagaactgccaggggcttccctgtcacgtggtggtggtgtccacacgtttctctgtctcagacatactcacagacaggccaggcctcctccctccggcttctccgtcgttcactcataaggccactgcgtcctcttcccagagtgtccttgccggctgcactgagacgtcagctgccagggtgccagacgctactgacaggtgctgcaacaggtgttcctgtgttgagggctattttgcctgccggacaagcttcttgtaaaacatgggccagaagcaagttgggacatgtcactctcctcgtgtgggatggttgtaacccagtgtcatcctgcggcacggtgggaaatctgaataagcctgggcggtggcagctaaatatgccttcacttcctatagagattttggtgggggtggtggtcagcattgactctttctgacttatgttaatgatgaagcaggaatgtcactagcagtttggcggttctgggggatgagaagggggccgagagaggcctcttggaatctctgcttgtcacctagcacatgtctagttggtaagcctgataattctcttcaccatgagtacaggctgggtaagcctggccctgccctcgaggggcctgtgttgagagtgggagacagcaggagcatggccacttttttcttttttttttttgagatggagtcttgcttttgttgcccaggctggagtgcagtggcacaatcttggctcattgcaccctctgcctcccgggatcaagtgattctcctgcctcagcctcctgagtagctgggattacaggcgcctgccaccacgcccagctaatttttatgtttttaataaagatgaggtttccccatattggccaggctggtctcgaactcctgacctcaagtgatctgcccatcttggcctcccgaaatgctgggcaggtgtgaggtaccgcacctggccaagcatggccacttctaagaccacctggcaagccctctcacagaggaaggaacagggtgctgtgggcagccaggaaggggcaataagttcttcccagaggtggtgaaacctacaagttcgagaggaccacgaagtgagcccaaggtggctcaacatgcagggagcagtgagggcattccagggagaagtaacagcaggtgcaggcaaagggacgtttaagccagcatagggatcttcagtgagtggcagctttgagcctctgccccccaagcccctcctcgggggaaccccaaagcttctggccaatagatggccacagggaaacagctagatgacattgagagagccaggactttacagccagcctcctctggagacagcttgtcccctccactgtccctggagtattgttcctgagtgccagtcaccccagagagcctgaaggcccagccaactacatggctgaaacttggggtatggctctaccacctcctggagagacccagagagctggtgtccaggcctgacctgggcaggcgttggtgtgtgcgggtggacttctccccgtggaggcgcgtgaaggattctgcgatgagcagtgtggctccctaccttgtgtatgtgtgggcgtttcttaagcacacggatgtagacagcaacctgggggtgaggtgagggcagagagcctggtaggggatccccgtaagattcagagcagtcccgtgggatgcccagacacttacggaggtgaatttcagcatggcagcggtacagagtttgcatctccgttgattctgccggctgctttccccagagcccgcaggcctgccgtggccagatctgctctggcgcagctatggcgatcaggtccctgccctcagctccgattcttggtctttaaaatcttcactgctcctctccagttcctgtgcccccacccttcatcctcgacattgaccttccagcaagatgcagtggaaggcctgatggtggaatcagacctggtaggaaccttaatgttgggggtccttagtcccttcctctttgcagtggggggtgtgagtgcttgggctccgagatgttggtttgtgaggttagctcccccgactccccaacccacagaaggggccagggggtcacttgaagaaagccagcctcctgcacaacttggacatggcttgctggagatttctttttctctttctctagtctgttgagtaggggactttagtggctaatatgaagatactcaattttttttttttttttgagacgatcttgctctgtcacccaggctggagtgcagtggcaagatattggctcaatgtagcctcaacttcccaggctcaagtgatcatctcactcagcctcttgggtagctgggactacaggcacaagccaccatgtccagctaatttttgtagtttttgtagagacaagctctcagtatgttgcccaggctggtctctaactactgggttcaagcgattctcctgccttgacctcccaaagttctgggattacgggcgcgacccactgtgcctggcttatgttttctctttaaacaactttttatttggaaaaaaaattaaacttcatgcaaaaataaaaatagcgtagggaacaccctatacttttaactcatattttcctgttaacattttttgcctgtttgctttctgattcatccgtgtgtatatgtatgtgtgtgcacacaaatggtttttactaaaccattagagggtaagttatgtataccatggccctttcctgcaaatgattaagtatctatttcctaaaaataggatgtttacatcttctagtaaatagctacctgttatggtaatatatttggtattatgtaatattatgacaggaagttcattattttgtaaattctattaaatctttgttatttttgctcatgggattatataatgcccataatcaaacatcaggaggtgatggtggcagctttaactggtcaaattttccctccttttctaagtccctttagatgatgtcttgagcagagtcagttttttttttttttttttttttttgagacagagtcttgctctgtcatccaggctggagtgcagtggcgccatctcagctcactgcaacctctgccttccaggttcaagtgagtctcatgccttagcctcccaagtagctgggattacagacgtgcagcaccacacctggctaatttttgtatttttagtagagacaggttttcaccttgttggccaggctggtctcgaaccccttacctcaagtgatccacccgccgtggcctcccacaggtctaggattacaggcgtaagccaccaagcctggccacagatttagtttttaaacttatgcttatttttttgagacggagtcttgctctgttgcccaggctggagtgcagtggtgcgatctctgctcactgcgagctctgcctcccgggttcacaccattgtcctgcctcagcctcctgagtagccgggactacaggcacccaccaccactcccggctaattttttgtatttttagtagagatggggtttcaccatgttagccaggatggtcgcgatctcctgaccttgtgatccatccgcctcggcctcccaaagtgctgggattaccgtgcctggcctaaacttatttcttgtacttcttatgttttctgacactgtggtgtgggcccggggtttaaaggtaaggaagcttagatgtggcttttgtctcaagctcccagtctaagcaagagaccaacactactcagatacataaaccaggagtcagcaaactatggcccatgggccaaatccagcccactgtctgtttttgtacagctcaggagccaagaatgattttcacattttaatggttgaaaaagaaccaaaggaagaatactattttatgacatgagaaagtaacatgcaattcaaatttcagtgtctataaataacattgtactggaacacagccatggccaagcatttcttgctgtggctgctgttccaccccaacagcagggttgaggagttatcaccgtgattgtgggatctgcagagtttacaatatttcctctctggactgtcacagaagaagttttccaacccctagtgtaaacaccctggaagtgctggcaaggagagggatataaggagaaagaggttgtgttctagggagtctgtgtggggagctgggggagggatccttagttgggaactgtggggagggagggggtttgctggaagagtggattgcgccttccagacagcacgctcaaaggtcctgtggctggggactgtggccttttcactggctgagagggtgagggatagagatgttcaggaggggtcagaatgggtgcgaggctctgccagaaggggcttactcttgtccttccctttcttttaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctttttttttttttttaaaaaaaaaaaaggttcagcagaaatcagcgtggctagttcacaaagaatttccagtatcagggaaaaactgtgcgtgtgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacac

SEQ ID NO: 38724 - DNA, 98911 bp, Homo sapiens; identical to SEQ ID NO: 35912

SEQ ID NO: 38725 - DNA, 10048 bp, Homo sapiens
gcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcggtgagcgggaggcgcgggcgccatcgggggcgtggggccggggctgcgggcggggcgggattgtgacaccccgggcgcacctgtgcgctcatctggcgccggcgcggggttgggggtccccgccgcgggttgggggtgcacagtggccctttggggcgcttcgtgtcctaggggtcgaggcggacgggaccccgcgcttcctcctcggtcccccgatcggggttgggccacatcggcccctggagcgccccctcccctccctcctcctcccagagcgcccaggtccggcgcgcccggcgcggggaagtggaggggcccaggggactctgcccgggactccagctgggaggagtggctgggccgtgagctcaccggccgggtccggcctgagagaggggcagagccgggagaaagttgttagaccctgtagcgggggcccgtgggcgtcatggctccagcccttccgcagtgacccccagccctggtacggccgcttcctgccgccggcccggcttctgggaggagggactcccagctggcggaagaggggctgaggaaagggcgcccctctcccctcttgttgggaaactcgccgggctccctttgcatttctgttccctgagggtccccgtccctgactgaggtccaaggaggcggctggaccagggagaaggcgtagcccttccacggggtagggacgtgggtgtggagaccgtcaggccttggccaccctgagatggtgaggacttgccccggcctctgtggcctgggactctggaggggccgtgtcctttctggccggctggaagttcccacacgtccccagccacgcgggtgcccaggtgcccggcagctgatgcggtgctgttccccgacttcccggcccccagcccctcccctcccctgcccctgaaataatgctcctttgagctcctgtttctttcgggggctgtgcctcctgctttctgagcttggcacaggtagagatgaaaggcagttttccccgaggaccgtgccccggattaaattgctccatggccaggcgcgaagctcacgcctgcaatcccgcactttgggaggctgaggcgggtggatcacctgaggtcaggagttcgagaccagcctgaccaacatggagaaacccccttctctactaagaatacaaaattagccggcagtggtggcgcatgcctgtaatcccagccactcgggaggctgaggcaggagaatcgcttgaacccgggaggcagaggttgcggtgagccgaagtcgctccattgcactccagcctggacaacagagcgagactccatctcaaaaaaaaaaaagaaagacagaaagaaaaaaaaataacctgggtgtggtaatgtaagcctgcggttccagttacataggaagctgaggctgcggtgagccgtgttcatggcactgcactctagcctgggtgacagagtgagaccctcagaaataccaaaaccttactccgttggaaactggcaaaggaaattctcctgtcccagaactcaggcctggtgaggggttcctgggagatggaacccctgtgtgtggacagtggagaggcctggtgtgctggctcagcccctcactcctcccagcctgccgaggagtaagtgctctgtggcgttgtgggtggtcagggtctcccatgggtgcctgtcccggtttggaggacgtgggtctggggtcttcactcaggttcccaggacagggccagggacttgcattaccaccttccccacccagccctgtgtccgtggaggggctgtggggcaggcagggggctgtgtagctggccctcctcaccctgtggtcacctcggctcagagcacccctaacagcctggtatgtgtgggcaacttgggcagggagcttgggctgcagagccctgggagaggcctggaggggctgtgagccctgggagtcggggactgggtgttaggacaaccttgaacagatctcttatctctgtgtacctgctgaaacttcacagccaccagctgggttctaggtgccctcaggctggcgctccagggccagaggggctgagggctttgccccagcagcccaggggctgtgtgtgctgcaggtggcctcccctgcctgcccccgcagaggccggctttctccgggacaccgtggtcctggggggctgtcctgcttcagctcccagcacttgagctttctctgcccacattatcaggccacagcctggtgggtgggacctggtggccagcagacacctggaaagcctggagtgcgtcgtgggtggagcctggccagcccctgcccagtcgccacgccaggttcccctggagcttggcctggatttgccgacaggctgctattggcaggtgtatcgtttcttctggtgcctctatgggagggtcacgaggctggcaggagagcctgctgctcacctgtctccctcctcaggaggggcctgggcctgagccagccactctccagtgagacctaggcagcgctcctgagtgtgtggggagggggagctgcagcagaggggagggtcccgccccctgctgtgtccactgtgcttttccttctgaagcctttgtcgttaattaacctcggagggaggggcccccaaagggatgtgccctccgccctgacctacccaggagaaggctgggacccagggagggaaggatgcccaaggtcgcaagggcacgaggctggagctggcacggggggctgggggtgagagcctgagtcctcgcctggggccatgagcaggatgtctcccacgggcccttctccatccccgcaccaggcgtgggtgcgttccctgaggacagttaggagccttgcccgcttggaacgcagagggcagctgtccccttgttctcatgactggccaggcttctggcctgggtccctcccacatgcagtatctccctctgggtaaggggaatttgggctccggtctcgccgtgtccaaagtcatcatagcccaagcaggcagccaacccatccagggatggagatgtgggaggctgagaggaggtgggaggaccgtgccttgatatccagggcatctgtgatgaggggcgggggctccttcctgacacctgctgggtccttcggcttcgacctgggttggccatggggagtgtagtcttctaaggttggagggggtccgggtggcagtgcgggtggggatggcagtcagagtggcgatggcagtgcgggtggcgatggcagtgtgggtggcgatggcagtgcgggtggggatggcagtgtgggtggcgatggcagtgcgggtggcgatggcagtcagggtggcgatggcagtgcgggtggggatggcagtcagagtggcgatggcagtgcgggtggcgatggcagtgcgggtggcgatggcagtgcgggtggcgatggcagtgtgggtggggatggcagtgcgggtggggatggcagtgcgggtggcgatggcagtcagggtggcgatggcagtcagggtggcgatggcagtgcgggtggggatggcagtgcgggtggcgatggcagtcagggtggcgatggctgctgaggtaccctgcggcttgtttggaagctgctgcagtgaggcggcagctgtgaaaagacccagatgccaggagggtgggatgtaggccatctggggagggacagcagaggatctggctgaggggccagagggtgtcggtgacctttgccaaggtcagagttggtgtgccaagatctccaggtgggtccccgggggcttccagccctttccatctgggggactcgtcctccccatctgcggccctggaggagggtcccggcctggctgacacctccttctcctcacagaggtggggctggtgtccgagcacttctcgcaggccccgcagaggctgtccttctacagctggtacggcagtgccaggctcttccgcttccgcgtgcccccagatgctgtgcttctacgctggctcctgcaggtctcccgggagagcggcgctgcctgcaccgacgcggagatcaccgtgtaggtggctgcccgcccgcctgcccaccctcccgcgcctggccaagccctgtgcctgaacccggtgctgctctcccgtctccaggcacttccgttccggcgcccctccggtcatcaacccgctgggcaccagcttcccggacgacaccgcggtacagccctccttccaggtcggggtgccgctgagcaccacaccgagaagcaatgcctccgtcaacgtttcccacccggcccccggggactggttcgtggccgcccacctgcccccctcatcccagaagatcgagttgaaggtgaggggggctgccctccgggatggaggcagagaaccttgcggcgatggcctgtccctgccgttcacctctttggggtggtcctcgctctaggctccacgctgcactctggggccagccctgctccctgcatgccgggggcgtctggtgagaccatgccctcacacctgcattctctgacaccgcccccgcccacacctgttctttccctagggcttggctcccacctgtgcctacgtcttccagcctgaactgctggtcacgcgggtggtcgagatttccatcatggagccggacgtgccccttcctcagaccctcctctcccatcccagctacctcaagtgagcgggggcctggggggcagcccggctctgccctccggccccttctcagattcggtggagtgggtgcgagagcctggccctgagtcctggggttgggctgggaagtggtccagatgcctggcccccaccagagtgggctgaggaacagcagagcctgggcacgctgcgtccctgggctgaggaatggcagagcctgagccagctgtgtcccctcgctgcagggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacaggtgggccgcacaagggctggagggatggccctgcccctccccagatccccagactttcctccagccaaaccccttgtcctctcggcagcttgcaggccacggagcgtgaccatccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaaggtacctgctgtctgcaagcggcctgtggcctgggctcgggcagggcgccgggcaacccctgcagcgcctcctcatttaccttggcacgggacaggcggcacagtgacaccagcaggcacgggccaagacaggggcccatgttggggggcctcccctgctgggcagccttgttcctgtcaacaggccccggggctgtggggtagctcgggtcagaggtggggtggaggcaggatgtcccagggcccggggaggaaggtcccggtgcaccgtgggcctgcaggagtctcagagaaaggcaccagcaccggccgggcgcggtggctcacgcctgtaatcccagcactttgggaggccgaggagggtggatcacgaggtcaggagattgggaccatcctggctaacacggtgaaaccccgtctctactgaaaatacaaaaattagccgggcgtggtggcgggcgcctgtagtcccagctactcgggaggctgaggcgggagaatggcatgaacccaggggcggaggttgcagtgagccgagatcgcggcactgccctccagcctgggcgacagagcaagactccatctcagaaaaaaaaaaaaaaagaaaggcaccagcaccaggctgagctggcacgtggggcagatgaccccactgcggccaggggctgctggagctgagccggcaccgcctccctttccagacagagatgcggaacgagaccgtcgtagtggcctgcgtgaatgctgcctcgcccttccttggcttcaatacttcgctcaactgcaccacaggtatgatgggcaggcgtcaccgtcagcgtggccccggccagccccccgccccggcctcctctgatggggccctctggctcccctgcagccttcttccagggctaccctttgtctctgagcgcctggtctcgcagggccaacctcatcatcccctacccagagacagacaactggtacctctccctgcagctcatgtgccctgagaatgctgagtaagtaaacctagggcagagacgggggccaggcaccctgtcatttcactcaggaccacaggccgggctgcctgaggttggcgttcggagtgacccagctagaggggtgcttcctccagggctgctgaaagctgggggccctaatgctgcgttctcatgtctgtcagcctgttgggagcgctggtggcagctgggctgtcagatcactgcaccagctttcctgtggccccttcctcaaagggactgtgagcaggctgtggtccacgtggagaccaccttgtacctggtgccctgtttgaacgattgtggaccctatggccagtgcctcctgctccgcagacacagctacctgtatgccagctgcagctgcaaggcaggtgagtgccagggccccgcccgccccgagacgctgctgctgttggcttccagtgctgtgctgtgcctttcccctgggggagcgccgcaaggggctggagagagacccttgcagagcaatgcaggggcaaagcctcctccccactcccccattccccaccaacaatccgtctgcctggcacaggcaccaggtatccccggggggtggtactgcctcctgaccttggaccccgcccgccgtgcctaccctgcttgctcctgggtgaggaaggggcttctctgcagggtcctgggtgaggggtgggccctgaggttcagcagtgcccccagcctccgcgtcggggttttgtgaccgcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacggtaggctggcccctcctgcagggatgtggggtgggagggcaggaccgcgctcatggagcctccccacagttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgagtggccctcgacgtggggtgtgggctccgggggagcagggcccccaagtgcagcctgcgaaaggcagtaccgtgggagaggccggacctggcgttgggcacggcccctggaaacctcacatctcggccgagcatggtggctcacacctgtaatccctaggccgagcatggtggctcacacctgtaatgccttggccgagcatggtggctcacacctgtaatcccaacacttgcaggaggatcccatgaggccaggggttcaagagcagcctgggctgtacaaaaaatcgaaaagttagccgagcgtagtggtacatgcctgtggtcccagccactcgggagactaaggtgggaggatcgcttgatcccaggcattggaggcgttggagtgagccgaggtcacagcactgcactccagcctgggtgacaaaagaaaagaaaagaaacctcatgtcttctgtgatgccacacggagatgcgggtctgagaccccgcaggcagttgtgagggggcagtgccagctgtttggaggatgccaggaaggaaggtggtaggcaggggaggccaggccccctgccttcgagaagcccccacccatgctccctgggtccttggggccaatgatgctttggggactctctgtggcagctggccctggcaaggggagactcatgccctgggcttgtgagctgcatgctctgccctcccatctgctctgggaactgcaggctgggtactgccccaagggggtgcccatgggagccccacagccagggcagaggggaggctgggaagcaccagggtcctgcagggctgagtgcggggcctgaacctgcagataggcagagaactgtaggctgtgggcagaggtgtctgatggagactggggggtgggagcccctccccatggaacagtgggtgggagactgaagccaccctgatgggggacttctagaaacccagtggtacagggggctagtgagtgtgtgggtgcagagcggccatatgcgtctgtccagtttgtgtgagcatcgtctaatcccccagagatgcctgcctggccacattcacctgtggatgcaatacagaagctgaaggaggggcatgtccctgccggctggcagagctagtcagaggctggcagagctggtctgagggtggcagcagctccgagggggcaggcagaggtgctgtggggccgtggggtacgcgtgctcctgctgggccttgagccctcagagacgtccctgcagtcatccctgtgtcttgcgcaggtgctgtttcttctgggtacactggtcatcgccatgtccttgcagctggaccgcaggggcatgtggaacatgctggggccctgcctctttgccttcgtgatcatggcctccatgtgggtaaggagccgggctggctggcactgctgcccaggtgctcggagaagagagcctggccccttgctctagccacgttcctggtcctgctccaaccagtgaatgcccatatctgctgggggttgccatggcacccacagaggcccagcatggctgtgtccctgaggcctgggcctgaggaccagtggccttgagccccctcgaagcagcccacccttgtcgttctgctgcccagacctgggcaggcccccagtaaccaccgtatctgggccctgggagctgcagccgcggccccacctgcactgatacctgcgtggctgttttctccaggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctctt

SEQ ID NO: 38726 - DNA, 85815 bp, Homo sapiens
aaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacaggtaggtgccggtgtggccaggcagagtgtcgccacctgactctctcagtggtttgtgtcccatcataaccgtctgttctcagctgaattatttgttttattaaactgatggatcttgtagtccagatggttcatagcttaagatactttgttaattaacctggaaacttggtaactgatgcatgtattttgtgtttgttctcagtcctcaaaaaagaagagtatgtgcttttaaaaattaccctttagatgtaataaggacttggaattgggacagtaaccaagagttaaatgaaggacttatgttaaccctggcagtctacaacttggtagtccctgctaactaccagtgcttgaatttttcttggtgtgggctttagaaatacactggccctatcagtgtctatctatgtgaccttaaacaagttatctaacctctcgaagcctcagtttcctcatttatacatatggatgcacgcactgtgaatattttataacgttaaaataacacattaaataataaagcatgttaatgcttaaaaataaaatctgtgcttcgaaaacaatttttctattttgcaacttaatctctagtccatttctgtaacatgctagttggtttgatacccactaatctagaaaccagctttagagcaaaactcctcagaacagttgttgtactccctttcatcatttcacctcctattttctcttgacccaccccattgagctttgggaacctcctcctgaaactaccctgtcccgaggccaccagtaacctccatcttgctaaatccaattgccagttctttgtttttttcttaattggcccctctcagtattcgaggaacacctgttgacttgctccatcttgaaacacttccttcatttggcttctgggtcacccatgtccctggaagtcctgcttctctggctcctttgagttccattcttttttccttctatctgtcagagcacaccccgaacctatccccacctcaacccagggccagacctgagacttttcttctccatctacactcactccctaaatgatctcatccagtcccatggctttaaatgtcaatgtcatgcttatgattcccaaattgaggcattcagccccaactccctcccccagcttaaggtttgtgtagtcatctcctgcttggatctccatttggttgtcttatcatttatacttaacgtgtccaaacccaagttctccatccaggccaccagtaaccacctcctaaaataattgtcatccttctaaatggcatcaccgtttgtttagttgcttaggccacaaacctaaaaagtcatctccaattcctctctttttcatataccccttcctaattcatcaccaggtcctttggttctagtttcaaaactttatcccaaatctgcctacatctcctccactgctaccatcttaatcatcttggattcacttcccatccgtagaacattcctccctcagcagccagaggagtcttctaaaaatataaactataaattaaatcctgtcaccccccactcagcatggtctgtcatgtaggatgattcttttggctgtaaatagcataatttcttttttttccccactttctctgtaaatagcataatagcataatttcttgtgttctcttcaagggggaaaaagtttgcatattctagaatttatttacatatatttgtatatatatatgtaaatatatataagttattcccagtttacaaataatgctgtgataaggagcatatagcattactagttttgctacttactagctgtgggacattggacaagcaactaaattgtgttggcctcattttacctatctgtaaaatggtgataattatattatagtaaccacttcacagagttgttgtgaagattgaatgagttaacatgtataacataaacttagtacagagcctgttcaatatgtgtgaagtgttttatttttctctggctccattctgtttaattaatcaggctatttttttttcagtaccaaactattattttaacttcataatgtattattattattatttttttttcgagacagagtatcgcccaggctggagtgtggtggcacaatatcagctcactgcatcctccacctcctgggttccagcaattctcctgcctcagcatcccaaatagctgagattacaggcgcacgccaccacgcctggctaattttttgtatttttagtagagacagggtttcaccatgttggccaggctggtctcgaacccctgacctcaagtgatctgcctgccttggcctcccaaactgctgggattacaggcatgagccccacacccagaccataatgtattttaatatctagtagagcttatagaaagttcttaatgttgctaataattagtcagttgatcctcttggacttcctatatataacatcatgtcatatgcaaaaaaaaataataatcactttgtctctctcctttttagtaattataaacctcttgtttgtttatttacttattattcaccttttccaaaaatgtcttgagtgtttctgcctgtatttttctgaatgttctaaatattactatcaaatttcacatacataaaatatgtgggggtttttgtaattaatatataattatttgacatgctatgtatttgctacatttatttctaagtcttttctctttttaatgcaatggttaatgtcttttttctcatatggtctttgtatttaagaaaactcttattttgtgtgtgtttgtgtgtatatatatgtgtattttttaagacatcttaaatttcttattatttctaatagtctgttagttgattcatagaaactatgaatataaccatattgtctacaaagaatcatcattttaccttttctttttaatttatacctaattctcttaccaaattgcactggctgagacttccgaacagtgttaaatcgtagtgctgaaagcagcgtacagtcttacttcgcccctaactttaatggtaacgcatctagagtttcactcacaggcactcttatttgagatatgtttttatgttatcaagttagtgtccatttatatttattttttcacttagagttttaaaaattaggactagagattagatttttgttaaagtacttttcagaaactcctgatgatcatatgattcttctgctctgatccattcatattgaatttatattttaatattaacccatccttaaatgtgggggatgaattcccattcgggcctggtttattattcttttaatgtactactgaattttatttgctaatattttaagatttttgtatcagtaaataaattagactggtctagacttgggttttattgcactatcttttttttgcagaatacatacaggatgattgcactatctttactaggtttgagtttcagtgttacttgaggtctggagaagaacttagatgcttccttctttatgttctgagaaaatctgaatccatctccaataataaatcctttctccagccagtgccaaagcccgggtccccgagcactcccatgacttccctgcccctgcccagtgcttcccacagcagcccttccacgccccttctggctcttcctccaaggaggtcccacacccccagggacaggttgattctgggaaactggaatccttcatctgtgtcatcactgggcaggcgagtcaacctggggaacagttattcccattatcttttctctcttaactatcatctgcgcttttcagtcttccagtgttttctttataaacagctaaagttacttatttcagtccaaagatgaaatttttcttggccagtttgaatatggtttcatcagctgtgttttaacaattttgactttgggtttttcattttgtttaaaatagtacaatggaggtgattagggcaagatattcactttctactcttaaaaaaataaagtatgctctttattgtggtcctatctcttaaaaacaaaaaggactgtaccacgaatttggcagacgcaccaccctctttgagggaggaaagccaaaccaaggttgaagaaagaaatgattaaggatttagaggttatgagggtttcaaatttcatggccaggctgtgtgtgccttagagaatgtattcagcttattttcataggccaattatttcacctccttaagagcaaaaccagcggattcagatcctcggtttaagaaagcgtatttttctttttctcttcctgtttctctctcttcttttttcttttctcctcttctctttccttccttttccctccttttctctctccctctctatttgctgtcttctcttttctttcttcatttctttaaagccccaggaaattaaatgcaaggacttaggccttcaatcctaaaatggaaaatgagaaaccctcaaatgtcaggaaattccaaagataaggttcctacaacaacattaacttggttatatgtgttttatggcatacacttaatagctctggcaagaatgccttaaggccgacatttaacaagaaaagttactactctttaagtgtgagcaccatcctgaattcacatgtatctacatactcaaaatgtcttaactggaattcagatttttaaattttagtttaacctggtcatgtgacagcttgtagatctttatgaaaccaaataactgcaatgaccaaaatttcaacttttcagctgattattttggcatcatatagatttggcctttccttggagctttagtgtaagactttcagaacttcttgaggacgtgaaacctcagtcattatatggctgccagatcacactgtgctgttattgattccataatttccatcttctatgggactgatacggatccccacagctctctggctgggcagcaaccctcggctctcacaggtttaacagttaaaattaacttaccagccaagctgtggtccatctcagtcagcaaggcatccctgagacaactcggaattaccacgtctaaaaactgaatgtttcaagtcttcaaaggagcgcattgtttgattaagttgatgtttagagcaaaagctactctggaagcttctgagaaacttgatttagtaaagccatttatttcaatagaagctgcattggaaaacagagagacggtgcttgctcttccaaggttgctgttgtccattacaagagtgattttcatgtcatttctcattgaaaggtggaaatcgttggatattagccacaatgagggacagaaatagtttttccttctgacatttagggtttagatccaggatagagaaaagcagaaaccctgtgagtgatcctagtacacggtggaggagttacccgataacagaatgcaagctgagagctaacggaagtctcctcctgcctagccgcctgccctgagcacctggtggtaggaaagcccttcctgagtatggcgagccatggggaagagctgccgtggccactcaggagagacaggcagaaagactctggcagctggaggaggaggatggaagtcagcgcgtggcatccttgatttctaacccagctggatgatgttttaaatggtcgctaggtgccaggctagccaagctttttttttttttaaacagggtcttgctctgtctcccaggccggagtgcagtggtgcaatctcaactcactgcaacctccgcctcctgggccaagtgattctcctgcctccgcctccggagtagttgcgaccacaggcacatgccaccacacccagctaatttttgtattttttgtagaggcagggttttgctatgttgcccaggctggtcttgaactcctggactcaagccatctgcctgcctcagcctaccaaagtgctaggattataggcgtgagccaccacacctggcctgtagccaagcttttttaatccatagaggaaaataatcctgggggaaatggattcaaaacaatttactaaaaattaactcaataatacagctgctttttttttttaaatcttgaagtagggataaattataaacagtaaatgtagcacttaaaaccagcttttaaaatattcattcacggggccaggcatggtggctcatgcctgtaatcccaggactttgggaggccgaggtgggcagatcacttgaggtcaggagtttgagaccagcctggctaacatggggaaactctgtctctactaaaaacacaaaaattagccaggcatggtggcacacacctgcaattccagctcctcgggaggctgaggcaggagaatcacatgaatccaggaagtggaggttgcaatgagccgaaatcctgccactgcattctagcctgggcacagagcaagactccatctcaaaaaacaaaatggtccagcaaggtggctcacgcctgtaatcccagcactttgggaggctgaggcaggcggatgacaaggtcaagagatcgagaccttcctggccaacatggtgcaaccccatctctactaaaaatacaaaatttagctgggcatggtggcacgcacttgtagtcccagctacttgagaggctgaggcaggagaatcgcttgaaccggaaggcagaggttgcagtgagctgagatgcgccattgcactccagcctggcgacagagcgaaaataaataaataataaaataaaatactcattcacttattcaaccaacaaatatttaccacgcacctatcgagtgttagacataggaatgtaataatgagcgagatagacggagactctgtcctcacgggatttgcagaccagtaatagttggaaggacacagctggtgtcgtgatcataactcctgtcagtgctgtgaggaatcctggtgccatgggaacattcagcagggatgtgtagcctatcagggaaacagatgggatcaagaggaagtgacgctcgggccagcgggagggtggggagtggacgttcagtttgagtgaactaataggtgaaagccctgagacaggaaagactgcatcatgtcagaggaactgcaaggcaggagtgtggcctgagggccaggaagggtctggggtgaggcctgaaggtcttctggacctatacacaaggtgtggatttgggcctattacctaagggcaatggaaaaaaggaacatttttaagaaggggagagagataatcagatttgcatgtttaaggccgggcacggtggctcacgcttgtaatcccaacattttgggagtctgaagggggtggatcacctgtggccaggagttcgagaccagcctggcctacatggtgaaacctcgtttcgggtaaatatacaaaaaattagtcaggcatggatggtgggtgcctgtaatcccagctacttgggaggctgaggcaggagaatcgcctgaatccaggaggcagaggttgcagtaagcctagatcacagcatttaaccccagcctgggcaacaagagtgaaactccatctcagaaaaaagaaaaaaaaaaaaaagatttgcttgtttaagagaccatcctgtcagcagcctggagactgggtgggcaccaatgggcaggtgcggtgaggcgatggggagaaacagtgaggtcttgtggttaccctgtggtgtagctgcctcggggactgagagaagtgggtgggttcaagagatgctttggaggtaaaacttgggttaactagttagacgtaggcagtaagtgggagggaggctaggagtctgatttccaggtttcagacctaaacctttggatggcaacactgggcaaggagttggttctcatcagagaggcaataggattacgagttcagctttgagattcttccgcattgtccaaatgggaggagctctaagttagcatttcatttacaaaaatatggagaagtcatgaagaacattcaaaatacgactcagaatcacagtgtttggcattggttgttgaaatttggctattacataggttataacgcccttcagcaaagttctttggaacaaccagctcattctagcatctctgaaactcagaagcaccaaatatcaaacgatcatttgaggacctgggaagtaaagtgaggctgagtggaggttacacctcttccccaggctgtgggctccccaaaggcagggacctctcgcctttgtatcacccactttgagcacaatgtgactcgcatgtttacttattaaacttgcaggcgggatgtggaatgaatgttgaaaatgtttaaattagagagaagcctgtttggatgtggttatcgttcattaacctttcacagtttcctttctctcaaagttaatgtgtaaatgaaggtactaaaactttcaagttaaaaaaaatatttgtagagaacagaattaggttagcagttgaaggattggtgtgatcacatttctcctcttcagggagcctaatcacctacctaaacctcagaaggggaggactgatgtccctgacatttatgtaggctgtagaaataatgctaggtggtccgggcatggtggctcacacctgtaatcccagcactttggggggctgaggtgggtgggtcgcttgagcccaggagttcaagaccagcctggccaacatggtgaaacccccctatctctacaaaaaatacaaaaattagccaggcatggtggcaggtgcctgtaatcccagctacacaggaggctgaggcaggagaattgcttgaaccctggaggcggaggttgcagtgagctgagatcgccccactgccttccggcctgggcgacagagccagactctgtctcaaaaaaagaaaaaaaaaaagggcagggcacggatcacctgaggtcaggagttcaagaccagcttgcccaacatggcaaaaccctgtctctactaaaaacgaaaaattagctgggcgtggtggctctcacctgtaatcccagcactttgggaggctgaggtgggcagatcacaacgtcaggagatcaaaaccatcctggctaacacggtgaaacccagtctctactaaaaataaaattttaaaaaatagctgggcatggtggcaggcgcctgtagtcccagctactcgagagcctgaggcaggagaatggtgtgaaccgaggaggtggagctttcagtgagccaagatcgcaccactgcactccagtctgggcgacagagcgagactccgtctcaaaaaaaaaaaataaaaattagccagatgtggtggcaggcgcctgtaatctcagctactcgggaggctgaggcaggagaattgcttgaacccagagggcagaggctgcagcgagccgagattgcacctgggtgacaagagcctgggcgtcaagagcgaaactccatcaaaaaaaaaaaaaagaagaagaaaagaaggggaggggaggggagaggagggagaggggaaggggaggggagaggagggagaggggagggggaggggaggggagtagggaggggggaggggaggggagggaagggaagggaggagaaagagagaggaagaaaaagaaagaaagaaagaaggaaggaaggaaagggaagggaaggaaggaaagaaggaaggggagggagggagggaaagaaagagaaggaaaaagaaagaaagaaaagaaaagaaagaaaggaaggaaagaaaaggagggagggaaagagaaagaaaagagagagagaaaggaaaggaaagagagagaaagaaggaaggaaggaaggaaagaaagaaagaaagaaagagaaagaaagaaagaaaggaaggaagggagggaaaataaagaactgctaggaagagctaactttctaaatgctttggcatgtgttaccaacacatgacaatgatagatcaaatgttataattggaatcctactttcctactagttctagaaactgggcatgtaaagatttctggcttctccttgatcttgtatggactgtacctcatgttaatttgtttgcctttcagacttcctgcataggaattagtcacctgaaaactaaccctttaatacaggaaatagagctgctatttgagaaaccttttgatgaatcgttttgcaaattagttttgcaacgtgaataaccatcttttattttgaaacagggtctcactctgtctcaaaatgagtgagagtgcagtggctggaatgcagtggcttgatcttggctcactgcatcctccgactccctggctcaagggatcctcccacctcagcctcccaagtaactggggctataggtgtgccccaccacacccagttaatttttgtatcttttatagagacagggtcttgctctgttgcccagctggtctgaaactcctgagctcaagcagtccacctgcttcggcctcccaaagtgctaggattataggtgtgagctactgcgcccacccccatcttcatttttttaaagggagtttttaattgttttcaaattggacttttctaatgctgtttagactagtgaccttttatgtgtcagaaatcaaatgtaaagcatggctgaccttttttttattattattattattccccagaaacaagatctcactctctcacccaggctggagtgcaagtggcatgatctcagctcactgcaacctgtgcctcctaggctcaagggatcctcccacttcagccttccaagtagttggaacttcaggcacatgccaccatgcccagctaatttttgtaattgttagtttttgtagagatgggatcttactttgttgcccaggctggccttgaactcctggcctcaagcaatcctcctgcctcagcctcccaaagtgctgggattacaggcatgagccactgtgtctggcctgagctcttatattagcatcttgttcttggaaatatagaaggattatacaaaacattcaaactatgtcttgaaatcccaggtgtctgacagtaaccactgggataaaagctaatcctatcccaacaaaccccaacacataatctggattcccgcttgcattacatgtgctctatttttatgtatgtatgtattttttgagacagagtctctgtcgcccaggctagagtgcagtggcgcaatctcagctcactgcaacttccacctccccggttcaagcgattctcctgcctcagcctcccgagtagctgagattacaggtgcacaccaccatgcccagctaatttttgtattttcagtagagacaaggtttcaccatgttggccaggctggtcacgaacccccaacctcaagtgatccgcccgcctcggcctcccaaagtgctggaattacagacatgagccaccgcgcccggcctgcattacatgtgctttaaataagcgagtcatccgctgagatttggagagcctttaaccatacaaatatcttctgttgttagggcagttattatgaaaacattttaaagattcagatgttatttcataggtactttatcatttcgaaatttgacctatacaaatattgtttccaatgagattttaaaaaataaaaacagaactataatcccagacaacagggaggctgagacaggaggatcgcttgagcccagaagtttgagaccagcctgggcagcaaagcaagacctccatttctacaaaaaattaaaacttagccagccatggtggcatgcaactgcagtctcagctactccggaggctgaaggacaaggattgcctgagcccaggaatttgaggtgcggtgagctgtggtggcaccactgcactccagcctgggcaacagagggagaacctgtttctaaaaataaatagagctctcgccatggcaaagcaaggcacagctacagcccctttctctctctcaaagaaaaggccaaactcagccagggtcgtgctgtaattctaggcagtcaaggctttacctgtaggtggtggttactaccctggccctgagagtgggagaaactgcctggcttccagtgaaatgaccccttcctgtcccccttttccctgtaagggttcatagcatctcctcatagcatagattacttactacttgagggaaacagagggtctgcctgggtatcgcacagtactgtgtaatgcagcaatgtaattatcactgtgtaatgcagttttgtatggaaaattagttcaggttcccaacagcaaactgttgaaattcagcctgttttagtttggagcctgtgaatgcagcttccctcctgacatgcctcacttaaataaatgctctccataatgccctgtgtcattaaaagcatcagtctccaaccagacttcctgcggtcagaccctaattccaccaccttttcccaatatacctggagcaatttatctaacccctctatgcctctgtcttctgataaataaaatgtgtataagaggccgggcacagtggctcacgcctgtaatgttagcactttgggaggctgaggcaggcagatcacctggggtcaggagttcgagaccagcctggccaacatggtgaaaccttgtctctactaaaaatacaaaaattagccagacatggtgatacatgcatgtaatcccagctcctcgggaggctgaggcaggagaatcgcttgaacccaggaggcagaggttgcagtgatccaagatcatgccactgcactccaggtctcaaaaaaaaaaaaaaaaagtgccaaaaaaagtggataagaatagtaattttgggttgggcacggtggctcccacctgtaatcccagcactttgggaggcccaggcaggaggatcacttgaggtcaggagtttgaaaccaacctgggcagcatgacaaaaccccgttctacaaaaaggtacaaaaattagcagggcgtgttgctgtgtatctatagtatacacagtcagggactgtctatactgtaataagacagtcagggactatctgtactataataaggactgttccatatccttagtcacaagccttttagacttggatgaactacataaatgggctgaaacttcgtgtcctgatttgtaaaatagtatagacagtccctgtctatactagtgagccactgctcccggcccccttttctattttctacgtctatgtttgtttacaaagttgggattttatttttttacatatactttattattttcacttagcataatagcatgaacattcttgcacataaaagccacatctcttattcatggattttcacaccttttacaataacagaagttgatttcaggccgggcacagtgtataatcccagcacttttggaggccaagacaggcagatcacctgaggtcaggagttcgagaccagcctggccaacacagtgaaactttgtctctactaaaaatacaaaaactagccaggcatggtggtgcatgcctatagtcccagcttctctggaggctgaggcagaagaattgcttgaacccaggaagcgcaggttgcagtgagccaagatggcgccgctgccctccagcctgggcaacggagcaagactttgtctcaaaaaatgaaataaaataaaagttgatttcggtaacaatttttctaagaaaaagaaaatttggccgaggggatatattaatatattctctgaaacagcctaatttgattcaaattctttgttttttcctcccatctggcacattccagaaagtcctatgagtttgaagatttactgcagtcttcctctgagagcagcagggtggactggtacgcgcagactaagctggggctgacacgcactttatcggaggagaacgtctatgaagacattctaggtaagaagccacagcgtctgtgtgcggatctgagtctgtctgggagaaaggggagggagaatggggctggctgctggaaacacacgtgcacacacatgtacacacacacacacttgaagacacctgtgcactcggatgaaaaagcaggcaggtggggtgggagagtgagccttgtgggatatatgacagaccctagggctggagggggaagactagctggtaatgagtggccaaggaggcagtgtggcagcgtggcatagcgagaagcgtggggcctggagtctgaagatccagaaccacatcttggttctgctgcctgttggccgcaggacattgagccagtgacttcacgtctctgaactgagttctcccatctgcataatgaggatgaagctagctcccttgcaaggttaaggactggagagaatgttgtgtcaactacctcacatatgacagatgctcagtcaactgcagggattactgaatgaaagaaaacactacacaacagagcctccttcagaaactgtcagagtgtggcactaacagggcatcagaacacagactaaatgtgatttaaaaagtaactttggctctaaagcgtcctctgagatttcagagtgggtctcagattcagagtttggtgagttcagtcatcttcagggaggttgatggttttagtgaagggcgagctccaactgcttacggtgcgggtgaaaggtgggggaagaaacaagctgataaaagggagaaacccatatgtgtgtgctggtgaggggcaggtagggtggatatatgcagacatgctggcatgtaatcatcaatactagaaaaaacttacagaaggaggaaatagaaaatttgaggaaggcagatgcttagctaagcaattggaattgcatctgtgtccaggctgctggagatgggctcctgccaaagcagcgggattcccagatctaaaatgggagcgagatctggacttctcttagcagtgactgcccaagaggatgctttcagttacaaggaacagaaaacccaactaaactagcttttccttcctccatttcttttctttctttcttttttattttttattttttgagacaggagtctcactctgttacccaggagttcaacggcacagtctcaactcactgcagcctccgcctcccaggttcatgcaattctcctgcctcagcctcccaagtagctgggattataggcgcccaccaccacactcagttaatttgtgtgtgtgtgtgtgtgtgtgtgtgtgtgtgtgtgtgtgttttcttttttaggagggacggggttttcccacattgcccaggctagtctcaaactcctgggctcaagtgatccacccccttcggcctcccaaagtcctgggattacaggtgtgagccaccgcacccagcccccttcctccatttcttacctctcaggttagctttattctcagcaggcttcccagcgtccccacaatggctgccaccagcttcctggaatccatatcttcttggtggagagaagagctggtatcctgcaagtcccagcagaaatcctgaggttcaccctcattagaccagccaaggtcatttgttcacctttagagccggggaatgccatgcagtgatatcacttaggcttagaatatgagcccttccctgaactgatcactgaggcagggatttgggatacctagattggctaaagcgctgaaactgagaatggagttaatctcccatggccacaaatgaggagatggagaggtaacccagtgaaatcagagactgctgccaacaggaggggcgcatggatggcaaaacagcagatatgcctacaagaatggacacaggagaggccaagatactgacctcagtgttttgaaaagggaaatgtcctcagtgttcccaggttcctgacacattgcctttgaacacagatccgccaatgaaggagaacccttatgaggacatcgagttacatggtcgctgcctgggaaagaagtgtgtcttgaattttcctgcttctcccacctcttccatccctgacacactcaccaaggtatgagtcccctgggaatggtggcaggagagggggccaaagcatggtggccttgagcactctggagttccggccagcactggaattccaggccacctccacctgccctgccgggctcctggatttgtacaacgctggctgactggtcttcctccctctagttctcttggagcccctctgctcaaaaaagcttcctaaaatacgattgagattctggctcagaaacctcctcaaactgggtaaataaaagatggtacatccgtcccatacaactgttaagaatgtcttaacatagagcatactctaagatacaagacggaaaggcatgatgtagaacagtagttttaaagtattttgccatttgtgggttgttgttgttgatttaattgagtcagggtgttgtcgctctgtcacccaggcaggagtgcagtggtgcaatcacggcgcactgcagccttgaactcctggactcagtcaatcctcccacctcagccttctaagtacctgggattacaggcacacgccaccagcccagctaatttttgtattttttgtagagacggggtttcaccatgttggccatgctaatcttgaactcctaggctcaagtgatccagctgccttggcctcccaaagtgctgggattacaggcatgagccaccgcacccagcctgtgggttttttaatgaaagaatatacatacatgtaaactcgcacatgtctatatgtgggtttttttaaatgaaataacatgcatatatataaagatgaaagaatatacatatatgtaaacttacacatgtatgtgtaagaatatctccatccccaatgttggaggtgaaaaaaaaatctctgtgcggatacccaagcatgagtaactgaggacctcagaggagttgtcctgtctgaatgcccagagggcagggggaaggctgaccttctttttacagaatatccttttgaactttctggagttacataccatatgcacatagataatataaccttattgatatagatggtaatttcaacccattgcctgcaggactagcatttgtaacagatatcttggcacccattacccctaatctcccatagatcctacatacaaatgccccttccatccagagcctaccaactacccctctgatgcaggcctgggacatgcgcactctctctaaagggccatagagtaaatatttggggctgtgtgggccatatggtctctgttgtaactactgagagtggccactgtagtgtgaggcagtcatagacaatgcgtaaataaatgagtgtggctgtatttcaatcaacctttgttgttgttgttttttgtttttgttttttgagacggagtcttgctctgtctcccaggctggagtgcagtggcacagtctcggctcaatgcaagctccacctcccgggttcaagcaattctcctgccttagcctcccaagtagctgggattacaggcatgcgcctccacgcctggctaatttttgtacttttagtagagatggggtttcaccatgttggccaggctggtctcaaactcctgacctcaagtgatccgcccgccttggcctcccaaagtgctaggattacaggcgtgagccaccgcacctgacctgaatgctgaaatttgactttttttttttttttcgagacggagtcttgctctgtcgcccaggctggagtgcagtggcacgatcttggctcactgcaagctccacctcccaggtttacgccattctccggcctcagcctcccgagtagctgggactacaggcgcccgccaccacgcctggctaattttttgtatttttagtagagacggggtttcaccattcacaggatggtctcgatctcctgaccttgtgatctgcccgccttggcctcccaaagtgctggggttgcaggcgtgagccaccgcgcccggcgaaatttgacttttatatgattgtcacttgtcatgaaatatttatttttccaaccatttaaaaatgtaaaagttaattcttaagtcatggcttgtacaaaaacaggtggtgggccagatgtggcccacaggtgccaaccagcgaggtcatttttaactctgcccttggctcttaccgggacctctccccatcctctgaggcccagttcaatcatgcgtcctttaagaagcgtctccagccatcccaatccctgggacttctttctctctgattatctgtaacactcagttaaaccatttctttttttgttatttttgtttgcttgtttgtttgtttgtttgagacagagtctcgtactgtcgcccaggctggagtgaagtggcccgatctcggctcactgcaagctccacctcccgggttcacgccattctcctgcctcagcctcccaggtagctgggactacagcctcccgagtagctgggccatcaccatggccggctaattttttgtattttttttttagtagagatggggtttcaccgtgttagccaggatggtctcgatctcctgacctcatgatctacccgcctcagcctcccaaagtgttgagattacaggcgtgagccaccatgcccagccttaatatatcttaaaaacatctccccaactagattataaattcctcaaggtcaaaaggtttatattctaaacctaagttaaaagaaagaaagaaagaaaaatgtatatattctatttctttggttttcctggaaggcctaacagttctacaatatttagtggaagaaattaaggaaggccaagtaccagctgcaaaggtcaacttaaatctcatggcaaggctctgtttccagcctaggaaaagcagtggtcttcctgtcccagccccacagggtcagcatcgctggcaggtggggctgtctccacctgaagcctgtctcctgtgcttgatggccataaagggatgctgcctgccaccaggcttctggaagaggtgagggaacaacctatcccaaaggatggatcttacagacccagataaattgctacaatacttgcctgcaccagttaactgtcatttctcttctcatatggaaaagggtgtcatcaagaataatccatggcaactgacaattagcaaatgctctctgcttgccttggaaatgtgttgttggtgttttcattggaatagggatgtcttcaacatttaggaaatccttcatttcccatggcagagaagcctgacttagaagaagaaagcaagctgtcacacctggtctgtcccctctgggtcctacctggctccccacttcatgcggggagtgaactgcctcacccctgaggaacaatgaaaaacatctgcccaggccaagcgcggtggctcctgcctgtaatcctagcactttgggaggccaaggcgggtggatcacctgaggtcaggagtttgagaccagcctggccaacatggtgaaaccccatctctactaaaaatacaaaaattagccaggtgtggtggcgggtgcctgtaatcccagctactcgggaggcagaggcaggagaatcacttgaacctggggggcagaggttgcagtaagccaagatcatgccacttcactccagcctgggtaaaagagtgaaactctgtctcaaaaaaaaaaaaacatctgcccaaggcagctctgcattcagggcagaacgctcctccctgataccaggaaataaaggcttaccaacccttttcttcttgtcactgctgggctggagaaaacctagagcctctgccaccaaagcagctaagcccagtaggtgagaatgtcaacaagaacttaacgtccagctgtatctgtatctgtagctgtcctgaacaaagagaatccagttgtccagagcacgtgtctgattgccacggatccttgcaagccctcagcgggacacggtgtccgtgctcattattctgctcatccacatctgggtgtctgctgtgtgccctgttctaggggacagctggagacttcaccacttcctccattagctcatcaaatattcatggagtatctaccgcatctgggctgcatctgggaccctaaagcttgcaggagcagtccctccatgtgacctcccccaccagctgcggagagatcctcagccatctttgggatgttcatttcattaggccacagctagttattcgggtcactagaatttccattcgagagggaagggcctgttggataggctctcctcagaaaggaccaatgtgtagctgcgggcagatgctgctgctgctgaacgcaaactgcaagctcctgaaagggactgttttcttttcttgctacgcatcacccaccgtttcttttcttttcttttgagacagaatcttgctctgtcagccaggctggagtgcagtggctcgatcttggctcactgcaacctccacctcctgggttcaagtgattctcatgccccaccctctgactagctgagattacaggcacaggccactgtgccggctaattttttgggtatttttagtaaagacagggtttcaccatgttggccaggctggtttcgaactcctgacctcaagtgatccacccacctcagcctcccaaagtgctgggattacaggcataagccaccgcacctggcctatacttttgaatatatgttctttttaaaaataacaagctgggtggccgggcacagtggctcacacctgtaatcccagcactttgggaggccaaggtgggcagatcacctgaggtcaggagttcgagatcagcctggccaacatggtgaaaccccgtctctactaaaaatgcaaaaattagccaggtgtagtggcactcgcctgtagtcccagctacttgggaggctgaggcaggagaatctcttgaacctgggaggcggaggtttcagtgagctgagattgcaccactacactccagcctgggcaacagaatgagactccatctcaaaaataaataaataataataatagtaaaataacaggctgggtgcagtggtccatgcctgtaatcctagcactttgggaagccaaggtgggaggattgcttgaggccaggcattcaagaccagcctggtcaacatagtaagaccccatctctataaaaaatttaaaaattagataggcatggtggtgcatgcctgtagtcctaactactcgggatgctgacatgggagattcacttgaacccaggagtccaaggctgcagtgagctatttttgtgccacagctctccagagtgagagcctgtctccaaaaataaataaatacatacatacatgcatacatgcatacatacatgcatacatacatgcctttcttttttttctgaaaacattgtaattgtaaagtttttctggttacatgataaagaataagtgtttcaattactgcaaagtttaatgaagaaaaaaactcgtccacaattggggaattttacttttctttatgcctctattttctaatatttctgtaatagatttacatttttttttgagatggagtttccctcttgttgcccaggctggagtgcagtggcatgatctcagctcactgcaacctctgtctcagtttcccaagtagctgggactatgggcgtccaccaccatgcccagctaatttttttgtatttttagtagagacggggtttcatcattttggccaggctggtcttgaactcctgacctcaggtgatccacccacctttgcctcccaaagtgcttggattacaggcgtgagccacctcgcctggcccagattgacatcttgtatatgtgtatttatgtgtgtgtattttaaagatcttcttaaaacgtgcatgtaaccccaacactcactgctaacactttggtttatttcctcccggattttctcacacacatctcgtgtggtgtgcgtccatgtgtttgtgtgcatgtgtgtatacatttttttaaaagatttgtgatcttgggaggtcgaggcaggcgaatcaactgaggtcaggagtttgtaaccagcctggcaaacatggcaaaacctcgtctctactgaaaatacaaaaattagccgggtgcagtggtgtgcgcctgtaatcccagctacttgggaggctgaggcaggagaattgcttgaatctgggaggcggaggttgcagtgagctgagatcccaccattgcactccagcctgggtgacagagagagacttcgtctcaaaaaaaaaaaagaaaagatttgtcattatattgtatatgcagttttgatgcttttttatattgatcgtattttcccatgtcatcaatttctttttattattattattattattattttgagacagagtctcgctctgtcgccagtctggagtgcagtggcacaatcgtgacttactgcaacctccgcctccgggattcaagcaattctcctgcctcagcctctcgagtagctgggactacaggcgtgcgccaccatgcccagctaatttttgtatttttagtagagatggggtttcaccatgttggccagatggtctcgatctcttgaccttgtgatccgcccaacgtggcctcccaaagtgctggaattacaggcatgagccaccgctccaggccatgagccaccgcatctagcctaatttatttttagaaacagtttttattgcctgcacggtatcccattatcttcatagaatgtcattagtccccattgttagaatgcccttgtaagcctttctatttttattttattttatgagacgaagtctcacgctgtcgcccaggctagagtgcagtggcatgatctcagctcactgcaacctctgcctcctgggttcaagcgattctcctgtctcagcctcctgagtagcgcaggtgcccactaccacacccagctaatttttgtatttttagtagagacggggtttcgccgtgttggccaggctggtctcgaactcctaacctcaagtgatccacccgcctcagcctcccaaagtgctgggattacaggcgtgagccactgcacctggcccttgtatgcctttctctgtatatatatttagagaagtgtctcttttttcatgcaagaatgtgtgtacctacaggcacatatgagcaaatatgtatgtttgtgtgaatgacagacagcacaggaggtctcctaagagtaggaatgatgttgagatgggtgagggggatggggatagtttatatcaaggatccctgtagtctcccacaggcagagtctcctgaggcagtaaagtcaggggcagtagaggactggaaggaattgagccaccagccaccgttcacagacaagaagggttaatgaacctgggctcgaatccagcttggccccctctgatggggcacacagcttccttgccactgcaccccccaccccgcccaggatgtcccctggccactctcctgaaacaactgaagaggcttcagcagggaggttggacctcagaccatcagggttcttgtctcttttcccttttggacactacagatcttttgctgtgccatcatgagtcggagatctatacaattaggggtgtctgggagcctctcagcagagctaagcccctgaggttactccagagggacacaatgggatttaggtgccatacatgttggtgtaaggtcctctgatcaaaagctagaatcttctctggaccacagtctgacacatcgttcttaggatcctagagtgacttcccttttatgccatagttctgggtgtgacaagcaactgctggttccctgatgttatgaataaagttctatggaaacacagccaggtgcattcatttacgtattatctacagctgcttttatactacaaggacacagtttagtagttttaacagagaggatatggcccacaaagccttaagtacaatctggctttttagaaaaggtttgctggctgggcgcggtggatcacgcctataatcccagcactttgggaggccacagtaggcagatcacctaaggtcaggagtttgagaccagcctggccaatatggcaaaaccccgtctctactaaaaatacaaaaattagccaggcgtggtggcactcgcctgtaatcccagctactcgggaggctgaggcaggagaatcacttgaacccgcgaggtggaggttgcagttagccgagattgtgccactgcactccagcctgggcaacagagcgagactccatctcaaaaaaaaaaaaaaaagaaaaagttttctgatccctaagtccaagattcatatcctcactttcaaaggccttcaatagacaattagatgtcttcattgctgtatcatctcttccatctgtttcactgtgcttactctaaggcttgaagactcttttgatctaatttactctccctcaccactattctcagatagtactgtgtcattgctaatactctcacccacagctaagtcttcccattctatcaaataaatatctactgaaatcccaccgcatcatgaaagctccctgaacatttggtggcttatttggggtgccctggaacacatcaggatcccctttctccagcagggtgaccactcagagatgcagcccacacattcttcagaaagctgtgtgttgtgtttccattccttctctggtttctttcttctctgaccttttcataggtcatatctcctttgaatgaacaccatcacaatctacatctctaacaaaagcagaacctacgttttcccaacagtttgacaggagattccagtgcaatggtaggagcatttccttggattttattgtagatggaatttggcctcaaagaaggcttgcccctcttccttctttttgtgctcttatggtgcccaatccaggtcagctcttcctctactgaaagtttatggcactaagcaatttattgctccttggagacctgtgataaaacattggagctggccacttaggaaactaggagtctttatttttggaaatctttttaaaaagaaaagattctgaagttattgctacttactatttggaactaagcaaatagcgaatggagaaatcaatggagcaaaatatgcctattctgtgagagtttaagataggataaatgtggcctcataagttgataaagaaaagctctttcattaaatagaacaaggataagttattttgggggaaaatggtttagatgaacatatcacaaaataaattaccgatggaataataaataaaatgtgtacaaaaccaagaaaatctggaagaaaatggaattgaatatttattgaacatctaaaaggagatagtttttttaggcaaagaaagaagagattaaatgaattacaaaagaaaagattaacacattttcatataaaaagttattataactaaaataaaaatacaagtaaatcacatgggaaaagcacacttacagcaaacctgacaaatagttaatatctgttctatgtagagctcattgaaaatagtaaaaacattagaatcctaaaagataaacaaagaacataaaaaatacactaaagaaaaatacagttggcgcattgaagtatgaaaaaatgtcaatgatgtaaaaataattatatatatatatatatctgaaagaaccttccatatcagtacattaagttttttgtttatttatttatttttttttgagatagagtcttgctctgttgcctaggcgggggtgcagttgtgtgatctcagctcactgcaacctctacctcctggcttcaagcaattatcctgtctcagcctcccgagtagctgagactacaggtgcatgccaccacgtcaggctaatttttgtatttttaatagagactggggtttcaccatattggtcaggctggtctcgaactcctgacctcaggtgatccacccacctcagcctcccaaagtgctgggattataggcgtgagccaccgtgcccggcaagtacattaagattttttaaataattgcatggtattccactgtgtgggtatatcataatttgtttgaccagcccctctattgatggatatctaggttatttccagtattttgtgattacaaaccatgtggcaatgtacaatatcctttgcacaatatgtttccttgtaaaaaataacattgcacaaataagagtatatcagcagagtaaattcctagaggtggaattgcggggtctgaagctatatgcatcataattttgttagctcacactagactgccctccgtagagctgtgccaagtgatgctcccaccaaccctgtatgacagtgtgggagtgacttttctccctcactttcaccaacagagtgagctatcaaattttcttatctctgagcaaaaaaatgtttctttaatggagctttaattttcttttctcttgggaatgaagctaagaatctttttatatatctaagaatcattgtatttctttttctctaaattttccattattttgcctgcttttcttttgagtcattagtctttttctcattaatttgtagcgtattttgggaaaatgagttaatttctgtgagttatcgtctatgggttctaaatttttttagcaagtattttgtttgccttttgactttgttttttgttttgttttgagacagtctcactccatcacccaggctggagtgcagtggcgtgatctcagctcactgcaacatccgcctccagggttcaggcgattctcctgcctcagcctcccgagtagctgggattacaggcacccgccaccacgcctggctaatttttttgtatttttagtagagacggggtttcaccatgttggccaggctggtctcaaactcctgacctcaagtgatcctcctcagcctcccaaagtgctgggattatggcatgagcaaccacacctggccagccttttgactttgaagaggcctgttttagaaataagatattgagggccaaagaaacacaattccttgtataaaaggcactcagcaatcctgcagcaaggccaaagtgaggcttaggccttgtaacccctagtccatgtgtcttgggttgtcagaaagcctcagctgtaacgtcttgggattgaggcaggtgacctcgcacttgtctaaaaagagaaaccgggccaggtgtggtggctcatgcctgtaatcctagcactttgggaggctgaggcaggcggattgcctgagcttaagagttcgagaccagcctgggcaacacggtgaaacctcgtctctactaaaatacgaaaaattagctgggcgtggcagtgtgtgcttgcagtcccagctactcgagaggctcagggaggagacttgcttgaacccaggaggcggaggtcacagtgaacagagatcgcgccattccactccagcccgggtgacagagtaagattccatctcaaaaaaaagaaactgaattagatttacatcgctcatcacacacagttttggtaattggatgatatgtattcattgaacacttactggcataaccaaactccacctaacctgggaacatagaccagttcctcttctcaatttcattgtctcgtccctggcaccaccagttatcccccggtcagtctcctttgaattcatttactcttcttttctccttttccttcacagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaaggtaatggtggcaacaagcttcatgctcaggtatgcatgaccccttctctgtgaaagaagactgcagaggggtctgggtggagaatacatcactggcccctctcccacctgtgttgctgcaggccagggggacacagtgaagccagcaggctggaatatccggaccttcgtcctgatcatttttgtggtcctgtggtcttcctcttagccactcttctcccaatcttagctgcttgtctaatcccagacaaggttttaatgcctatcctcaaaaagccacagctccttccttcaccgccacaaaaaacagaactccatccatcatgctctgacctgagacggtcgacacccgctgcagaggcaggtcccagtctgtgctctgagacagccttgtcaacaatacctcttgtggctctttgcagccaaaaaggtaaaatattcccaggggcttggaaatatacattctatatgcatccgttgttggttacatttccttttgctcaatttcagtgctgcagttctggtctctcttcattgaccaatttggtactgtagggtaggcagaatttctcctctaccctcttagggtctccagctgagccttagatttaaactgacgtaaaacagattaacaggagaaatgcatactcattttatttacaagtacgtgggagccctcaaaagaaaaatgtaagacccaaagaagtgactgggcctatgtgcttatatactaggctgaagaaagagcggcaattgtggaaaagtaaccaggaagataggggttaaacaaggtttgtttgattagatttctcttggcctcaactccccatcgctgctgataatgtttcttccctcctgttataaggagggcctcttttacatggagtttcatctcctgttttaagaagaaaagggaaggtcagagcgccctttgtgcacctgctgtttttagagtgtctttagttaaaaacaactaatatgccaaagtggcatattttggggagttacatcctgaactccttcaagatcaacttcttttttttttttttttttttttgacagagtttcactctgttgcccaagctggagtacagtggtgtgatctcggcttactgcaacttccgcctcctgggttcaagcgattctcctgcctcagcctcccgagtagctgggactacagtcaccacacccagctaatttttgtattattagtagagacggggtttcaccatattgaccaggctggtctcgaactgctgaccgcgtgatccgcctgcctcagcctcccaaagtgctgggattacaggcatgagccaccgtgcccagccaggaacttggagagcagggattcttaatttcagagttcatggatgggctttagggggtcatgaaacccataaaaatgtaaaactttatgcagataagtttcggtgtgggacactgtctgtagctttcaagggacttctctgagtgacccattgacctgaaagaaagtccagggaggctgggcacagtggctcacacctgtaatcccagcactttgggaggccaagataggaggatcactttagcccaggagttcaagaccagcctgggcaacatggtggaaccccatctctacaaaaaaaatttaaaattagccaggcatggtggtgtgcacttgtagtcccagctacatgtgaggctgaggtgagagagaatcacttgagcccaggagttagaggctgcagtgagctatgatcatgccactgcactccagcctaagtgacagagcgagatgctgcctctaaaaataaaagagagacagagagagagagagagagagagatggttctgctgaagtccacttagggaatgcacctttaagtagtggtgcctactgagtgactcaccttggcagcactaggagaggttatgaaaggacttggcaagtctgaggacagctaagaactgtcatcctagaacctagaaagttagactgttggaaatatctcaggtaagtggaatcacacagaatcgtcctttgtgaatgacatttcactttgcttagtgtcttcaaggtttaagcatgtgtcagcattttcttcttttttaagactaaatggtattccatcgtatgtatataccacattttgtaaatccatctatccgtccatggacacttggctgttagaaagttggagtgtttcaacagaagtgactgttgaaacactccaaccccttcattttcccgatgaggacatttgaccccatagaagccaactaaatggcccagagacacccaaccagctagaagcaaagagggccagacaatgtttaaatattgaaaataagaattgaaatattcaagccaacacggtggctcatgcctgtaatcccagcactttgggaggctgaggtgggcagatcacttcaggtcagaagttcgagaccagcctggccaacatgttgaaacccccgtctctactaaaaatacaaaaaaattagctgggcatggtggcacacacctgtaatcccagctacttgggaggctgaggcatgagaatcacttgaaaccgggagtcggaggttgtggtgagccaagatcacgccactgcactccagcctggtgacagagcaagactctgtctcaaaataaatagataaataaaatatttatagaacatggaaattgattaccatcctatatttttgtttactgacctatacagataaaagtgttatataacatttaacatatagctgtgagataataagattaattttgtaagcacacagaacaactaattttagagttcctccacgtgtgggattctgaatcacatatgccatgagcgtgtactctttgatagcaagccctgggggacccagcaaagcaaaatacataaattcgcactcaccagcttctcacgcaagaagagggaaaacaaatacataggaaacaccaaacttttttggtctgaaatatgaaaaacattttccatggaagcaggtctcctttcaaatgcatcagacaactaggctggcctgggaggtggggaggggcagggcacagggcgtctggcagtggtgatgggggagaccacataggctgagtggcctgcttggaggcttgggatgtgtcccacaccagggtatccatgtgcacttgcacactgcatgtgtgtgttctgtgaacacatggagggtacatgacatctggggagcgtgtccctctgcagatggggctgcacgctcgggtgcatggcaccactccccgtagtcccaagctagggctcgggagcagttctaatcccggttctcaccccactcagggctgctctgacattctttggaatagttcccatgaagggagccctgcctgggaactttttttttctgtctcttccttttcttgttttgttttgggaggaaaagctccttcccaagccgcagtgacatcgaggcctcagagggaaagcagccatcgcatcatgagcaatgggctgtctccccatgggtctctgctgctcgtgagcagatccagacaacagacgcccatagggcagtggagctggcagcctcctttagtgtccttgacagtcacgttcctgtgtggtagaaaaaaatgactgggctgggtgcggtggctcgcgcctgtaatcccagcattttgggaggccaaggtgggtggatcacctgaggtcaggagttcgagaccagcctggccaatgtggtgaaaccccgtctctactaaaaatacaaaaattagctgggcataatggtgggtacctgtaatcccagctactcaggaggctgaagcaggagaatctcttgaacccagaagttagaggctgcagtgagctgagattgcgccattgcaccccagtctggtcgacaagagcgaaactctgcctcaaaaaaataaaaaaaaaaaatgattgaaagacacccatgagcccatgggaagtttctcccactccccctggccctggccctccatcgtcctaggagaggggcagtgagggaagcccagctgccacagagagtgggctgctaacactggctgttcttctcctggtgtctggcagctggtgttgcgaatcaacgccatttatgaggtccggagaggaaagaaacgggtgaagaggctgtcccagtcaatggagagcaactcaggaaaaggtagaacccccaccaccagccctcctcccgcaagaatcggaaaagagattctttccagaagtggcttcctgttttttctggttggctcaccaaggaggagaacaagctgatgctttgtaaatgtcccgcactgtctttgggacagtggtggggctgggagctcagccggggcagcatgtcccctgcctccccatccttgtcctggtccaccaccaagtcagcccagtactgcaggccctggcctgactgtgggagcagccttccttgcttagcctgcacaaaaggggccaggaccttctgttgtattatctgatataggtaccatctagtaccatctgaactagagccaaattaatttggcagtacatcgagttggacgagacgtggtttgtgcaatacattgaaagagacaacaagaggcggggcgcggtggctcacgcctgtaatcccagcactttgggaggctgagacaggcggatctacctgaggtcagaagttttataccagcctggccaacatggcaaaaccttgtctctactaaaaaatagaaaaattagccaggcatggtggcatacacctgtagtcccagctactcaggaggctaaggcaggagaatcactggaacctggaaggcagaggttgcagtgagccgagattgcgccactgcactccagcctgggtgacagagcaagactccatctcaaaaaaaaaaagaggcaactcaacatcccctctgaattagaacatttgatctgtgctaccacatagaaagagtttcctacatgagaagaactcacatttgcaattttcttccttgttcttttcttctagtgacagatgagaacagtgagtctgacagtgacacagaggagaagctgaaaggtgaggagagccactactgtgcaggactcaggcaggtgacttggaagctgcaaaggtggcccctcctccttagtatgagggacagaagcgtcctgccggagcttgcttggcaaggcgtggacatctcgggagacagtggggccacagggtgctccagagccggtccgtcatgggcatgatcaaaatggcactacagttgctgagagccagggtggctgcagtaacggcagcgacccctgctcccatgcctctccctatgtcctgagggttttccacacttcaaggcttgacactgcagccctaagcctccagagacctggagcttctgcccacttctgctcaaattactgtgtgatctggaggaaatcacttaagatccagggcctctagttcatctgtctgatgaagttgttgaaataattggtccctatgggtctaaaattaaatagtctaggccaaggctttagtgagttttctgcaatttttcagaccccagggagaagccaaagaaagcaagtccaggggccgggcttggtggctcacgcctgtaatcccagcactttaggaggccgaggcgggtggatcacaaggtcgggagttcaagaccagcctggccaacatagtgaaacctcgtctctactaaaaatatgaaaaattagccaggtgtggtggcaggcgcctgtaatcccagatactcaggaggctgagggaggagtatcacttgaacccgggaggcggaggttgcagtgagctgagattgcgccattgcactccagcctgggcaacagagtgagactctatctcaaaaaaaagaaagcaagtccagattgctgaacgaggtgacagggacctgtccactcagtgaccctgctgcattcacctctgacacccagctgctcccggactcacctctagaatgaagcaaggccatttcattgcagagttagtggcaggaggggaggtggacaggagttcctgagttagtgggatctctgccagttgagtcacaagggatgtttacaaagctcccagctccaaaagccctatagtctggattctgtcacatcacaccaaccaaaagacgagggaaatgggtgaggggaggagtcactgtccccatctcatcagacagatgaaggcaaggacatcttcagcctctgcccagagtccagacagcaaaaccatggcagagcagagccaggctcctgcaccctgattggtttggtagccaactgaatgttggttctcccagaactttggcagagatcccaaataaagagtttcctactaatttgttagacacagaaacactttggggattagaaaaaagtacttgagctgataattacataacctattgcagctcggcacaattccacatggactcatggtcatttcaggctctttgctcactctgtctctctctctctctctctctctctctctctctctctctctttctctctttctctctccctccctcacccagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaaggtaacagggtggccaggtccctgtggcctgccagggttctaaccatcaccttgttgggactcatgaattgagggaggtgtgggagtctgaggaacacctagcatctagaatcttgaaaatgggtcctaattagggtatatcagatgaaaaaaaaatgctgctgctagagaatttgggaggtcccagaaaggagagattcagggacttaaaaagtttggccagacaaatacaaaaattagccatgcatggtggcgcacacctgcagtcccagctactcaggctgagacaggagaatcgcttgaacccaggagatggaggttgcagtgagccaagatcacgccactgcactccggcctgggcgacagagcaaaactccgtctcaaaaaaaaaaaaaaaaaaaatagtatggccagaaatgctttctcacttgctgtggtccctgtgctgaccgtgccatcctctttgccctttccttccatctccttatccagccagccacatctcttcctaacctagcctagaagtctctttcccctgaagccccaagtctccctaagcagcatcatacttgtgtctatgctgaacttctgctttgcttgtgtgctgtgcatctttgtgtatgtcccttccttttgttacaggcaggggatctcaatccagacctctagagagggttcttggatctcacacaagaaagaattcagggcgagtcagcagggtaaaatgaaagcaaatttattaagaatgtaaaggaggccaggcgcggtgactcacacctgtaatcccagtactttgggaggccgaagtgggcggatcacttgaggtcaggagtttgagaccagcctggccaacatggcaaaacccactctctactaaaaatacaaaaattagctgggcgtggtggcaggcgcctataatcccagctactcaggaggctgaggctgtagaatcgcttgaactcaggaggcagagcttgcagtgagcagagattgcaaaaagtaaaggaatgaaagaatggctactccatagacagaacagccctgagggctgctggttgcccatttttgtggttatttcttgattatatgctaaacaaggggtggattattcatgcctcccctttttagatcatatgggataatttcctaatgttgccatggcgtctgtaaactgtcatgatgctggtgggagtgtagcagtgaggactaccagaggtcactctcatcaccatcttggttttggtgggttttggccggcttctttactgcaacctgttttatcagcaaggtctttatgacgtgtattttgtgccgacctcctgtctctgctttaaccatctgggaatgcagcccagtaggtttcagcctcattttacccagcccctactcaggatggactcgctgtggttcacacacctgggacacttttatgtcatggaccatggccgtatgaattcagctttaccatatgttaaatcatggcacctaaaataaaataaataaaatggcacttaatatagcctgaagcaacatggcaataatttataaattattcttaggctttgacatcagtattaaagaggttccaccatattctaattcagttcaaccagaatttactaagaatatattgcattcaagcaattttctgcttggccctaggggattacagtgataaacaaaatgtgtctcctgtcctcaaggaatttaaactctcccaggaggacataaaataaccatctccccccacccccagaaaagcatgcaaagattcaccaggtagaatctgatggtctctggacagactcatgcctcagggagggcagaagggagggagcttctgtccttgcccactcagggactccctttgccatcaccacccaggcataaccccagcatctaccaaggcccagatcctgctgtccccaggcctcccctccttttgtaggccagccttccttccatcctgcccactgtgctctaacaccacaatcaagtcctatttttggagtttaggatagcaattatgtagattgaagtaaaccataggcaccggccttccaaaggtgacactcaccttcctctagctatcacacctctaaggaatgagctcctgacaccccactactacaggtatgcccagatttttttttgccgggggctgcccatgggtaagagaggccactgggtatgctcacactgactcacaacagagatcactgaggcgtgaagggctgtcctgctatcctgttcattgccttggggcctagcacaatgctgttcacgtggcaatgcttaatcagtgttgtaggaatcaaggaagcattaattcatgagttagttaattaatgactcaccataatgatcaaatgattattgtttccagcctggagtcacccacattaaattttttttctagagtaaagttgcacattcactgtttaaaaggaaactgatccagaaatgtattaggaaagaaatcactagtaatcccaccacacagagaccgtcactgttaacattttctttttcttccagtcttttctaatggtgtaatgttcttacaaaactggaattatacactgcagaatttttgtatcgtgctgcgtgtactcttttgtaaacctctcattatttataagcatatttaataaaaattctaaaacatcatttttcaagttatacaatgttccaatatgtgagtattccctagtctatttttctatgtaaccagtccccttctgttagaaatgtatctggctaccagtgtttctgtgtgtgtgtgtgtatttttttttttttttttgacacagtctcactctattgcctgagctagagtgcagtggtgcaatcttggctcactgaagcctccacctcccgggtacaagcagttgtcctgcatcagcctcccgagtagctgggattacaggcatgcaccaccatgcccaactaatttttgtatttttagtagagatggggtttcaccataatggtcagactggtctcaaactcttgacctcaaatgatccgcccacttcagcctcccaaagtcctgtgattacaggcatgagccactatgccctgcctgtgtgtgtatttttgagacaggatctctgtcttgctgttgtcatccaggatggcatggagtggcacgatcacagctcactgcagcctcaacctcctgggctcaagtgagccttcccgcctcatcttcccaagtaactgggactacaggcgcatgcaaccatgcccagcttatttatttatttatttttcgtagagacgaggtcttcctctgttgcccaggctggcctcgaattcctgagctcaagcgatctccctacctcggccttccaaagtgctgggatccactgtgcctggcttttttttttttttttttttttttttttaatgcaatggtgatcatccttgtacaggcatttttacatgtcaggcattttatctccttgtctttgctcccttgctccctctgtagaaaggcccttttcctccttctctctcttctctttttaaactttttttgtgggttttatccctcacttctgtcaagtcacctgaatcaaggcacagcccctatttgcatgctaatgttccattaaaatgtttcctatcccatatttatctttgacagttcagggagactgggctgttttccagccatctgtgattagttgtatttgtgggaaatttccgtgtgcagcttcctgtaactgtgctcctgtgcatatatgagcctgtgtatgtatgcgctgataactcgtaggttgatgacgtgtgggtaggcacaagtgtgcctgtatttgtgtgtgtcctatgtgtgatctggggtgggtgcatgcaagtagtgactgggctgttgaaaagggctggaacttgtttccccacgaggtctgctcttcagtcctgaatgctgtttcctttgtggagaaactcatttggtattcttcctccctttggtattcttggctggtcctttctttggtcttctttataatttaagtcattcactctgtggtgattaatgaccccttcctataattacacccagctggtatttgcttctttgcatgactatgcaaggacagtcaaaattactgtttaggggacagtctgagcttgtgatttaccaactcaaagacttcctgggccagttgggttcatctgtgtcatcgtggatggaagagagaactgttatatagaaaagaaatagtggctatttattctgaagaagaacaactaaaggacaactaagtctataaatagtgactgtgttttaccgattgattgctgtcttaaccactagtattagtggcaccccatggcttcaattaaatttggtctagcctgaggggaatcatactggaagcgggtttttttgttgttgttgttttgtttgtttgttttgagacggagcctccctttgtcacccaggctggagtgctgcggcatgatctccgctcactgcaagctctgcctcccggattcacgccattcttctgcctcagcctcctgagtagctgggactacaggcacccgccaccacacccagctaatttttttgtatttttagtagagacggggtttcaccatgttagccaggatggtctcgatctccagacctcgtgatccgcccgcctcagcctcccaaagtgctgggattacaggcgtgagccaccacgccccagccaggaagtggtttttaaagttggaaacaatcagtctggtgctctgtgcctttggatactcttcttcagagccctcctctctctgacacatggtgaccttgggaaggcttgttgaccatcaggagcagtgaacaggactgctggcttgccaacttcagaaattgtctgcaagggtgttttaaagtggagctcgggccgggcgcggtggctcacgcctgtaatcccaacactttgggaggccaagtcagggatcacttgagatcaggagttcgagaccagcctggccaacatggtgaagccccgcctctattaaaaatacaaaaattattcaggcgtggtggcaggcacctgtaataccagctacttgggaggctgaggtaggagaatcacttgaacccaggaggtggaggttgcagtgagccgagattgcagcatttcactccagcctcggtgacagagcaagagtccatctcaaaagaataaataaataaataaagtggatctcactagcaagctattggaaacaaagaaattgatgcaaattattacagaaaaatttaggttagggccaaacaccgtggctcatgcctgtaatcccaacattctgcgaggctgaggcaggcagatcacttgaggccaggagttcaagatcagcctggccaacatggtgaaaccctgtctctactgaaaatacaaaaaaaaaaaaaaaaatagctaggtgtggtggtgcatgcctgtaatcccagctactcgggaggctgaggcaggagaatcacttgaacccatgacgcagagaacccatgcagtgagccaagatcacaccactgcactccagcctgggcgacatagtgagactgtctcaaaaaaaaaaaaaaaaaaaaagacaacagaaagaaagaaaaaatataggttagccattatatttaggttagacgttataaattcctaacctcagatattcagatatgagatatttcaaatcactgaagataaccttagcatgatgtatttttctttaactttttataaaggaaatttaacaagtataaacctattaacaacaacagcaacaaagcctacaattctcctcacatgaaaaagtacctgtttataagcaaagatgaataataatgagataaataattagaaattattcttttgtgtttcccaaacttgtatctggggtgcttcttaaaagcacagatttctggctaggtgtgatggtatgcactcgcagtcccagctactcaggatgctgaagcaggttgcttgagcccaggaattcaagtccagcctgggcaacacagcaagactctggctctaaaaaatatatatttatacatagaaagaaaaaaaatcacaaatttctgttcataagcaaaataaactcacgactttagtatcatctctaaatcagactttattaattcatcctgtccttttttttttcttagcgtcttgttctgtcgcccaggctggagtgcagtggtatgctctcggctcactgcaacctccacctcctgggttcaagcagttctcatgcctcagcctcccgagcagctgggactacaggtgccggccaccacacccagctaatttttttgtatttttagtacagacggggtctccccatgttggccaggctggtctcaaactcctgaccccaggtgattcacccacctcagcttcccaaagtgctgggattacaggtgtgagccaccactcccggcccttgttctttttttttttcccatagaggtgggaccttgctatgttgccccagctggttttgaattcctggcctcaagtgatcctcctaccttggcctcccaaagtactcctcctgttctttaacaagataacattcatccagtctttgatatgtcagatactgtatgatgtgctagaatatcataaagagagagagagaggaaaaaaagattaagatcatttttcttcctagtttgaacattaactcatgtgaccaggacacatcacttcacacctcggggcttatttccttcttgctgaaataagaatgtcaggctggatggtgtcacgcttccttctagttccaacactcaatgactgtctgaaattagttgaatttcccagcataatatggttttactggatttattcactgagaatgttgtaacagtctttgcctggagttcgaaagggacagctttgcctggacccagagacagagaggcctgattagaggctctgccttccagattcctgagcctcctatttggaaaggattgctggcagtttttttaattcactgaaatagttacattctagaatgtcaagcatagagaatcattctctaaagcatcctattttttcctcccaacttctcccagaggtctatagttggaagtgcactggggggaaaatgccccagccgactgagctgcaagctcttcccaagggaagaggctaaggcggcagtcacaaatgtggaaaggtgggagaggccatccttaccatcatccgcctcaatttcccatgctgagatttgttctcgaattttctctcacctttctccctgcagttggaaaggtctttcaagttcatgagagaagctgaggaccaactgaaggccattccccagttctgttttcccgatgccaaggattgggttcctgtccagcagttcaccaggtacgagctggcttctccccttcgcagccccaaagactaaggcgagacttagagacggggttacaggtggcagaccacatgagtcattcccaccgttaagtaatcctgatgggcctggcctagagctttccccaaggggtgtttttaaagcttccctgaaggtgaagtcacctgcccagcatgcagacctcccgggcttcccactcaatctggggatacttgtttcagaagcctcccggaagataattcttagcctgggaaaagttagggcaacattgcccttccccgttctcatcctgaaacatctcttcagtctcctatccagatgtttcttggattgggatccgtttacatttctgcttcatcccgagtaattagacaccagtgtttttattatcagatgtttccgcatttggccaaactcagtaggctgcgggtcctgtctttaaggggtaccgcgttccttgagggtggctcagcagtctttaaggaccgtccaagccccggggctgccctgtacagaccatgccctgagagagctgccccagggcaattccaagaggggcacagaactgtccccatcttccgctgctccctcaccgagtcacatccctagatgagcagatgtcactgcactcacacatgctcagttccctgaggacagcaccccaggctcttccctctctttagcctccagagtaaatgacagttgtgttttgtacaatggggcagctcaggtgattgaatgatgggagagcccttagctaggcatggtggtggcaggcgctggggcaggagaatcgcttgaacccgggcggcagaggttgtggtgagccgagatcacaccactgcatcccagcctgggcaaccgagtgagactccatcttgaaaaaaaaaaaaagagaaaatgacaggatagcccaggatggaaacaaagcaccacattttgtctcaggccacagcgacactttaggtctcagtctcactgacttttttttttttttttttttttgagatagagtctcgcttcttcccccaggctggagtgtaatggcatgatcttggctcactgctacctctgcctcctaggttcaagcagttctcctgcctcagcctccccagtagctgggattacaggcatgtgccaccatgcctggctaatttttgtatttttagtagagacagggtttcaccctattggccaggcgggtctcgaactcctgacctcaagtgatccacctgcctcagcctcccaaagggctgggattacaggcatgagccactgtgcccagcccagtctcactgacatttactatgaagctatgggtgaccagtgtctcagcatggacagggacaggtgggacagggagtggcctttcctacagcctcctgcagtgtgtcccatggctgctcactgccaccccttgctgcagagtgatgaggtgtctttggttttgttttgctttatgatacatttgtgttttcccaaccacagtgaaacattctcatttgtcttaactggagaagatgggagcagaaggttcggttactgccgaagactgctggtgagtacattctgctttcagcctgcaagagcctcgtggacttcctagtcctggtgcaagagccaggtctggcttcccagtcccgtgagactgagattccctgatgaggcacaggaggagaaggagcagggggagtggcaggtgaatcagcatagttaaaatcacagaaaaaatctggcatggtggctcatgcctataaacccagcactttgggagtatgagaaggacagatcacttgagaccaggagttcgagaccagcccgggcaacaaaatgaggccctgtctctattttaaaaatatatacggccgggcgcggtggctcacgcctgtaatcccagcactttgggaggccgagacgggcggatcacgaggtcaggagatcgagaccatcctggctaacatggtgaaaccccatctctactaaaaatacaaaaattagccgggcatggtggcacgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaatatatatatatatatatatatactaaaaaataaaacattaaaaaaacaggaattgagggggctcacctgagtcttattggtaggtgggaatgtccgtttccatcagaaagaaaatacttttatttcattttgagacagggtctcactctgctgcctgggctggagtgcagtggatcatgtttcactgcagcctcgacctccccagctcaggtgatcctcctgcctcagcctcccgagtagctgggaccacaggcatgtaccaccacacatggctaattttttaattatttgtagagacaggatcttgctgtgttgcccaggctggtctcgaactcttgggctcaagtaatcctcccacctcggcctcccagtgtgctgagattacaggcatgaaccaccgcaactggacaaaaatactttctccattatttttcctgccaaataaaagacctttctctctttaagcgaatttttttttttctaataaaacatgccaaacagaccctgatcacttagagagaacattcagaatggttgctaaggagagaagactcaaataattcaagaatgtccccttcagaatagtcacctttcaaagtcagaaacttatttcagtgcaatgatcctgctaaagcattttagaattgtcattttcaggcccattcttttgaaaatcttcagtaatggtgaatctttttccactgagaatatacttgagtctctgaaataggctgaaaaactttagggtcaagtataatgcgtggcacatagtaggtgttcaagaaacattttttgaattaatcagtaaaataaaaagcatggataattgaaaaaggtaagtgagataataattttgttgatcaaattactttagggttaaagtattgagactgaggtcgggcacaggctcacaccagtaatcctagcactttgggaggctgaggtgggcaggttgcctgagctcaggagttcaagaccagcctggccaacatggtgaaaccctatctctactaaaaatacaaaaaaatagctgggcgtggtggcacacgcctgtaatcccagctattcgggaggctgagtcacaagaatctcctgaacctgggaagtggagggtgcagtgagctgagatcgcgtcgctgcactccagtctggacaacagagcaagactccgtctccaaaaataaataaataaaaatttttaaaagtattgagattgggcagggtgcagtggctctcacctgtaatcccagcactttgggaggaggaggcaggcagatcatgaggtcaggagttcgagaccagcctggccaatatggcgaaaccccttctctactaaaagtacaaaaattagtggggcgtggtggtgtgagcctgtaatcccagctacttgggaggctgaggcaggagaatcgcttgaatctgggagctggaggttgcagtgagccaacatcacaccactgcactccagcctggtgacagagtgagactccatctcaaaacaaaacaaaacaaaacaaaaaaagtattgagattgatttttttttgtttgaaaattagcttaaaactgagttttcagaaagatcttcagaaatgatttctcacttgaaattatcattataataaacatatagggatacaaaacaattataacaaacattataataaacacaatgggataacaacttactttattgggttttccagagctatgatatgtggaaacatctggcacatgatagtctcgcaaaaaacatgtgggttcctttcttccctgaggttgtcaacactcataattcccttgtgtttctctccgaaaagcctggaggcaaagggaagcgccttcctgaagtttactgcattgtgagccgcctgggatgcttcagcctcttttcaagggtgagaacttggacctcagagaaagaggaagggaaggaacgggagggctctagagggctccagggaatacccccatgtcctgggccttctatcatcttattctctacctacttcccttcccatttcttcactcctctcctcatcacccctctattctctcaccattggttcaggaaatgagagttgataggcccggtgtggtggcggggtggctcatgcctgtaatcccagcagtttgggagtctgaggcgggcggatcacttgaggtcaggagttcgagacaagcctggccagcatggtgaaagcccatccctactaaaaatacaaaaaaaaaattagccaggcgtggtggcgggcgcctgtaaccccagctactcaggaagctgaggcaggagaatcacttgaacccgggaggcggaggttgcagtgagccgagatcgtgccattgcactccagcctgggtgacagagtgagactccgtctcaaaaaaaaaaaaaaaagagttaatgaagagccaggttcagaaagtgtgtgtggtgcagggatggcaagataattgaagttgagaaagggaggggtggaagaccctcccagaatattccaggtgttttatttttcttcttctgagaattgccttttgtcatatgagctttggcgtgaaaaaaggctactgtaatagatggataggtgtgtacccacgtacatatgtgtcatgtatatataacagttttgtggaggggggattaattattttaatagtgctctaagtttatcaaaatattcatataatttggtcttcttttctggaaaatgagccaacatatgaacgcataggaattgccgtattgaattagctcatctaccccggtattctggattggtatataggagagaattactatcctatatgatgctgatctcaaaagctaggtataatccaacatcatttcctgtattaaccagacatgagtgtctaattcataattttttttctttttttgagacagagtctcactctatcacccaggccggagtgtagtggtgcgatctcggctcactgcaacttacacctcccgggttcaagcgattcttgtgccacagcctcctgagtagctggcattacaggcgcgtgccaccacgcctggctaattttgtatttttagtagagatggggtttcaccatattgcccaggctggtctcaaactgacctcaagtgatccacccacctcggcctcccaaagtgctgggattataggcgtgagccaccgcgtctggcctaattcataaatttattttcaatccttcttgagtatatagctctgtctgagctttcttttggggaattgaagttcctgcacctacggtccatgaatgttaaagcagtactccctaaaagcattttttttttttgagacggagtctcgttctgtcgccaggctggagtgcaagggtgcgacctcggctcactgcaacctctgcctcctgggttcaagcaattctcctgcctcagcctcctgagtagctgggactacaggcacatgccaccacacccggctaatttttgtatttttagtagagacggggtttcaccatgttggccaggatggtcttgatctcctgacctcgtaatccgcccacctcggcctccctaagtgctgggattacaggcacaagccactgcatccggccccttgtggggaaaagaaagagagatcagactgttactgtgtctgtgtagaaagaagtagacataggagactccattttgttctgtactaagaaaaattcttctgccttgagatgctgttaatctataaccttacccccaacgccgtgctctctgaaacgtgctgtgtccactcagggttaaatggattaagggcggtgcaagatgtgctttgttaaacagatgcttgaaggcagcatgctcgttaagagtcatcaccaatccctaatctcaagtacccagggacacaaacactgcggaaggccgcagggacctctgcctaggaaagccaggtattgtccaagatttctcctcatgggatagtctgaaatatggcctcctgggaatggaaagacctgaccgtcccccagcccgacacccataaagggtctgtgctgaggagcattagtataagaggaaggaatgcctctttgcagttgagacaagaggaatgcatctgtctcctgccgtgcctgcgcaatggaatgtctcggtataaaacccgattgtacgttcgatctactgagatagggaaaaaccgccttagggctggaggtggaacatgcaatactgctttgtaaagcattgagatgtttatgtgtatgcatatctaaaagcacagcactttattctttaccttgtctatgatgcaaagacctttgttcacgtgtttgtctgctgaccctctccccactattgtcttgtgaccctgacacatccccctctcggagaaacgcccacgaatgatcaataaatactaagggaactcagaggctggcgggatcctccatatgctgaacgctggttccctgggtccccttatttctttctctatactttgtctctgtgtctttttcttttccaagtctctcattccacctaacgagaaacaccaacaggtgtggaggggcaacccaccccttcacccctaaaagcatttctataaaaaagccttcctcctgcccaccctccacctaaactcagaggaaacctgaattatacaaacatagtacaatctcttcccatggtagaacttgtacttctctgtaaatctgttagaaagaattaatgcctggtcaggaggctgaggccagtagatcacttgagcccaagagttcgaggctgtggtgagctgtgatcgtatcactgcactccagcctgggaaaactagcaagaccctgtctctaattaaaaaataaaacacaaaagaaggccaggcgcagtggctcacagctgtaatcctagtactttgggaggccaaggtgggaggatcgcttgagcccacgagttcaagagcagactaggcaacatggtgaaaccctgtctctacaaaaaatacaaaaaaattagccaggcatggtagtgtgcacctgtagttccagctacctgggaggctgagcggtgggaggattgcttgagcctaggaggctgaggctgcagcgagtcatgttcacaccagtgcactccagccttggcaatatagtgagaccctgtaaagaaagaaaagaaaaagaaagaagaaggaagggaaaggagagggagagggagggaggaagggagagagagagggaaaggaaggaagggaaaatgaaagaagggaaaaagagagaaaaagaaagaaagaaaatgaatgctatcagtgtaatctgagccaaggtctcccctcccctccaccagaagtgctcatcactttatgttggggttggccattggcaaggtctagcagactaggcattactgctcaggccaggctttcatgtgatttgtttacatgtgaagtaaggttataggtcatagcctttgttgttgtcagaatgcttatgaacaccagaagtaaaacagctcatgtgagttaggccagcttccaagtggaggctttgaagttcacgtaagcttcactgctgtcatgggcaggggacgtggagccagtaaatgtgctaacatatttctgtgatgcacagtcctttgttttcatgtctgttttctgaccagggatattttaggagtgcagtgtaatgacttgccgaagaccacacagcagttattcaggacagaaccagaaccagagctttagctaactgatcccaggaacttgagctatttctaggcgtggagcaaggatggccaaaatgcatattgtcctttagaacagaaaggagtcatggagaagaagagcaggtctcagaatttctgaagaaaagggtatcagttaacaattgctatagtaatactgtctagtgaaccacagaggcttcaagattcaatcatttgttctcccagctgtgaggtcagctggggtttgggcttggcaagtattgtgaagaggctgggttggctgattgaggctggtctagctgctctagaggctacaagtctgggcgcaggcctggtccacatgtctcccatgctcctagacagtgagatggcccacatgtgctcttctcgtggcaatggcagaggcacaaaagggcacacaaaacacgaaggcaggcctcctaaggcctggccagagaacccgcatggcaacgcttctgcctcgttctgcccagtgtcccaaaggctttttttcttttcctttttcctttctttttttttttttttttttttttgagatggagtcttgctctgtcgcccaggctggagggcagtggcgtgatcttggctcactgcaacctccacctcccaggttcaagtgattctccttcccagcctcccgagtagctgagattacaggagcccgccaccacacccagctaatttttgtatttttagtagagacgggatttcaccatgttggccaggctggtctcgaactcttgacctcaggtgatctgcttgcctcggcatcccaaagtgctgggattacaggcatgagccactgtgcccggccacaagcttttttttcattactgtccccctaagcagccttttcaggtgtgttttccctaactgtctcccccaaaattctttttatttttgttcatattattgtctttttcttgtgctaaaatatatacataacaaaaaatttaccatcttaaccattttaacagttcggtgccattacactcacattgttgtgcaaccatcaccaccatctatctccagagctttttcatctcccccaacagaaactctgtacccattgaggccaggcgcggtggctcacgcctgtaatcccagcactttgggaggccgaggtgtggatcacctaaggtcattagttcaagaccagcctgaccaacatggtgaaacccgatctctactaaaattacgaaaattagctaaagctggatgaagtggctcacacctgtaatcccagcactttgggagactaagaggggcagatcacctgatgtcaggagttcaagaccagcctggcaaacatggtgaaaccccatttctactaaaaatacaaaaattagccaggggctgaggcaggagaatcgcttgaacctggcaagcagaggttgcagtgagcccagatcgcaccactgcactccagcctgggcaacaacagcgaaactcaggctcaaaaaaagaaaaaaattaagtgagtgtggtggtgggcgtccgtaatcccagctactcgggaggctgaggcaggagaatcgtttgaacctgagaggcagacgttgcagtgagccaaaatcatgccattgcactccagcctgggcaacaagagcgaaactctgtctcaaaagaaaaaagaaactctgtacccattaaacaatagcttcccattccccctcccctaaccccacccctaaccccacccctatcccctcccctaacccctcaccatcgccattctactttctatttttatgaattccaggattctaggaatgttacagaggtagaacgatcaacagttgtccttttgtgactggcttcgattcacttagcataatattttcagggttcactcatgtcgtagcatgtatctgtacttcattccttttgtggctgaataatattccactgtatgtatgtacaacattttatttatccatttatccattgattgattatttatccatttatccattgatggacatttgggttgtttccacgttgtggccattgtgaattattctgctaggaacataggtgtccaaataaatatctattcaagtccctgcttcaattcttttgggtatacacccacaaatagagttgctggatcatatggtcattctatttagttttttgaggaactgccatactgtctttttaattttaataataaattttatttaacacaatatgtacaaaatattattttatttcagcatatagttaacatgaaaaaaatcattgatatattttatgttattaattgtctatttcgagggccgggcatggcggcttacacctgtaatcctagcactttgggaggccgaggtggttggatcgcctgaggtcaggagttccagcctggccaacatggcaaaattccgtctctactaaaaatacaagaattagctgggtgtggtggcacatgcctgtaatcccagctacttgggaggctgaggcatgagaattgcttgctaggaggcagaggttgcagtgagccaagattgcgccattgcactccagcctgggcgacagagcaagactcattctggaaaaaaaaaatgtgtattttgaaattccattggtattttacactttttttttttagatggttttgctcttgtcacccaggctggagtgcaatggcgcgatctcagcccaccacaacctctgcctactggattcaagcaattcttctgcttcagcctcccatgtatctgggaatatatctgggaatatagcctgccaccacgcctggctaattttgtagttttagtagagatggggtttcaccgtgttggcaggctggtctcaaactcctgacctcaagtgatccgccagccttggcctcccaaaatgttgggattacaggtgggagccaccatgcccggctggtattttacatttaacaatacatctgggccagcacagtggctcatgcctgtaatcccaacactgggaagccgaggtgggtggatcacctgaggtcgggagttcgagaccagcctaaccaacatggagaaaccccgtctctactaaaactacaaaattagccaggcgtggtggtgcatgcctgtaatcccagctactcgggaggctgaggcaggagaattgcttgaacccaggaggcagaggttgcagtgagccgagatcatgccactgcaccccagcctgggcaacaagagcgaaactctgtctcaaaaaaaaataaaaaataaagtaaaaaaacctctgaattcagactagccatatttcaagggctcaatagctacatgtgatacttttataaatggcagtttttaaaaatagagactgggtctcactatgttgcccaggctggagtgtggtggcatgatcatagctcattgcagcctcaaattcctgggctcaagcaattctcctgcctcagccttccaagtagctgggattacaggtgtgtgccatctcacccagcttcataaacggcattttaatttagactcttcaatttacaattagattgtggagagtttggaatttttttttttttttttagttttttagtagtagctttattaagatataattcacataccatgcaattcattcatttaaagtacacaatttgctgagcacagtggcaagcgcctgtagtctcagctactcaggaggctgacataggaggacacttgagcccagaagttgaaggcaagcctgggcgacctagcaagactcccatctctaaaataataaaaaataaaaaatatatacagttcagtggctttcagcatattcacagagttatacaaccatcaccacaattttagagcattttcatcaccccaacaaaacaccctatacctattagccgccactccctaactctaagcaacctccaatccactttctgtctctctggatttttctattctggacatttcatctaagtggaatcatacattagatggccttttatgactagcttctttcatttagcataatgttttcaagagtcatccaagttatagcatgtatcagcactttgatggccaaataatattccattatatggatatagtgcattttgtttatcacttcatcagttaatggacatttaagtttcttctgtgttgtggctattatgaataatgccgctacagacaatcatgtacaaatttttatgtgaacatatatgttttcacttcttttgggtaggtacctaggagtgctatgtgctgggtcatatggtaactctatgtttaaccttttgaggaactaccagactgttctccagagtagcttcactattttacattcctaccagcagtgtatgagatttctaatttctccatgtccttgtcaacacttgttcttatccatctttttattagagtcatcctaacgggtgtgaagtggtatctcatggtgcttttgatttgtattttcatgatggctatcccctcccatgacattttcatttcataaataaactgtatatctgtttatgtactgtgacctcttagagggctacaaaccactgtaatatctaagttttttcattcctcccaaaaaccagttcttacccccttggggttatattaccttcattgagaatgcatgtattagtacaacctgtcacatggccaaaccctaggtcaaaggggcaaggaagtggacttcactcctgagtaggagctgcaacattgcatggcaaagggtgtggacacacagaggagagaagaattggggacaatcatgtgtagggtcaaagggcctgttttggcctcatggggaaagcagggcttccccataattcttgagtcaccatggcaggcccacttcacctagaactgagctccaccttggtgctttggcttcggaatagctaagctgcttttctgacccttgcagatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgagttgtcagactccttccttctccctggggaggcagtggcccagacagccgagtctccgtgctcagaggggctgcctttcagtgagcagtccaattccttggtgtcttctccccacccctagagctggcccagatcactcatcatgagttccaccctcaatccatccagcctaggactctgcccaatgcggcaagcccaagaactatgctatggcagctggggtgttcctttgcatgatgttggcctcaggttagggatctgcactgaacatccttaatttcttttaatagcccgttttctttcatacattttattgaaacctatttacatttcaagtctgtatcacctctataactttattttttgtttttgtttttgagacaaagtcttgcactgtcgcccaggctggagtgcagtggtgtgatctcggctcactgcaacctctgcctcccaggttcaagctattctgttgcctcagcctcccaagtagctgagactacaggtgcctgctgccacacccggctaatttttgtatttttagtacagacggagtttcaccatgttggccaggatggtctcaaactcctgacctcattatccacccgcctcagcctcccaaagtgctaggattacaggcgtgagccaccgcgcccagcctgggctgggattttatgaaggagtttgttttcatccctcccaccccctttgcatggcttggtggacatcagaagaaggaccccatttagccttgagtcttcagtttcagagaccctcagcaaaccagatcacctctggaaacaaaggagggaggagaataggcctggaacactctggaacaacctagtttcccagcagagagaacagcaatctctgtgttgctagagaacctgaaaccatcccataccagatgcagtggcttggccatggggatgtagcagggaggttactggagaggaagcctcaccgttggggcagcaccaggcggtgcaacactaagagtgaaatccactctctgctcaccgggagggaggcagctatttaaagagaaaaaaacatgcacatgggtaccaacttgagggaattcaggaacatttcaacaagtgcagaataagaagatatacacacaggctgggtacacggtggctcacacctgtaatcccagcatgcctgtaatccctccctttgggaggccgaggcaggtggatcacttggagtcaggagttcgagaccagcctggccaacatggtggaaccctgtctctactaaaaatacaaaaattagccaggcatggtggcgggcacctgtaatctcagctacttgggaagctgaggcaggagaatcgctcaaacctgggaggcggaggctgcaataagccaagactgcaccactgcactccagcctgggcaacagagtaagactccatctcaaaaaaagaagatatagacacaaagcacaaaagctgaaagcacatatcatcagaaatggagtgggatggtgtcagggttacctaaaaaacaccttcttgaggtggcagcgagtctccgaagtgctgctcaggcctgctgggcgttccatgctagtctgggatttccacctagcaggtaacagttcctcaagagacagagatgctctccactgggactctcagggacagaaccgttttcaaaagtcctataaactctccatggggagtacagatatgctgttgccagagagagccccgcaaccatgtggggccggaaaccattgattttgccatcctctgtcatcccgttcgtccacactgtcctcagtctcatagctgagtgtgagacgcttgcttccctaccaaagctacctcctccgccccccgtcttctggcatctttcttttcccccaatccttttgttttgctttttttctttcccttttcccccaccagtgggtcacccctgatgaggacctcagagccctgggactgcgacacccgtgagaggcctggctgcgtagctgggcccctccttcatggctgctcctgttccctggcaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcaggtacccgccttggctacttctgctaaagcgtttgaatgacagtcgctcttggaccctctagtctgtagagcaggtgaccgcctagcattgaagagtaagcccttctgagataaggatggaataggctgggcgcggtgactcacacctgtaatctcagcactttgagaggctgaggtgggtggatcacttgagaccaggagttcgaggccagcctgtgcaacatggtgaaactccgtctctactaaaaatagaaaaattagccagccatggtggcccacgcttgttatcccagctacttgggaggctgaggcacgggaatcgattgaacctgggaggtggacattgcagtgagctgagatctcaccactgcactccagcttgggcaacagagggagaccttccctcctgcccccacaaataaaggatggccaggcacggtggctcatgcctgtaatcctagcacttcgggaggccgaggcaggcggatcacctgaggtcaggagttcaagaccagcctggccaacatgatgaaactcagtctctactaaagatacaaaaatcagccagtcatggtggctcgtgcttgtaacaccagctacttgagaggctgaggtacaagaatcgcttgaacccaggaggcagaggctgcagtgagctgagatcgcaccattgcactccagcctgagcaacagaatgacattccatctcaaaaataaaaataaaataggccaggcgcagtggctcacacttgtaatcccagcactttgggaggccgaggcgggtggatcacaaggtcaagagattgagaccatcctggccaacatggtgaaactccgtctctgctaaaaatacaaaaattagctgggcatggtggcgtgtgcctgtagtcccagctactcaagaggctgaggcaggagaattgcttgaacccaggaggcagaggttgcagtgagccgagatcatgccactgcactccagcctggtgacagagcgagactccatctcaaaaaataaaaaataaaataaaataaaggatggaatcagtcggcagctcagactggagatctggggggcacactgttttgcactgctgtgtgcgacttccctggcattggtgggctttccactcattctgccatgtgtcatacactctgctatgtggtaggaaaacagagaaaagacacagctggcatggtggctcacgcctgtaatcaccgcactttaggaggctgacgtggaaggactgcttgagggaagtagtttgagaccagcctgggcaacacagtaagacccccatctctacaaaaaacgtaaaaaaaaaaaaaaaaaaaattagccaggtatggtggctcgagcctacagtccctgctactagggaagctgaggtaggaagatcacttgagcccagaagttcaaggttgcagtgagctatgatcatgccactgcactccacctgggcaacagaacaagaccttgtctcaaaaaaaaaaaaaaaagaaaagaaaagaaaaacacagacttgtctcagtgcagtggggtaacagagacataagccgactctccaggaccacattagaggcaggtagaggcagtgagttctggagaccgagggagggcactcactcccagggaggcgagttctgagggccaacactcagaacaagtagtcagcacattgcaggcaaaaggagccatcctacatagatatggggacaggtgaggcctagctgtcaccttcaggactgtaaagtaggccaggcgcggtggctcatgactgtaatcccagcactttgggaggccgaggcaggtggatcacttgaggtcagaaggtcaagaccagcctgaacaacatggtgaaaccccgtctctactaaaaatacaaaagaatttagttgggcgtggtggtccacgcctgtaatcccagctacctgggaggcttgaagaagaatcgtttgaacccgggaggcggaggttacagtgagctgagattgcgccattgcactccagcctgggcaacaagagtgaaactcaaaaaaaaaaaaaaaaaaaaaagagagagaaaaagaactgcaaagtagttcactagggctggcccagagagaggaagatgggggagggagagatgagccggcagtggtggacagaggccagctcacagaaggctgcagggccatgctcaagaggacagaccatcgtgagggcatccctcctcaccgttaaagcaaatcccctcccatcacacacacaaactcagtgccccataggaggccacccccgtcccagtgggcacattcaataatttgctaaggccacgtcacaaaacaaagaagatccggaaggaaatgcagacaaggacttgggttcgttctgagcttctaaaaagaagctcatttttgaaatactgaatcagagccttctttgctttggaactgggggcacagaagcgtgaggggtgtggctgcagccccaggaagggctgagatgcggggccagccaaccgggtggtgcagatgaggccacctgagaagtccatctggaaagaagcagtgccaaaaacaaaaaaaaacctgaagcactgtggtttggagaggaaatctgactctgaactatggaaaacaaaagggaaggaaaaaaaaaggcatagaagaatggaagggacaaactccgtagatgtggaattcctcaggaggcggggcgggaagcggccccaccctctcccctcatgcgccgcatctggtcacctttctgatgcacctctttggacagcagccatctggctgttcccagcctgctcccaccctgtgttttagttcgctatgcacttttaaatgtcagcgtgatcgtactcccggtgcacttttgtcagctcaggaagcaggccctctctgtaagccttgcagctggtgctgggcgctgaggagctctccaagctcccgggcactggggaattcagcccagggagttctcaaggttggagccctggaagccaggatgagtaataacccttcagtggccaggatcggatttcatcagcaccatagtaactgtctttatcttctccatcccccactccctccatccgctagaggtggaattctcaggcttggatgtgggggaggggaaaatgatggatttcagaaaggcctgggctagaagtggaaagccagccaaggaaacccagcaccccccaggagtggtggtggggacagagtcccccgggaacgtgcctgcggggtgaagatgctagacttggggaggacccaccctgagaagatgtctgggaagggcacagctggagaggagccgtgggccccctcacacaccccagcctcccccagactccctccagggggaagaaaacaaagtatcatccatttttctggtaaaagtacagtgagacaccagtctcactggtgacagagagagactctgtctctaaaaattaaggagaagaaaaaaaacttaaaaacattaagtgcagggagagaaaaggtgggaacagaaaagggaaggggccttgtcagagacaaacacatctccaaagggcaatgcaggaggacatgtcagaaggctcagggcacaaagaaacctggaaatgccagccaggctcagtggctcacgcctgtaatcccagcactttgggaggccgaggcgagtggatcacctgagatcaggagttcaagactagcctggccaacatggtgaaatcccgtctctactaaaaatacaaaaattagctggtcgtggtggcgtgcacctgtaatcccagctactcgggaggctgaggcagaagaatcatttgaacctgggaggcagaggttgtggagagccgagatcatgccatcgcactcctgcctgggcgacagagcgagaccctgtctaaaaaaaaaaaagaaagaaagaaacctggaaatgcctgccccagtgacgtctgagagaggacttgacgcctccgcctttttgctggacagatttccgggtggacaggttggacgctgggccagcccctcccacagagctgctgtcaccagagacagacaaaaatgagcaaagtccagtggccgagagtggaccctgcctggattcctgggccttggctgttccccagccaccctccctgccctgctctgggacccctcaacagaggagacagtcaccagtgcagtccataggaaaggcactggtgtttctctccaaccttccatagtgcctggcattctgcccttggaggtttcgtcttttcaaacggctcatgccgtgagtgggtcagatgccagctgtggctgccacaagcaggtctccccacgggcacgttgtgcccatcaggggttttcttctgcagcagctgccaaatgtcaggcgctgtgaggatgggatttctgtgggagaagagaaggcagcaggaacgtggataattgtggtgccctccttggagcgagagccaggccatggtacagtaatggtgtgcgagtgtgagaaagaccgtcattgggtttttagaccctttacagctttcagaggtacacatccctccgccatcactcagggaggtttcccagagtaggggggacccctgagcatccttagccgttggccctgggtctcctcgttcataagacgcggccccgcatggctctgactttccgggactccgctgtcttgttttctctgaaagcagccctcgcttttcctgttacaaatggctccacatgctctccccgctgcccaataaatcgtccttccatcctacacgggttccatgcagacctgaagagatggaaatctgcgtaaagaaaggcccgaagagctctgagacaggaagagggtaaacaacgcgtgagcaaagctgatgaggatgacggcagcgacggggcgtggagtggcctctgagcggcctctgtgccgggcgccttctgagggtctgacctgcgtcatttcatgccccctacggccctgtcacatgggtaactaacaggcgtgcagaggatccgtcattctgctcaaagaagcagggagtgggagagctgccgggctttggagaggacggagggaaagcagctgggctgcagactccagggttgggtgaagggcagggtctggggccctgtccgtttacagaaatgtataaggaaagtctccctagcacaggccctcaggacccgctttgtgctcagcagtcaggctaacaggtcatggggaagtctgtgcttttctcctcagggccctccccgcctcccttacagcctttggccttccagcagggtcccagtgagacaggtatgatcaggtcacccccaaggcctcccccagctttgaaactctctgactccatgggccaggtggaagaatccgtatccacctcgatctgtctgatttatgggaaagtagccatagggaattgaagtgttctttggccaggccatgacaaacaagggtttggggaccaatggttggctgcaagttgcctgacctggaaaattctggaaagtctttaggccaagcgcagttgctcacgcctgtcatcccagtattttgggaggctgaggccggtggattgcttgaggccaggagttcgagaccagcctggccaacatggtgaaaccctgtctctaccaaaaagacaaaaattagctgggcgtggtggcacacgcctataatcccagctactcaggaggctgaggcaggagaatcacttgaacctaggaggcagaggttacagtaagctgagattgagccactgcactccaacctgggcaacagagcgagactctgtctcaaaaaaaataaagaaagaaaaaattttttaaaaaagggccaggtgcaattgctcatccctgtaatcccagcactttgggaggccaaggcaggtggatcgcctgaggttgggagttcaagaccagcctggccaacatggtgaaaccccgtctccattaaaaatacaaaaattagcgggcatggtggcgggcgcctgtaatcccagctacttaggaggctgaggcaggagaatcacttaaacctgggaggtggaggttgcagtgagctgagatcacaccgctacactccagcctgggcaacagagtgagactctatctcaattaaaaaaattaaaaaaagaaaaaagaaagtcttcaggttaaattacagctggtaccctcatccccagtactcctggggctgcacatgcactcatgcccaaccctgctccgctcacgtggcagaaagcctccttattctcctgatttccagctgtagcccctaacttaatgagggcatggaacagggcatgagaacaggacatgtcacagactcagtgcgtggcccggtgacatcccagagaggaccttcgcccactctaggtcggtagccacccccgcagcactctcccccacaaacacaatttattctctcatcatcgctgtgagtctcccactgcaagaggaagcttcagggagttatggcaaagattgtatgagttataaaagggttttaagttgagccaaaaatctatcaagtttagaataacatttttgctctgttttatctttaggctggacattgagtgttctagtggctctgtcaagcaagagtttgacagatggaaaggaaagaatgctgttgtgatggcttgttctgtggtcatgacaacagataaatacttctctacaccctcgccttcattttcctgatgatgaacattttgttttttactttactaatttcagttccccaaagttttggctaaacctacagaccaggctgaatgataaagtcagagctgcacgtaaacaaatatgtgcaaaaagttttagagggaggtcgggcatggtggctcacgcccataatcttagcactttaggaggccaaagcaggaggattgcttgagcccaggagtttgagaccagcttgggcaacatagcaagaccccatctcttaaaacaaacaaacaaacaaacaaacaaatgaaaaacaccttaataggggacaaagtttttaatattcaaggaatttatgagctgggcatgctggcacatgcctgtagttccagctactcaggaggctgaggtggaaggatcacgtgagcccaggagtttgaggctagtgagctatgactgcaccactgctctccagctggggtggaccttgtctttaaaaagcaaattaaaaaataaaacaaataagaaattgacttatatgtttgtagtgcgttaaaccataagctaaatgatagactactggctagtgataagtaggattaggtgggcaaatcttgacacatacaggagtttgaaccttgtctttgacatataggtaactacacaaataagttcatatgtagctgtgcactttcatcctcttatttgttcggtttggttcatttttaataagtttacacaagcttaaatgagaatcccatgtcctttttagaattggttgcacccagcaacatttgccatcccaggaggttgggcttctcaccacacctctctagggagatgagtttgcccaaggcctagccgaaagtgtttaaagctgccaccttgctgctctggcatccataagatacttcagaggtctagctagtcctcagcatggttgacagagtcttagagataagtacatttagttcagcaaagtcctatgaaaaacacaattttaggcaggtgcagtggctcacgcctgtaaccccagcactttgggaggctgagacagattgatcacctgaggtcaggaattcgagaccagcctggccaacatggtgaaaccccgtctgtactaaaaatacaaaaattagctgggcatgatggcaggcgcctgtaatcccagctactcagaaggctgaggcaggagaatcacttgaacccaggagggaggctgcagtaagccaagatggcacgactatactgcagcttgggcaacagagcaagactccatttcaaaaaaaaaatacaattttaatagtataattgtacagcctgattaaatgttaagtattaaccacctatttttgcatatgaacaccaacaagataccaattagagcaagatttagagtttggcatagccacaaatgctgttgtcttctaatccagacccatcactgacatatcctggggctggaagcttattccagttcttctcttggagtcgaatccctcccagactacactggctttgaaacactgtcatcttcaccttttggatgcactgcagccactggaaacctctcagacacgtttctctgagattctttttttttttttcctgagatggaggcttgctctgttgcccaggctggagtgcagtggcatgatctcggctcactgcaacctccacctcccagtttcaagtgattctcctgcctcagcctcccaagcagctgggactataggcatgtgccaccacggctggctaatttttctgcatttttagtagagacggggtttcactatgttggccaggctggtctcaaactcctgacctcaagtgatctgctcgcctcagcctcccacaatgttgggattataggcgtgaaccaccatgcccggccttctctatgaatttcttagtgagtgtcaccatcattcttttgttctgtcttggctaaggagcgctagaattaccttcctgtgacacccttcgttcttttgatggcctcaacaaaagctcctgtttccagctcctggcctttgctctctcttctgggttcatcgtttgtagatgttaaagttggaaggacggccaggtgcagtggctcaagcctgtaatcccagcactttgggaggccgaggcaggtggatcatctgaagtcaggagtttgagaccagcctgaccaacatggtgaaaccacatctgtactaaaaatacaaaaattagctgggcatggtggcacatgcctgtaatcccagctcctcaggaggctgagataggagaatcgcttgaacctgtgaggcagaggttgccgtgagctgagacgacgccattgcactccagcctgggcaacaagagcgaaactccatctcaaaaagtaaaaaattaaaaaaaaaaaaaagaagctggaaggacatcagcaacgatctagcgatgatctagtctactttagttatttcacaggtgagaatctgaggcctggagcagttcagggctttacctgagatcacgcagagagtaacagaactagttgtcttgaagcccagcctgtgttcgttttcaactgtgtggcacacggcctcagggtttgcaagtacagtgatggaaaccaggagccactgcatggtgactcccacctcctagtaggtttcaccaggcaccagaccacacgtgaatttacctttcactcatgttttcgggagtggagcaccaataggagagctactttgcttgggatactaaagggcattcactgaatcagccttccagttcctggggtgttcctctaattcgggaaactcttcatttacttttctggtagcatcttagaggaagctctgtgctggatccttactgcttcatagagagttggaagccagctgagcataggaacaccaagtatggagcagaggcttggtagcaaccagaactaaaaagttggctccaggaaaactttggcattccttacaagtgcgtcctgatgttctggaatactgctccaacactcaggaaccaccacccaacagcaaaacatccttggacccaacccttctcacccatgcccaacttttaaccctgaggcccagccaacctcccactggggccttctcttccctgccccacttttgtacaattgatcacagctgtgagtgctggcgtttctttcctccacaccactgtaatgcaagccagctgcgagtgaggactctctttctatgtcttccttcaaaaacactgcctcttctctagcccctccacctccacactctgcagcaagccctcttgaccagtcatccctagcatccccagaaccactgactattggcatgttcctaagggaccaccagtcccaggagtgcccacctcccatccccctccttgagggctcctcgggccttcacaagtcagggaataaaattttattaccacttgcatcagggattgagagaaacaagctccatccaaaataatcctttcctgctctatcatttattttgaggaaagggctgccactcatggaattattcacaaaatttgacctttccttttagtgtttaggggcagaattgtttttagaacattgatgtgggctgggcgtggtggctcatgcctgtaatcccagcactttgggaggccaaggtgggcagatcatgaggtcaagagttagagataagccaggccaacatggtgaaaccccgtctctactaagaatacaaaaattagctgggcgtggtggcacgtgcctgtaatcccagcaactcgggaggctgaggcaggagaatcacttgaaccctggaggcagaggttgcagtgagccaagatcgcaccattgcactccagcctgggtgccagagcaagactccatctcaaaaaaaaaaaaaaaaaaaaattaaccaggcattggtggcacgtgcctgtgatcccagctacttgggagactgaggcaggagaatcgcttgaacccaggaggtggaggttgcaatgagccaagatcgtgccactgcactccagtctgggcgacagagtgagactccatctaaaaaaagaaaaaacgttgacgagggctacagagcaagaggaataagacccttcacctgcctgcttgttgccgtattgtctccagcaccctgtgctccatgggctccagctaacgaggtattcatgataaccaggtacagaaacgtttgttgcagccacaacagtgggatcagactactcaaaacaaacttaccacaggagatagtcaacaaacgggcagctcctcccacgcggccagctggttccccagccgagtcgtcatcatttctcgcatcaagcctgaacactgctgtcctggagccccatgcatccagttcactgagtgaactttggcttcctttctgtcacgtttctccaccagcctctgcatctagcaccggcattgctggtcatctttcctgaccttgctcccacgaccttctcctccagatggttcacactcactgcagctgaaccagggcctccgggtgtcccaggccctgggggcctctctgtcactgaaggcaacatagggctttaggagtcacaaagggctgtacagcaaggagccccaaggggctgtacagcaaggagaagggagcagccccttgtacttcctccttctaggaatgagaccacaaggaagtaaaaatggaggtagccagccaggtgcagtggctcacgcctgtaatcccagcactttgggaggctgaatcgggtggatcatgaggtcaagaaatcgagaccatcctggccaacatggtgaaatcccgtctctaccaaaaatacaaaaaattagccaggcatggtggtgcacacctgtagtcccagctgcttgggaggctgaggcagaagaattgcttgaacctgggaggcagaggttgcaatgggcagagatcgtgccaccgcactccagcctggcaacagagtgagacactgtctcaaaaaaaaaaaaaaaaaaagcaggtagccttttctttgagttgggaaaaaaagttaaacatgtttttgttttgtttttctattgcaatgattgggaaaaaaaacacacataggctatcctcctttttatatacatttaattttttgttttagagatgaggatctaactatgttgcccaggctggacttgaactccagagatcaagagatcctcccacctcagcctctgggattcagtagctgggactacaggcacatgccactgtgcctggatcgtagggtgcctcctcatgcctgcattcctctgagcagcaatcctgccttctccagtctgcaggacccttctctccctactctgccccatcctacattcagagttactttagcctcatttagcctcactcttcctaccttaaaaatccaaaagaaactgaactcaatccccaagaactcttccaggtctaaattctgtcattctgtaactgtgaagtcaaaagtgcttgaaccacaagtctgacgcgtagaaggaatcttaaacacaaatactgcattttttcttctcctttaacggactaaagtcagagtttcaaagactagggaaatggaccatggatcttctcatgaaccacttcgtttccaagtcacatttaggcactttggcaaacgtgctataaaaagagactggtttcatgcaaaataccttcatgcagggatttccttcttaaggtctcttttatttttttgagacggagtctcactctgttgcccagactggagtgcagcagcgtgatcttgactcacaacaacttctgcctctcggattcaagcgattctcctgcctcagcctccctcccgagtagctgggactacaggcacccgccaccacatctggctaatttttttgtattttcagtagagacagggtttcaccatgttggccaggctgatctcgaactcctgacctcaggtgatctacctgcctcagcttcccaaagtgctgggattgcaggagtgagccaccgtgcccagcacccactcccagtcttctagtccaaatcactggcttcaagcccttttcattgcagcccacaatgagaagcacatcttacaatcagacccagggtatgccttcccacccgcccccaccacacacacagatagttgttttgttgttgttgttgttgttgttttcctttgagacagagtttcgcgtttgttgcccagcctggggtgcaatggcgtattctcggctcactgcaacctccgtctcctgggttcaagcgattctcctgcctcagcctcctgagtagctgggattacaggcacacgccaccatgcccgactcgttttttgtttttgtattttttgtatttttagtagagacggggtttctccatgttggtcagtatagccttgaactcctgacctcaggtgatccacccgcctcagcctcccaaagtgctaggattacaggcacgagccaccgcacccggctcacacacagatagttatttacagctgggaaacgtgcagcacactctcttattttctattctgttctttttgttcttgtttttaatgctgatcgcaaccctctaaaatgatttcaagacccactaatgggctgcaaactatagtctgaaaaatcttgctctagaaacaactatcctcacttgtatgtgaatgttctgattttctaagtcctgactttacaaccatagcacacgagcatagcaactttgtagcctggctccacgcatcaacatagattagtcctaaaataaaaaaataaacaatttagaacaaagtgaattcagtacattcagtggtttatagatcaaggaactaaaacataaatggtgaggaattaactaaagcattaacattcttgaatatttgagaggaagtgatgccttagggaaaggtatctctgctttgacagaagatgtagatctagatccttcgaaagtcatagaagtcggccggatgtggtggctcacgcctgtaatcccagcactttgggaggccaaggtgaacagatcacctgaggtcaggagttcgagaccagcctgaccaacgtggtgaaaccctgtgtctaccaaaaatacaaaaattagccaggcatggtggcgcatgcctgttaatctcagctacactggaggctgaggcaggagaatcacttgaacacgggaggtggaggttgcagtgagctgagatcatgccactgtactccagcctgggagacagagtgaaattctgtctcaaaaaaaaaaagaaagacacagaagtcacttcaccctaagctctggctggattctggatagtattctccttaatataagtcctaacttcattattctctcactcttttttttttcttggtatcttccaaatgcaatgtgttactcttacccagctaataaagaagacagtgtagggataagaatgaaatcttggggtagcgtttttctcatcttgggggtgatcatttgaaagaaaagataaggaccgaatatcagtgcgatgcatggatgccatgctgctatttcctgactccagtgagtatcaggagaacgattatttgcaaagacagagaacaggaaggttaagagacagtgggataaatgaacaagattcaatagtaccattattagtccaggggcccccaaattggggaatggaaaagaaggctatgtgtacatatattttttaattttaattatttttaattgtcatataaagatggcatatatttatcatgtacaacaatgatgattttgttgttgttgagacagggtctccctctgtcatccatgctggagtgcagtgacacgatcacggctcactgcagcctcaaccttccaggttcaagtaatcttcacacttcagcttcctgagtagctgggaccacaggcacatgtcaccaccaaaggctattttttttttttttttgagaaacagggccccaccatgttgcccaggttggtctcaatctcttgggctcaactggaacataatattttaatacacacatatatcttgttgttgttgttgttttgttttgttttattatacttttaagttttagggtacatgtgcacagcgtgcaggtctgttacatacgtatacatgtgccatgttggtgtgctgcacccattaactcgtcatttacattgggtatatctcctaatgctatccctcccccgtccccctaccccacaacaggccccggtgtgtgatgttccccttcctgtgtccaagtgttctccttgttcaattcccacctatgagtgagaacatgtggtgtttggttttttgttcttgcgatagtttgctgagaatgatggtttccagcttcatccatgtccctacaaaggatgaactcatccttttttatggctgcatagtattccatggtgtatatgtgccacattttcttaatccagtctatcattgatggacatttgggctggttccaagtctttgttattgtgaatagtggtgcaataaacatacgtgggcacaggcctttatagcagcatgatttacaatcctttgggtatatacccagtaatgggatggctgggtcaaatggtatttctagttctagatccttgaggaatcgccacactgtcttccacaatggttgaactagtttacagtcctaccaacagtgtaaaagtgttcctatttctccacatcctctcctatttttagtagagatggggtttcaacatgttggccagactggtctcgaactgctgacctcaggtgatccactcacctcggcctcccaaaatgctatgattataggcgtcagccaccgcacccagcctgaccatttttcttgaagagaaactcccaatatttctcccagtgttttttttggtgttttgtttctgtttttgaggcagtgcctcactctgtcacccaggctggagtgcaatggcgcaatctcggctcactgcaacctccgcctcccaggttcaagcagttctcccacctcaacctcctaagtagctgggattacaggcgtgcatcaccatgcccagctaatttttgtattttttgatagagatgaggtatcaccatgttggccagcctggtcttgaacttctgaccacctcagcctcccaaagtgctgggattacaggcatcagtcactgtgcctggcctctcccaatgttattatttttaaaaatttcaatgcataaaatggttaaccctcagtcatctcttttttttttttttgagatggagtttcattcttgttgcccaggctggagtgcaatggtgtaatctcagttcactgcaaccttcacctcctgggttcaaccgattctcctgcctcagcctcctgagtagctgggcgtacaccatgcctggctaattttttgtatttttagtggagacggaatttcaccatgttagccaggctggtctcgaactcctgacctcaggtgatccactcacctcggcctcccaaagtgctgggattacaggcgtgagccaccgtgcccggcagccctcagtcatctctagcatatcatctttgaccagaattctgggtaaggctcaactgtatatgagcttcacttggaacccatttggagctgactgctggcatgtgagtaccaaaggagttttctgtccttttcccggatttcctaggtgttcatgctcagctgaaagaatgcttggaacagaacaaagcaaaagctacagtgtttcaatagaaagcatcttcagatcttcagtaagagaaggagcattcatgagaaaataggctttcaccgtttgtgtttttgttttgtttgtgtagggggcagggagtaagggtggaaatgaatataaattaaaaccttacaagagtccaggcatggtggctcacgcctgtaatcccagcactttgaggggctgaggtgggcggatcacttgaagtcaggagttcaagaccagcctgaccaacatggtgaaaccccatcgctactaaaaatgcaaaaattagccaggtgtggtggcgcgtgcctgcagtcccagctactcaggaggccgaggtgggagaattgcttgaacctgaacctgggaggcagaggttgcagtaagcccaaatcacgccactgcaccccagcctgggcaacagagtgagactccgtctcaaaaaaattaaaaatataaataaataaataaataataaataaaaaccttacaagagtatagatcacaaaaaaaggtcagggcgggagagtgcagggcgtgcagctcacatgtggaaacgcacttgtaaaaattatccaggacgttaaactcatccctgtagctgtgcctgcaagcctctcgcataggctctaagtgcctggtgtggcctgtgctgagaccatcatgtgctccaccggatccacatccacgtgtgtcctttcctagtcatcctgtctctgggaggagccttctcccctggaggcttcctcgggccctcgctgagtcggcctctctccctgttctctccccggctgcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtgagctcccactcagccctgtccccctccctgcagggtgcggagaacagagcggggcgctggctctgcaggcatcatggagcggttctcagagccagcagtgttggggagcagggcgtgggggcaccagggctttgtctggcatgggtcctgcccagaggctgactcagtcagaccctcagtgactgcaaacactgttttcccttccaaatgaaatgcctggtatgagcacctcttgagaaggtcagcaatgaacaatttagccagatgtcaaaactcttaagtcattaatagccctctcctctcccctgccctctcgcccactcccccacattgaggagctagcaagatctggtccgttgtcatatccgttacaaatgtttttaatccccaagttctgggtgtccagtttagcatcgaagcggggaaagtcctgcttggcacttctggagttacttagccccagccccttcctctaaatggttttgacccggaggactggggacttccagcagtcagagaaggaagcttaaataatgttgctcagccctgaagctccaggaggaacgcctgtccctctgtcctgcatttgtgtctgggtccctagaagctgctcctctaattgcccagatagtcctaacgccccattaaacatcacccaccggccttagggctttcagtgcaggcttgagggcagccaggagttcgtctgggtgccctgtgctcctgcaggtggctcagttcaaccccggagggtgtgagtgggaaggaaggagaggtggccctccgctcctgggcaggtctctgggatatgggagaactcacatgtttccagctgttgttatggtgaccatccaggcccctggctcctcctccgtcacggccagtggccttggctggggtctgagtgagggtcgcgctctcaggagcagcagcacttgtgggacctttgcgcctcaggcacctcacttgccccaccctggtcctgtcccaggtctcattctcactctgaggatgagggaggaagtgctttatcctgaaagccttcagcagtgaaagcccaaagcctaaccgagtctgcaggtgggtttctctcctcctctcccctggagggaaatgatacggttaagtgggcagctgggggaaggacaaggcaggggccctagggtgggagccagggaggcctgcagcgtcttttgcctacctcagtagcccacaccctaaaaggcagcgtgagaagctctgcctcagccagtgtgaaagccaggcggtgagtccagccacagcacacatgcatcccagcctgcggtgtcggtgttgaaagcatgcagctcaggaaggaccctccccagccctgctcttcattacctgtggctaccgtggcaatgtcaggaaaccacaaatggctcacctccagccccgccccagctgcctctctgcatgccaagaaggaagaaggctatgagtccatccctatcccagaagccctggtgacagtaacagtccctttcgtctcatctcataggtccttgtggttgacctcgtcaacagccggttcctcagacaggtgagtgaggccagcgacggcctcctgctccctttgtctttacctatttgttgtttggggctcagctctccagccttggaaaggctctttgggattgcagagcagggtggcagagctgtgtgaccccaggacggggctgggctgaggacaagccagaaggcaaggggcaaaaaggaagggtttgggcaaaggattgctttctacgtgttctgacacaaaatggttttctaacaattagaaaaagattctttgtaatcttataactataggcacctagatttttcatttttaaaaatagctgggtgcagtggcttacacctgtaatcccagcactttgggaggctgagacaggtggatcacctgaggtcaggagttcgagaccagcctgactaatatggtgaaaccccatctctattaaaaatacaaaaattagccaggcatggtggcaggcacctgtaatcccagctacttgggaggcttagacaggagaattgcttgaacccaggaggtggaggttgcagtgagtggagattgcgccactgcactccagcctgggtgacagagtgagatcccatctccaaaaaaaaaaaaaaaaaagacagggtctcactatgttgcccaggccggtctcaaactcctggcctcaagtgatcttcccacctcagtctcctcagtagctggaggcatgcaccaccatgcccagcttcaatatgcatttacgcctgtagtcccagctacttgggaggctgaggcaggagaatagtgtgaacccaggaggtggagcttgcaatgagccgagatcacgccactgcactccaacctgggcgacagagcgagactccgtttcaaaaaaaaaaaaaaaaaagaatatttgccctggccggggcacacttacaatcccagcacctccagaggctgaggcaggaggatcacttgagcccaggagttaaagaccagcctgggacaacatggtgagacccttgtgtctataaaaaaattaaaaaattacccaggcctgctggtatgcacctgtagtcccagcagctacgcaggaggctgaggcaggaggatcacttaagcctgggaggtcaaggctgcagtgagctgagatcgtgccactgtactccagcccgagagacagtgtgaaaccctttcctgaagaaaaaaaaaagagagaagagacaggaaaaaaaatatgtatatacgtgtgtgcgtgtgtgcgcgcacgcacgtgcactttaaaaggactgaaaggaaaacccactaaaacattaacgcttgttgtcttggggagggaaactgaaaggagacagattatgagtgattttaaattgttttagtacattcatatatttttataatgatcatcagttactttcactagcagagaaggtaacacacatgtattttctttttatcatttgctagagaggcctaacttctatcagattttgcaagaagtaattatagtaattacagaaaatttctctgggcattctgatggattacttccaagtgttgccacattgctgaaaagttcagtagcattaatgctgttttttatcattactttcacttcctcaaggcccacagggtaggcccttcccaagaccctcctgctctgaggccctgatcccaaagccagccttagatcacacaggccatctgccctggccagaatcccctggttaccagaatccactagctaccctacaggatggagcagtggaaatcatctattgagtatcctctcagtgccaagccctttcacagggtaattgtagtccattgtagcttcacaacaaggtacagattgattggtagtccattttacaagtggggaaaacgaggctcccgttgcttgtaaaaagtaggctcggccaggtgcagtggctcacgcctgtaatcccagcactttgggagaccaaggtgggcggatcacctgaggtcaggagttcgagaccagcctggctaacatggtgaaactaaactactaaaaatacaaaacattagccaggagcggtggcacgcgcctgtagttccagctacttgggaggctgaggcagaattgcttgaatccgggaggcagaggttgcagtgagccaagatcatggcattgcactccagactatgcgacaagagtgaaactctgtctcaaaaaaaaaagtaggctcaagattgaaacctcagacctctggctttcagttgtattccttccatgaaactggagactgagccaggcctgccctgcagtggctccagtgtgtcctatggccaagacgcagccaccgtgcccataagcccacctgctacctctgctttccagatggacgatgaggactccatcctgccccggaagcttcaggtggccctggaacacattctggaacagaggaacgagctggcttgtgagcaggacgaagggcccctagacggcaggcacggtaagtgttcagccacctcccagtgggtctctcccttccactctgagggtcagggaacaaatgggcagtggccaagggccaagtaggaatatgggcaagggagacataaggagagaaaccagggcctcattctgtttatctggatttcattcccacagtgaattgtgggaaagattttcccacctcccccattttggccttaaagtacctgtttaaaaggggggcgtggaaattatctgggcatggtggcacatgcctgtggtcccagctacccgggaggctgaggcaggaggatcccttgagccctggaggttgaggctgcagtgagccacaccactgcactccagcctgggcaacagagtgagatcccatctcaaaaaatcaaaaattaaaaactgtggccaggcacagcagctcacacctgtaatcccagcactttgggaggccgaggcaggtggatcacctgaagtcaagagttcgaaaccagcctggccaatatggtgaaaacacgtctctactgaaaatacaaaaattagctggccatagtggcaagcgcctgtaatcccagctactcgggagtctgaggcaggagaatcgcttgatctaggaggcagaggttgcagtggaccgagatcacaccactgcactccagcctgggagacagagcaagactctatctcaaaaaaaataaaaggctgggcacagaggctcatccctgtaatcccagcactttgggaggccgaggtgggcagatcacttgagttcagaagttcgagaccagcttggccaacatggtgaaaccccatctctactaaaaatacaaaaattagctgggcgtggtggcgcatgcccataatcccagctactcgggaggctgaggcagagggattgctttaatccaggaggcagaggttgcagtgagtcaggattatgccactgcactccagcctgggcaatggagtgagactccatctcaaaaaataaaaacaaaataaaaataaaaacttttttaacaatttaaaatttaaaaaattaagcatggaaagaaatgtcttaataacctgggtaaccctcctcctggataatcgcagtttccatcaagggaactagcagttactgttctttgattaccaattggcttgtctcaagggctctggcccagcctgtctgccctcaccgttcctggcctttcctccccttactcaggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtgaggggcatcttctctgttggggccgagtcagctagagctccctatattccaggcggctgatgagtagggagaaagatcacagggcaggggcacagacaggactgtgtccatctcccccagagagcttgcagttatgccctgactgagctggtaggaaggccccctctcctggcttctctgttccctctgccagcctctcccagaaccacattccagtgtctgtggcagggtctccttctatcccattctttccaaattgatgaaattctcaggctgggcacagtgggtgactcacgcctataatcccagcactttgggaggccaaggcatgcagatcacttgaggtcaggagttcaagaccagcctggacaacatggtgcaaccccttttctacaaaaatgttttaaaaaattagatcggtgtgatggtgtgtgcctgtggtcccagctcctcaggagactgaggtgggaggatcacttgagcctgggaggtggaagttgcaataagccgagatcatgtcactgcactccagcctggttgagagagtgagactccgtcacaaaaaaaaaagaaagaaaaagaaaactgattggagagtatgagttacatttaaatctctctttacagatcacttggtaagagaggtgtgagacacacaagcttaaaagctactggaagccgggcatggtggctcacgcctgtaatcccagcactttcggaggccaaggcaggcggatcacctgaggtcaggagttggaaatcaacctggccaacgtggtgaaaccctgtctctactaaaaataaagaaaattagccaggcgtggtggtgtgcgcctgtaatcccagctactcaggagactgaggcaggagaatcgcttgaacccaggaggcagaggttgcagtgagccgagattgcaccattgcactccagcctgggcaacaagaatgaaactctgtctcagaaaaaaagaaaaaaaaaaactacctggaaaaagccgggcgctgtggcgcgcgcctgtaatcccagcactttgagaggccgaggcgggcagatcacctgaggtcaggagttcgagaccaacctggccaacttggtgaaaccctgtctctactaaaaatacaaaaattagctgggcatggtggcaggcgcctgtaatcccagctactcaggaggctgaggcaggagaagcgcttgaacccaggaggcagagcttgcagtgagccacagtggcaccattacactccagcctgggtgacacagcgaaactctatctcaaaaaaaaaaaaccctggaaagaaccctctgtccatgaaagatcagtcagcaatgaagacagagtgcctgaagctcagaccccaggggtctgagaagcggcttaagagatggcctatccagccatcctccctccacacctccacagagggactcctggaaaactaagccacttggccagggccctcgtacaggagaatgcagggaaatgggagagcacagacacccctcccaagccaggacagtccggttcaacttttttttttttttttgcgacggagtttcactcttgttgcccaagctggagtgcaaaggcgtgaccttggctcactgcaacctccgcctcccgggttcaagcgattttcctgcctcagcctcccgagtagctgggattataggcgtgcaccaccacacctggctaatttttttgtattttcagtagaaagagggtttcaccatgttagccaggctggcctcgaactcctgatctcaggtgatctgcccacctcagcctcccaaagtgctgggattacaggcgtgaaccaccatgactggccactccggttcatctttaaaactgcccgcctggcacagtgtagacgctcggaaggcgtttgttgaataaaaataggatttcatctatgaggtggctttatagctttccaaagggagttactgcacaggtggggcaattataagagcaataaaatccttataaaacctcctgattcagagcatgtttataggagcagcttagtctcagaaacaaggtttctcttttctctggtagggaggaaatggacacatttagaagtgcaaagaccaagaactcaaatggctgggatttctcttgttaacaggtctgtttgaggtccgagcccaagagtatctggaaacactccccagtggagagcacagcggtgtcaataagttcctgaagggactaggtaaggccccgggctctgggtgcccagcctgtgtgcctctgagctgtctgtctcggagtcccagccggttccctccactggagccagcgccctgaataatgcagagctctacggcctgcgctgggcagatgctactggcattttaacctcctgttctaatctgtccccaaagagaaaacaaaggaaacgctgcccccagcacctccttttctgggtccccgggctttcttgctgtcttctttctctatgatctcctgcactgttaaatctcagaggaactgagctgagggagcatggcgggaaccagacaaggacgtctggcaagaaagactcgcactggtgtccaaattcctctggaaagtagaaacgtgacacttacaaggactgtagtttaatcagtgaaaaggcccttaaagggaaagggagaatgaagacagccaaaaaagaggacggaggccccagtagggaggtgtctgcagcagtgaggccctcccagagggcctgtgaagggcgccatatctgtgcctcctgcaggacggagggctacctggaagcagagtgttttaaatacacacagcattgctgggcactttctcctcccctggctcctgagggatgtgttaattcggtgcttcctttattaccacagaagcagccagccctcctagacagctctgatggtcttcctttcaaaccccctcaagtctgaggaagaccccacggggatctctggaaagaacaaagcccctttggcttctccagagcaagggatgaggctccctggggtggcgtgggggccccgttacccgcaccacttctgggtggaaagggcaagatttatctcaccctcctttgtctgccttgtgaaatgttctcattttccttttttttaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagtaagaaaaatgtgtgggttttctgtttattatgccaaggccaagaggagcctgtcctgccctacacgttcccctcgttcgtcccatccggccgctcagcaatggagctaagaggagtggtgatgggcaacagaaatgaggtgctcctcggagcgggactgacgacacatgaggactgtgaggggaggaggcggagccggtgcctcgggttcagggagtgaggcctcctagtgaaaggctgggcccttgccctagagtggaggctagggaggaacgggagctgtagacggatgtggcttcccagacacgctgctcttccagaagggacagtgatgccacctggtggccgaggccatggacgtctctcttcccaaatggacctgactcttcttgactgccttgttctcttagaagaagccatggaactgtccactgcctgagtagtccctggcttttagaggcacacacacaaaaagaggtcagtaaactgttctaggggtcttcaagtttacgacactgctcacggcccaccttccaacacatagccacaactttgaccccgttcccatctcattccaggggcccagagcagcattaatgcaatagtggatgtgcactgcctgtacacggtggggggcggggggaccttttgcggctgatggtaacaagatggagggtgagaacgctggggcggcgtcatgagccgtgtgcagccagagaggcagcttgcgttttctggaccagaagcagggagggtgtggagaaggccaaaaacctcagggcgacctaagagctgtcctgcagcggggacagtggggacagcagggacagcggggaggcaggaaaagccccgaacacagctgaggcaggttctcagagcaagcctcagggccactaccaggtgacccctgccctcagctctcaccagcgaccctcacagaaacacaaaagggaggggcgccgacctcaacaatggcccagaggggccatactgcctggcaggggttctcaacctttagggagcgggagcaaggggccttccgaggataaatagaaatgaggaaaatgaggggaggtgacctctcatccttcctcttagctggagttatggaccccctcgcccctccaagttctacccaggctttggtgtgtccattactttttcagaggtgaagatccacagtttacatcaaattctcaaagatgctcccagaatggtagaaaccaggctgtgcataaaaattaacctgcctggccgggcgcaatggctcatgcctataatcccagcactttgagaggccaaggcaggcaggtggatcacctgaggtcaggagttcaagatcagcctggccaacatggcaaaaccccatctgtactaaaaatacaagaaaaacttagccgggcatcgtggtgcgtgcctgtaatcccaactacctggaaggctgaggcagaagaatcgcttgaactggggaggagaaggttgcagtgagccgagatcatgccactgcactccagcctggacaacagagcaagactccttctcaaaaaaactctggctgggtgtgtgtgggtggggactagggggatgcctgaatgagaatccctgaatccttgagtgtgggggttcaggaatatgtatctaacaagctccttggattagtcaagtttgtgtgtgggctcaggaatatatgtatctagcaagctcctcagactagtcaactttcttaatagtctgcatatttgtatattgcccagaaagggacactttttggaatatactttctttttttaacttatttcgca

SEQ ID NO: 38727 - DNA, 5005 bp, Homo sapiens
ggacgccatgctggggactctgacacccctgtcttcgctgctgctgctgctactggtgctggtgctggggtgtgggccgcgggcgtcctctggtggcggggccggtggggcggcgggctatgccccagtgaagtacatccagcccatgcagaaaggacctgtgggaccgcccttccgtgagggcaaaggccagtacctgggtgagagcctcctcaccccacagtgcctcaaatcgctcccagcccccaaatcccctgcctccctgagagccatcagatcctcaggcgccctccacagctcctcattccccaccaattttcctaccttcagtgtttttcctaataccccagagggcctggaaacggtgcagttagctggcacaggtggtcttccaagggggagatgaactgggaagttgggaggtggggctctgctcccacgggctctaaggtgggctgctggtgccacctggtggccactccaccttcaggtcatgcagggatgagaggtgagaatcagccaggctcatggaggaggcccagcctaggtaggttgggtgttaggagcccttaaggaggacaccctgttgcccccaagatgtcccctgggccacccccaaaccccatcttccatgagagcaggaaggggcagccccattcttcctctcccgtgtacctcatactggaatgggggaatgggtagatggggtcccctgtccccacagttcaggcccctgactgcccctttctctttctttctcagaaatgcctctaccgctgctgccgatggacctgaagggagagcccggcccccctgggaagcccgggcctcggggtccccctggcccccctggcttcccaggaaaaccaggcatgggaaagccaggactccatgggcagcctggccctgctgggccccctggcttctcccggatgggcaaggctggtcccccagggctccctggcaaggtcgggccaccagggcagccggggcttcggggggagccaggaatacgaggggaccagggcctccggggacccccaggaccccctggcctcccgggcccctcaggcattactatccctggaaaaccaggtgcccaaggggtgccagggcccccaggattccagggggaaccagggccccagggggagcctgggcccccaggtgatcgaggcctcaagggggataatggagtgggccagcccgggctgcctggggccccagggcaggggggtgcccccggcccccccggcctccctggtccagctggcttaggcaaacctggtttggatgggcttcctggggccccaggagacaagggtgagtctgggcctcctggagttccaggccccaggggggagccaggagctgtgggcccaaaaggacctcctggagtagacggtgtgggagtcccaggggcagcagggttgccaggaccacagggcccatcaggggccaaaggggagccagggacccggggcccccctgggctgataggccccactggctatgggatgccaggactgccaggccccaagggggacaggggcccagctggggtcccaggactcttgggggacaggggtgagccaggggaggatggggagccaggggagcagggcccacagggtcttgggggtccccctggacttcctgggtctgcagggcttcctggcagacgtgggccccctgggcctaagggtgaggcagggcctggaggacccccaggagtgcctggcattcgaggtgaccaggggcctagtggcctggctgggaaaccaggggtcccaggtgagaggggacttcctggggcccatggaccccctggaccaactgggcccaagggtgagccgggtttcacgggtcgccctggaggaccaggggtggcaggagccctggggcagaaaggtgacttggggctccctgggcagcctggcctgaggggtccctcaggaatcccaggactccagggtccagctggccctattgggccccaaggcctgccgggcctgaagggggaaccaggcctgccagggccccctggagaggggagagcaggggaacctggcacggctgggcccacggggcccccaggggtccctggctcccctggaatcacgggccctccggggcctcccgggcccccgggaccccctggtgcccctggggccttcgatgagactggcatcgcaggcttgcacctgcccaacggcggtgtggagggtgccgtgctgggcaaggggggcaagccacagtttgggctgggcgagctgtctgcccatgccacaccggccttcactgcggtgctcacctcgcccttccccgcctcgggcatgcccgtgaaatttgaccggactctctacaatggccacagcggctacaacccagccactggcatcttcacctgccctgtgggcggcgtctactactttgcttaccatgtgcacgtcaagggcaccaacgtgtgggtggccctgtacaagaacaacgtgccggccacctatacctacgatgagtacaagaagggctacctggaccaggcatctggtggggccgtgctccagctgcggcccaacgaccaggtctgggtgcagatgccgtcggaccaggccaacggcctctactccacggagtacatccactcctccttttcaggattcttgctctgccccacataacccgcggggggggtcctgctgccctggcctcctcccctttagtggtagagcgaccttttcaattacaaagaacctcctggaaaaaaaaacaaaagctgaacagaggcggccgtggccttggcccgaggagactaacttgctttctccctgcatgcaggctgagattgtttctggaaggggctggcctgagtttctttcccccaaatgtctgtgcagtgtcagggctgcaccccataggccctgaggcacacagcccagccccttgtgagtcctggcctctgctgggccctgaaggagctgagagggagctcaactccccaccccgccacgtggggagacagcccttcccactggctccctgatggcacctgctggaggaaaggggcacggcctccctcacagcccttggctggggctcctccagctccccctgggacctccagcatatgacagtggactaaggactgtggggttttcctccaaggggaagggagaagaggggaccatcgaggtggcgagtgtggacaccctgccaggactgcagcccccatggtgatgctgtggcatcagacatgtccgtggtgggcacagtgcctgttgccctgggaaagggcaacctccctttcactgctccagtggcagccatggggaaggcagtttgtgagggcttggggcacagacctggggcaggaggcagctcttcacgttcatccctgtctctcccgggctgcccccgccagctctggctgtttagcttgagggcagcacagaggcccctgggacacctacaggccagaaagatcaacctctgtgaagtgtctagaagtatctagtgcagatggtggcggaggcagaatcgaccatcagcaaacatgagcactcttccctttctccccttccacctgctgcgggctgggctggttttctcaatacaaaattgtaagaggatccttgtcaccccagccaggtatccccaaggcagagcacctctcgtttggccctctgaacaaggtgcacgcgagctgggggatgaagacggctcccacttccttttccttaataagaaccatatggtgggtgtatgtgtgtacaagaggggttcatctgtgggggcttcctctccttccaccctctggttccaatttcctgttctaagcaggactagggcccaggaggctaaggctgggagagaaagggtgccaacaggtcccttgggaatgagttggctctggacgtttctgccctgttccccgatcagagctcctctgcaggaaacaggcaggatgcccctcccaacccctcagtccctacgtcaagcggagtggataaggctgagatgagtgctgggagtggtggacattcctgctcgtgcaaagatggccactttccccgcagctgcagggcctcgcgctcggccctcgccaggccagccccactccttgtaccaagtgtgaactggggtcattcggtctgtgatctcgttgcactgctccaagtctggctgtgtccaggcggtccatgttgaaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtat

SEQ ID NO: 38728 - DNA, 12180 bp, Homo sapiens
ccgccgccagcatgccccggcccgcgggccgctccgccgccagccacccccgcggccctcggcggcctgcgctcggcccgggggcgcgggaaccgcagccggagccggaggcgggagcagcgagccggagccccgggcgctcgaatgcagggtgagcgtcgccgccctggcccgagggcggacggacgggaggaccccggcgggaggactcggcgggaagggagggggctttccgcgccctatcggtcgcggggtccgtccgagggcccacgagcggcgcttagcgctggcacccccccaacttggggaccttcggggtaacttccctggggccagcccctccctccgtccccctgcatcggggcctagcagcgccgccccctgggcttctcaggggacgggggcggggcgcggtctggggatcctgagcccgcccctgctcggcgcaacccagaggggtccgggggccgcagtcccgccaggtttcccagcctgtcgctcggacgcgccctcggggtggggcaggactcggggcacccactggggaccagcaggcgagagcacgcgagtcggagcggggattgcggggggggggggggatcggagccccagggggttgggactgtaggggcgggggctggggggggcgtgccggagatgtccaggcctcgcgctgcgcgtccctccctgggcgacggccaggccgggccccgtggaacacatcggctgcagcgcgggcggagaccggcgtgggggcggaagccggggcgcagccagagcccggggaatcctttcaagttctgggttctctttgttgcgcaatggggcctcggggccgcgcggcctcattggcccggagctgtgacgtcacgccccggccccgcccgcatgtcttgcggagggaggcctcatggcccgggtgggtcccaggctagttgcacctgcagttggccctgcagtgggcggggaagtgggaagccgggtcctgagatgctgcggaatgctttaagtgccctgcaggagaaacttcccagcagaagacagggctttaagtgccctgcaggagacacttcccagcaggagactgggtcccgtcggcactgtggggagcccagcctggggtctggccctagtggccgctccattctatgaagaatgaacagaaagggtgcaatccgtggatctgtggtcactgacccagagccagagggacactttgttcccacacaaccagtcctctgtcactctgcacttggaacccggtgtccacgccctgtcccccaggacgttcctctcccatgccaagactacagtgcccaggagtgcctggccccaaacccagccctgacactattctctccgtgttgccctgagcttctgcctgaagtgttcccatctgcagtgtggggacggtgagacctgccctgcagacctgaggctcagaaagacctcagctctagggacaaaaaaaaaaaaaatgcccttttccccaacattttagggtttgagaggccaggactttggtgtcaggcaagtggagtttggatcctggctcaggcaagtgctggccgggcaaacagctttacctctccctgcttctgctggacaaactttacaatggggatgaattgtgggggcactcactggaggagcatgcccgtgtgcaagaggatgcacgtgcccctgcccacagacctagagcctttttctttttaagacagggtctcactctgttgctcaggctagagtgcagtggcacaatcatggctcactgtatccttgacctccccaggctcaggtgatcctcacacctcagccttccaagtagctgggactataggctcacaccactacgcctggccaatttttttatttgttgtacagatgggttttccccatgttgcccaagctggtctcgaactcccgggctcaagccatccactcaccttggcctccccgagtgctaggattacaggcatgagccactgcaccctgccttcagacctaaagcctttcccagcagtaatgcagcattaggctagacgagaggaagaactggcaccgcgaagggctgggctggttgcagcctgtggctctttccttaccaccctgcaccagtaatcaacacatggacagggtgggcggggccaaggtcacggggctagacagagcttgttcacggggctagacagagcttgttgggcatctgagggaaggcctcccagtctcacagccgaggctgccttgggcaggtagaaatagatgctgacctgctaggtgcatgctgagtccactttcctatttgagagcgtaaagaccactggtgtctgcagccctcttgctcacagcgcttactcacactctgtctgctctgaacccccaaaaggctgccaggcaccccaaaggctggaggtggcccagtgctcccctcactcctgaggctactctgccccaggtcctggtcccagtgaatatgtatctgcccacaggtctgaggctccccggcacctccaagctcagtgtcttggcccataagagacagcacaaggctgggcgcggtggctcatgcctgtaatcccagcacttcgggaggccgaagcgggtggatcacctgaggtcaggagttcgagaccagcctggccaacatgatgaaacctcgtctctactaaaaatacaaaaaaatagctgggcgtggtggcgggcacctgtaatcccagctacttgggaggctgaggcaggagaattgtttgaacccaggaggcggaggttgcagtgagccgagatccaccctgggtaataagagtaaaactccatctcaaaaaaaaagaaagaactctggacaagacaagcaggaggcttgccagctgctggctggggcatcgctgccttccctgcccgagagccaggggccttggctaaggcggcagtggccccccaccttgagctggagatacttcctctctgggggacatggggcgtatctggtactatagatgcccataaggaccggggcatgagaaagagagcaaatgaggctaaatggcccctgggtaagaagggccagttaagtgtgagcagagcacaagtaggccttcacttggtactgggcttctcccacactgcctgcctgggctgcagccagagggctgccaggctgggaagggtgagggaaggactcgctgcccagccctctggcaggatgggtgcttccccgctccccgccacatgcctgctgcccagcatcctatgtccctgactcacatggaaaggccatcggcacttcctctgacttcagagtcaagctctggtctggtctactggccgtctccaggcccttgctgcccaagccaaccagagcatgagactggccactaccccagagcacccagtgtgtgccagacctgggcccagggctatagagatgtggctcctgtccacctcagcctccccgcggaagaagcatggcagtctcttagaggagaaggtgcagggaccttgccccagccacaccgctgctgtgtgggggctttaacctcagcgcggggtcctggctctggaagaccagctgggggctgacatagcagactgcctgccccctctcagggtggtcaggaaggtggtgaccatctccgttccccaacaggtcacttggggaacaggagagggaaatggaggttcagggggtgtggtcttccgggacatgtccttacgtggcctgatgaagtaaaataaattaaggcaagtacgtcagagatgtccactgtggggggctctggcatgggctgtgtgaggattctggaacatttgatggcaagaggacttgttctgggatggtgccaggtcatgcacggggcaagagtgcccatctgggcccaccttggatggttccctgaggatgcaggtaacctggaagggagcccagatattgagctttgaccaggagtggacggaagtgagggaatacgcacttattgggcaccccgtatacagcccctgggtgtcagggacatgggcaggagggtcctcccggggcgtggagaggagagtgcagcctgatgtaagccagggccagataggtcatggtgcgccagggccttccccgccttagggcatttgtgctgttgtaacacagtacttaagacgcagtaactcatgaagaacagatttatgtctcgccgggtgtgggagcacttgccctgtaatcccagctactcaggaggtttagatgggaggatcacttgagctcaggagttcgagaccagcccaggcaacatagtgagactctgtctctaaaatataaaaataaggccaggcacggcggctcatgcctgtaatcccagcactttgggaggctgaagtgggcaggtcacttgaggtcaggagtttaggaccagcctggccaacatggttaaaccctgttactactaaaaatacaaaaaaattagccgagcatggtggtgtatgcatgtagtcccagccactcggggctgaggcacaagaatggcttgaacccgggaggtggaggttgcaggagctgaggtggtgccactgcactccagcctgggcgacagagcaagactctgtctaaaaaaaaaaaaaagaaaagaaagatttaaaaaatacacacatatataaattttttttttcaaaaaagaaaagctgagaaatccaaaatcaaggtgctggcaggtttggtgtctggcaaggcctggtctgtgcttcaaagatggtgccttgaatgctgcgtcctctggaggggaacagcactgttgctcacatggcagaagagggaaagctccttgagagagaactcactcctggaagcccttttgtaaagacattaaacccacccatggcctaatcacctcttaaatgtttcatggccaggcactatggctcacgcctgtaatcccaacactttgggagaccaaggcgggaagactgcttgaggccaggagtttgagaccaacctgggcaacactgcaagaccccttctctataataaaattaaaattagccaggcagggcagggcatggggctcacacctataatcccagcactttgggaggccgaggcgggtggatcacaaggtcaggagttcaagaccagcctgaccaacatggtgaaaccccatctctactaaaaacacaaaaaattagccaggcgtggtggtgcgtgcctgtaatcctagctactcaggaggctgaggccggagaattgcttgaacgcaggaggtgaaggttatagtgagccaagatcatgccattgcactccagcctgggtgacagagcaagattctatctcaaaaaaaaaaaaaaaaaaaaaaaaaaaacgtagccaggcatagtggtgcaggcctgtagtcccagctacttggaaggctgagtggggaggatcccttgagcccaggagttccatgccacagtgagctatgatctcaccactgcactccagcctgggtgatagatcaagaccccatttctaaaaaaatagtgttatcttgtaatcccagcactttgggaggccgaggcgggcagattacgaggtcaggagatcgagaccagcctggccaacatggtgaaaccccgtctctactaaaaatacaaaaattagccgggtgtggtggcaggcgcctgtagtcccagctactcaggaggctgaggtgggagaatggcatgaacccgggaagcggagcttgcagtgagctgagattgcgccactgcactccagcctgggctacggagcgagactctgtctccaaaaaaaaaaaaaatagtcttacctcttaatagtattagaatggcaattaaatctcaacacgttttaattaaatttcaacatgagttttgcaggggacattcaaagtgtagcgctcgccatctcccatcccaagtacctaagggctacaacgctgtcgccagagaggaagtcactgagtgcccactgccacccccccacagatgctcgtggtccccagcatccttgagccaccaggagtgagggctgctgctccctgagacctggctccaaggaggatgccacagccgcctgccagctccggtctgcaccatgagtgatgagcggcggctgcctggcagtgcagtgggctggctggtatgtgggggcctctccctgctggccaatgcctggggcatcctcagcgttggcgccaagcagaagaagtggaagcccttggagttcctgctgtgtacactcgcggccacccacatgctaaatgtggccgtgcccatcgccacctactccgtggtgcagctgcggcggcagcgccccgacttcgagtggaatgagggtctctgcaaggtcttcgtgtccaccttctacaccctcaccctggccacctgtttctctgtcacctccctctcctaccaccgcatgtggatggtctgctggcctgtcaactaccggtgagcatgtgaagttctggggttcttggggttctaagcaggcgtgaaaacaaagacatatctggtgtgcccatgcgcacacaggagtggccacacctgtggcatgctgggagggcaggcaggctcaggaggggctgctgtaagctgctgggggcatacacgtagctttgcatgggtagacacaagcagccaatacagaatgcttggaagagggacgtgtgacaatgttcacagtatctcctatgcaaggaacaaggccctgccacactggctgtgccatgactatgatatactgggggtgtggggtgcctgggtggtgcggatcccctacaggtccccagaggcctggggaggccctgtgggtgacgccagatccctctgttccaccctgcctcatgccaggctgagcaatgccaagaagcaggcggtgcacacagtcatgggtatctggatggtgtccttcatcctgtcggccctgcctgccgttggctggcacgacaccagcgagcgcttctacacccatggctgccgcttcatcgtggctgagatcggcctgggctttggcgtctgcttcctgctgctggtgggcggcagcgtggccatgggcgtgatctgcacagccatcgccctcttccagacgctggccgtgcaggtggggcgccaggccgaccgccgcgccttcaccgtgcccaccatcgtggtggaggacgcgcagggcaagcggcgctcctccatcgatggctcggagcccgccaaaacctctctgcagaccacgggcctcgtgaccaccatagtcttcatctacgactgcctcatgggcttccctgtgctggtgggtgacggcgtcgggtagaggggcctgtctctgggacagccctggggctgctcatactccaggcatcaggtggttgagtcctcagacccaatcctttgagatgggcttgatcatcgtccccattttccagatttggaaaccgaggttcagagaggtgtaaagacctgcctagagtcagggcagcctggtgggacttgaacccacatccggcaactgcagggcccagggcctagctgctacagtgcagaagagtttactccccttgcccaaggcccatttttttgtttttgttttactttatttatttatttatttttgagacagagttttgctcttgttgcccaggctggatgtgcaatggcacaatctcagctcactgcaacctctgcctcctgggttcaagcgagtctcctgcctcagcctccaagtagctgggattacaggtgcccgctgccacgcctggctaattttttttttgtatttttagtacagacaggttttcaccatgttagtcaggctggtctcgaactcctgacctcaggtgatctgcccatctcagcctcccaaactgctaggattacaagcgtgaaccactgcatctggcctcaagggccgtttgatgcagaggtaggatagcatacccatgggtttcctggtgggtccaggtcccaggatggacagagggagctttggtgccgtaggtaggtaggtaggggcgcaggatcaggagacagagcaaggccagggcgggcctcaaatgtctgttggggagttgcacttgatactaacggctggggaaggccaaggtgagggctgctgtgagaaaggccttgccgacaaaggtctgaggtccagaggggctgcctggggtcctcttggtgaagctgggaccagcttggcccaagaatgaagtctggactcagtagccaacccctgccccctgcaggactctacgcccatccccgaaaggtctgcagtgagacagggagaggactggggcaaagaccagcctgaggggtttcatccaagcagcaggcaagactgccttccctgagccattgcaggacatgaggacatgagctccagaatggtgactcggggggtggcagcttcagagtcagggccttgctcaggaggcagcccccactgccccacccccagcaggcctggttctccccagctaagggtcctcatgtgtacagtgggggctggcagcccggtccctgtgcagatggagggcaggggcttcatgaaacagcagagacccacaaggcacctcgggagcagagtgggggcagtggtggggagaggcggggctgggagggagtcagaaccacccctgcgtctcttacggacggggaagagggtacagcttgtggggccactccatgctgctgttataaagcgtccggagtcttcaccctctagagcatggcctgttcttagcccattttccagatgaagaaactgagccccaaaggggtttagcagctttctgagggtcacgtggcccacaaacggcagaatcaacatacccacatcctccacactttcactcttttgtggcagtcacttaagcatcactctttgggacagagcaacgagggctatcctgggagaggaggaatgcagggacccaaaagcaggggtagggctgaggaggccactggccgggaagggggtggtagaatcttgaacaggcttgagacctggttctctaagcctcagtttcctcatctcaaaaaggggatggcagccgggcacagtgattcatacccgtaatcccagcactttgggaggccgaggcaggaggatctcttaagcccaggagatggaggctgcagtgagccatgattgagccactgcactccagcctgggtgacagaatgagactgtctcaaaacaaagcggggaggaggtggtaatccatgccccacttctctccatgggcagccaggaggaagacagagcaaggccacccagtgctgcccagtagccaggtagctcccggaaggcggggcctcccactgccacgctccagctcttttctccccaagggccccttctccttggcagatacccacctgtcagacctgccgtacacatggggagaccgagactcagggggagcttgtgtgatggtggggggtcctgcaggtgccaggccgagccctgtgcccacaggtggtgagcttcagcagcctgcgggccgacgcctcagcgccctggatggcactctgcgtgctgtggtgctccgtggcccaggccctgctgctgcctgtgttcctctgggcctgcgaccgctaccgggctgacctcaaagctgtccgggagaagtgcatggccctcatggccaacgacgaggagtcagacgatggtgaggatggcctgagagtggccccagggagagtggcgtctaggttaggtcattggggttggcaggaaaacggctgtcaggcaacgccactaaggaggtgacttcattctcaaccaccagacaccccgtgtcacccccaaatgtacttgaatgtccaagggacctaagccaggttcccacagggcactctcctatctggcttggctgccccaggttccaagtaatgggatgttctggttaacagagagcagggtagacatgtctgcaagtgctccagcggagctcctgggctcaccccccaacctcagggatccccagcaagctgccctgggggctcctgcagaccgaggtcctgtctggataccgttaccagcaatcccattaccctcagcccagcccgtgctctgtccaggcactgccagccccttgcgtgtgttatttagtcctcccgaggtcacctctggtcccaccccatgtcctagataaggaaattgtctcagtgagtgacctccctgcccagtctcacagctaaagggtggcatatttgggatttgaacccagaacccctcccattcccttttcagctaaccagccccctaccttgtatatgtctgttgggggatctcagggggatccctgggattccctcccagatgcccccaagtttccatgaccctaaggctctgcccccccacccaccccccaccctacagagaccagcctggaaggtggcatctccccggacctggtgttggagcgctccctggactatggctatggaggtgattttgtggccctagataggatggccaagtatgagatctccgccctggaggggggcctgccccagctctacccactgcggcccttgcaggaggacaagatgcaatacctgcaggtgagcgcagggctgggggagaggccgcacctgcgggtgacagggtgtcctgagctccccgaggcctctccactcggagcccatctcacgccttctgcagtcgcaggggtggctgtcaccatccgaggacgggctgtccaaaggtcacacagcttgtgtgggtgggccccaaccgccacccccatggtccctgtcacatgagttatctcctgccggctcagtatcctcaacgagcgccctccccaaccgaccccagctgtctgacacagccctgcggctcgaagagactgcaccaaacctcacagctcccagccagactgccccagcgcgcagcctggtccctgacccacggaaggcctttccccagggtggagaagggtttgtccccgtttcccaggagggcagctcggggtaaaagccagccgcgtcctgacaggtcccgcccacgcggcgcttctcccacgacgatgcggacgtgtgggccgccgtcccgctgcccgccttcctgccgcgctggggctccggcgaggacctggccgccctggcgcacctggtgctgcctgccgggcccgagcggcgccgcgccagcctcctggccttcgcggaggacgcaccaccgtcccgcgcgcgccgccgctcggccgagagcctgctgtcgctgcggccctcggccctggatagcggcccgcggggagcccgcgactcgccccccggcagcccgcgccgccgccccgggcccggcccccgctccgcctcggcctcgctgctgcccgacgccttcgccctgaccgccttcgagtgcgagccacaggccctgcgccgcccgcccgggcccttccccgctgcgcccgccgcccccgacggcgcagatcccggagaggccccgacgcccccaagcagcgcccagcggagcccagggccacgcccctctgcgcactcgcacgccggctctctgcgccccggcctgagcgcgtcgtggggcgagcccggggggctgcgcgcggcgggcggcggcggcagcaccagcagcttcctgagttccccctccgagtcctcgggctacgccacgctgcactcggactcgctgggctccgcgtcctaggaccgccggcgcctccccacggacgccaggcaggccaggccgctctccggggccgcagcaccaaagacgcccgcctccgccccgcgcgcagacatgcgccacccctcccaggggtgagggggcgttggcctcagcgtttgtcttccggctcctcccagctggccttgtcccaggggcgacggctgccccggacgactgcgctgggcaccgcatgtcccgggccgagtgaggtcgggcctggggagctgagtgacatcccaagcttgggcttgggtagtgagtgacatgtgcacacgtccagctgcgccatcaccagccctgcgcaacaggacgtcgggagcagggaacctgagacagggccactgcgggatcggacaaagccccgctttggagaggctgagctggagccattggcctccccaggggctttccacccacactgcaccataaccgccacacccttcggggggggggagggtacagagggtctctaagcacaggggtgttcagagcccgaacaagctttgatcaggtttccctgc

SEQ ID NO: 38729 - DNA, 56544 bp, Homo sapiens
gggggcgggcccaggtagcaggtttggctgcgcgggggccgcgcgtcggaggtaaatactagggcggtgggtgtggggagccggggccggcccgggacgcgggctggggagccggggcgaggggcgacgccccgccgcccgaggttagtgaatgagcgggcggctggcggccggcgggcggccggatcccctcggcgcagccgcctggcctcagggcgtccggagccgccgcggcgaccatcgggccctcggcgccggcccgttagttgcccgggcccgagccggccgggcccgcgggttgccgagcccgctgacgtcagcccgggtttcccccccccaccggggcttccccatcccccgaggcttcccgggagggctgcgagtccggggagcgtgcggggtcgccaccatcgggacccccagaggagagaggacttggggcgggagccgcgcgggacgctgtccccctcccgccccccaccccatttacagattgggagactgaggcacaggccgctggcgggccccgacggccacggttggcctcaggagcccggggctgtgattcctaccgaccgcgccgcggggcgtacgtaccgatcgattttgcgggtgttggtggctcccgtccaggaatggcagtcggggttctggccttgttaatggcgtgttctgctttttctttcagtttccccctttctagggtgaggatggttctacacagccacccggagttccttagttgaaaggtgcgccctgctgtgacaggtattctttctttatgtttttctttcatgttaacaatcgaggggggtggggggcgaatggggggcgggggcgaagtcatgaaatcttcaggagatggtgttgagtttggtactcagctgggtcagctgccggttattcatgtacttggcatcgtttctcttccaccccttggcatttgaatgttttaggatagttgtcatcttccagccaccaagcctgtggccttgcagtctcccagcccccatcatccctgccaccttcttctcctcaatttttcctggaaagttttatccttagctcagctaaggagcatgcctaccttgcttttgaattcgggctaattagggatcttaataagattgttcattttgcaatcattggctctcagagaagcacccaggccttgagagggtgttcgtttgattgttggctttctacacaccccctcacgccccaagtagactgaatggccttaagaatttagcctcccattccccactgagcagtaggtggatttgaactagaacagtattaggagaaaatgatttgctggaaattcttattgaagtaacacccagaacattctctaatattctgctgcaaaattgtatagtattcttgcaaataaaccttcctctgggtggtaacttttgtgagaagcagataaggcttgttatataaagcacaactaacattaagcagcaatgatttttatagtctggcacacctaaactgtggttttgtttgatttaaggaagtctccaacacagggagagagaaaggaatagttatgttgtttatcaaactattagtattttgttcctgattttcacactatgatttaaattagtttttttttcattggttgtacagaatttataagcatcatacatgctagttgaggctgtaggaagctagtatcaaataaacctcaaaacaacttggtttcgtaattgtgaaattttccgtatttgtttcttcttatatgtataacaatgaagtggtttagcatgatttcattttatctagagaattactgaagttttaggcaaaattcattaaatactcccaattcctgagtctttttctcttctctttctcttggtttaatcccttaaacaggaggaggaaatgcaattttgttttcactgttaccacttgagtctttcattcatttctctgtattcagtgcctagcatatgccaggctctcgtgtgggcactggataatataaaaatgaaggacttggggaattcacagtttggcagtggagtggctaggtttaacactagagaggcagcagtattccttgttccagtgggaatatgcagatgtgagaggctcttcttttcttttttttttttaaccttataaatcccacttgtattagggactgtgtacttgtgacacaaattagtcattgaggaaaattaaaacggactcagtcttttttctggccacggaatctctgtatctctattctttagctgtttagaaatataacaactttgtcttttagtgagagatgttctcttttaaaaggatgatcattctagctatccagaagcttttggaaaaaggcccacatgtcttctttctttggtgttcaagctgaccttcctacctctttgccatttataattaggggcagaattaagtattgtaagttttattctaatttaaatagcttcctgtggtttttagaacaagcaggatatctttggagatgcaaaaagctcttgaattggatctgtctttgtgagatccttatgaacaatataacctgataacttgagaatcagaaaaacactgcatcttctggataagttaaccattgttagttttctgtagctactgatgttcatttgtactatatgttgcctttcagaatgtggtaattgtaatctttaacattttcatgtaaaacatatttcctgatcatctttccattgtcttcatggaaaattgataaatatttgtgccttccaactctcgtcttggttgaatgacttcatcttaatacaagtaagttcccctttactcagaatccagaccatcaacaagctcagataaccagaaatgttttcaaatctatgtgaacctgaactgttctccttcatcagcgtccttaaaggaaaggccttctgttcaacatggctttagggttaaacatattattgtgtttcaactcgttggtaattttcattcagtatttattaccaagatattcataatcacacagttatccagcctgaagtaagatagtatttagatgagtcatttgtgatatactcactcaaagtgattcaacctgcaaaataataagagaatacaagtgaaaatttctcccttcacactgacccctcacccccacctgccctacggtgactttgaatttagctgtgcttctttttccttcagttgtcttactgttccctaggcctttacttaaaggcagaagctgagtgaatgtggattgatgttgggtttttttttgtgtgtgttctctctttcctctttgtttttttttttttttttttttttgagaccaggtcttgctctgtcacccaggctggagtacagtggtgtgatcatagctctcttcagcctggacctcctgggctctagcgatcttcccatcctccagagtagctgggaccctgagtagctgggcccacaggcagacaccaccacacccggctaattttcttttctttttttttcttccttttgggacaggctctcattctgtcacccaggcaggagtgcggtagtgctatcacagctcactaaagccttgaactccagggcttaggggatcctcccacttcagcctccaaagtgctgggattacaggagtgagccactgtgcctagcctagatgatgtagttttcagtatctaactctgtactgaaagcgtaaaaaataccaaactaacaaaccaaccttcttgatgataaataactcatttacaatgtgatttagatctttcccttcatattgtgttgagtcagtttttactgcttggggtacctaagactttaactatttaactactatgcacatcccagtgaaagtagactgttggtgttatattcacttctacagtggggagaaatgtatgttagcatatttttattgcaatactggtattttgagtacataaaataaatatatatatataatggagtgtgtatatatgtgagagagtgtgtgacagggtcttgctttttcacccaggctgaagtgcggtggcgtgatcatggcttgctgcagtccctccctccagggctcaagccatcctcccacctcagcctcacaagtagctgggactacaggcacatgccatcacacctggctaacttttgtactttttgtagaaatgaggtttcactgtgttgcacaggctggtctcaaactcctgggctcaagctgtccactcaccttggcttcccaaagtgttgggattacaggcgtgagtcactgtgcctggccgagaatattagtgatcattcagttgattgccttgtatatctctagactcgagccgtaaagtttcccattcaactttctctatcagttgcagtgaagagaatcaatttttaataagagagtttcaaacttgttcttaatatattctttctgaaagaggaaaggctgtatcctttatttttggataatgcttttgaaatatttgataacttgtgcttgactattttagttgtctaacatgacccatcctattgctaagtctaagctcatttccacttgtgctaatgaaagttaggaaaaaagttaccactccttgtagagttcactttaaaatatggtacttgaaagctatagtttattaccctaaaacatttttataaacctagcagttatatcaatttttactgtggattctcttccttaaattatttcagaaagcaagcttataatcaaatttatttaacataatgtcctaatgcacatatagtaatttagttttgtcttaataatagattattagcattaatgatttttattttaaattgtgacatgaatagttaagctacaggaccaatagagtaggagctgttggtataaagcaattattaagattcagggaagtttctgattgtaatatttgaagacattgttcttaggaattttaaaaaagaatttcttttcaaaatagaattactttacctttttcaaaaaaattttggccctaaaaatctaaatacattttaaagagaaccaaaacaacagctcgtttttttgaaagttgctttttgactgtcttaaccttctgctagtgaccagactctctattcaataaagcctatgtgccctttgctcctaaagaccctttcagaatgtatgcattcctcttttcacgattgttgctttgtgttttcaaacacacaaacatatttcactacctggcttctcagaactgattcgaagcgataagttggaaagcaacaaggccgtaaaaggagtcaaatgcatacagcaggaaaccacagaaaatggctgattgcaagggaaaactctagacagtagatctgtagaaagcattcgcgacctcaggaagcataagatacagccttttaacaaaataacagccttgcagatcaagagttatgcaaaataatttacagtcataatgatacatcaatgatcaagaaaaaaataaggacattttcttgtggaaagtgttgacatgttaaaagcattttggtcaaaaagaaccaacacttcagtttggtcctttaaaggaatccaaccaaattgaggggttggatagctgtttgggcagcccttataaggagttttgtttatattgtgtcaagatagaggtttccacaggtgtcttatataagtggcaaatataaattgatcccattcttgctgaagtagacagtgccctcaagtggaattaaaacaaacacaccacaaaaaagaagaaaagagaaccacttcatgctacctctgcttttaccctcactgagtgttacacagatatttcagtcatgttggtttgaaggaggtgcctaacctgtatcctgtcttggctaaaccacatgtctcatgctggcttgtagagggagagacttttaggaacgttaccattatggaatacttcattatctagcagtgctttctaaaagaagtgttccactgtgtatagatttgccaggttgtttgatcattaagtgattaaatctaaaatttggttctttaggagtatttattttttaattgctagaataaaataaatatgatagtgctatcaattgcagccattacccagaataatggaaatggatacctctatctcaaggaaggatgaaatgaaagtactgtctttggaaaccagatagccacattcttatgacagggatacctaggaagtattgttttcagcagaaaattaattaaaataatgaagtaaagtctcagtttaaattaatgaaattgtgtagttttttaaccatcagttaaaataggtttgagaatgagcctacttcattggaaagattattattcttgtaaaaattttaaatgaggaccaggtgcagttgctcatgcctgtaatcctagaaccttggaaggccaaggtgggaggatcatttgagtccaggagtttgaaactgcagtgagctatgatcgcaccaatgtacccaagcctgggtgacagagcgagaccctgtcttaaaaataaataaataaaataaaaataaatgaaaatttgaaaaagaaataatagaaagaaattataatgcagttatatcatgatattcccttgctatgtagtacaagttttgatgctacaaaattgatttttaaaatatttttaatatagtcatattataatatctgatatttgcgatttgagaaatcagataactatgattaatgtgatgaacattgcccatcttcagaaaaaatatatgaaatgaagttgagtcagaggtaaaatgttccattatcacaatatggccatatcatagctatcatttataggcatgagccacacagctcagcccgaaacgctacttttaaaagtttattagtgtcagaatatgggacaggcctggtggcttacgactgtaatcccagtgcgttgggaggccaagacaggaggattgtttgagcccaggagttcaagaccagcttaggcaacatagtgagaccctgtctctacaaaaaatagaaagcttagctgtgtgtggtgatatgcgtctataataccagttactcgggaggctgaggtaggaggatcacttgagcctggaaggtcttggccacagtgaactgtgattgtgccactgcagtccagcatgggcaacaagagtgagaccctgtctcaaaacaaataaataaaaataaattaaaaaaagttagaatatgtatataagggtaatctttaaaagtttttactagaatctgattttataaatttcagtgtcttggaagcaaacattgtgttgtctttgaaagtactttacaattggatttcattaattaaatatgcacagttacagtagataaaagtaatacagtatgtatgtcttttagcccttttagatattttttgaaaatatttcatttgtgtgtatgtgtttactggtcaaatgaaaattttaaaagtcttcagtcttaattttcagtcatgtagaatgaagtctaaagtttatttttgctttttcactaggcattttgatttcctttctttttacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggtaagtttgataaaccattttagtagtgtgtttgtttgtgttcatgtgtgtctgtgtatttgtatgcacatacatatttttctccttaaatacgaaataaattttcccaagagtcttctgtaatttttaatattcatcatccttgctgatgaatccatgttgtggttgaatccataatccaaaacttgcttatagttgtcactgataatatgtgtgaaaatcaccttggcgtttatttctgttggaaagagacccaagaactctgtgatatgtttccaagcttaatattcattcttgagaacttaaatgtcaattatattttgacattcttgcaaatagaattgtatgccttctttgcttcttgatttaatttcttttgtttactttttaatgatgaattgcgaagatgtaaagatgatgtcgaaacttaaaaaactatgtactatggtaggaacatacaaagagattcacctggctattgcagacatatatattttagaaattttaacattgcctgtattaaacatgaacgctaccagttgtaaatagttacataaaaaattgttaattaccttgcgttatcatctataggtttcttagttcttcttaatgtatgttattaaataacaatttagatataagatttttgaaaaaaaagttgcagaaatttaaacttgcttataattgtccccgataatatatgtgaaaatccttagaatttatttctaccggaaggagacccaagaatgctgtgatatgtttccaaacttaatattcattcacaagaactgaaatgccaattacattttgacactcttgccaatagaattgcatgtcttctttgcttcttgatttaattttttttaaaagcagtgattgtaaacaattaggaatttgaatcccagttaagccatttactagctgggttgccaggttacttaacaaagctacttaacttctctcattctgcatccttacctgtacaatggtgttaatagtacatgacttgtagtgtttttgtggtacattgatgcaggatttaagcacagtgactgacaataagtgcttaatgaatggagctaacattactgctattttaaagtaacattttctttttataaccaaattaatgttagaatcacaacgtggaattcagcctagctttctcatgatagagttatgaattgaaattatcagataatattatttcagcatcagatacaacttcttattttttaaaacactctaaatccaacagaaactgctaataattgtatttcttattatatgtatcatttagaaattttccagagtgattttcctgaaatccctagagtgaaccccttttcctatggatcgtctttctatatctatttctttcccttctctcttaaaaactaggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggtaagaaaattttggattaaatatctttgtgatatatatattagtttatatatatatgtatatatatatataaacatatatatacacacatatatatacacacatatatatgtatagtttatatatatatgtattagttttaggaccaatttacttgcaaattgaacactttgaatatttaacatgatctaatttggagtactttaaagaacatgttctaatttatctttggtaaaggagcattgaaatagaacaggggtctagatacagattacatttacttttttttcccatttgaataaactagaataatgttctctatctttaaatttgccttattgtagctgaccagtagacaaaacaaaacaagacaaaacacaattatattacttgaagtcctatttttctttattttgaaacagttttttggggtactccatttttttgtgatattctacacaatttaatggctgatctgattttaataattagtataataatcatttatagaaaatacctgagtagaggaaaaccacattgattttgaggaatagacaatcagaatatctcataggatttcattcattttaaaaaccttttttaattgtggtaaaatatacataacaaaatttatcacttaagcatttttaagtgtgcatacagtggcattaagtgtattcacattgttgtactgtcacctgttcatctccagaactttttcatcatcccaaaccgaaactctgtgcctgttttaacagtaactgcccactttccccaacctctgctaaccacaatttcttctgatttctctgtctgaatttgccggttctaggctcctcataagagtggaatcatacaacatttgaccttttgtttgtgtcacttatttttaatgtttccttacaatcatactttttaataatggatccattccagtgtggttcattggattatacctgtggcactgaaagaataagaagagaaaggctgagaccatttttatcatatattgaacatatgggcaagactttgttatgtataaagaaggaaattcatatggaattactgaacactagaatgagttaggaggcgatgtgagtagtaatctcttatactcacaatggggatgcttttagtcatcatttttatctgctcaggtatactttttggttggtaaggtaatgttctagtgtaatggtttcctgtgcttgaaaattccaggaaattctatctgatactcattggttagttactaaacaaacgtttactcttaacatgtgaaaagttagaaccagagtaaaacatgtatgcccctcaggatagctgacagtaaagcactccttttaaccaatattctttaaatagtaattcagtctttatttcaaggagaattgtggccttcatggagggaagattggagaaagagggccactggtcattggggttggtctccccttgcatcaggctctttaccttgggcctcaaacttggcagaagctgtttagggtttaggccttgcctttttcagatggcggtctggggtcagcttgtttacctgaggcaagctgcctagagatttgccctgccagcttctctccttgcctccatctgtcccatagctgacttgtgcagatattcattccaaacacttctattatagtccttaagaggaaagttctggcaaatgctagaacttctttctttatctccttttccttctattcatcctttatttccagggacattttagcatgccatgcacattggtgcccagggcagttgtctgactggcccgtctactgatgtagttccctgtacagcacagtgctagttggcactatattagaatatcagataattaaatataaacatctccatcttggagaagattcctatatgctcataaatgacaaaagaacaattagaaaatagactttttatgtacagaaaggcatacagaagttcagatggactatttaaatgctcagggaatatgaagaacttagggctaattagaggcaggtttctgggtgaaataatatattattaatgaaacttcctgtgcaaaatactgtctttttaaacctcaaatgggtgttatcctacagattagtatttattgttcagtaaagtatgaaaaaaacactttcaattctttgcttatctgggggtttactatcacttggttattcttgaatctcatttccctaaagaaaaaaatgaacaaaccaatgaaaaaagcaaaaccttattactatggcaactattcctaatgtattctttctttcttttaggtaaaattgttaacatttaccaatgtaaaatattttggaggattctttatggaaaatacagacttccacatttacatttcattgaggaggattttaatgtttattatttaatttctaggataaccctattggcaactgggatggaagatttgatggagtgcagctttgtagttttgcgtgtgttgaaagtacaattctattgcacatcaatgatatcatcccaggtatgttttctttgttttatacatttataaggcaaactttattttttaattttttatttttttatatcaatatgttttgggggaacaggtggtgtttggttacatggataagttctttcgtggtgatttctgagattttggtgcacccgtcacccgagaagtatactccgtaccccatgtgtagtcttttaccccttgccaccccccattctttccccctgagtccccaaagtccaatgtattattcttacacctttgaatcctcatagcttagctcctacatataagtgagaacatacagtgtttggctttccattcctgagttattatacttctcttagaataatagcctccaattccatccaggttgctgtgaatgccattatttcattcctttttacggctgagtagtattccatggtgtatgtatatatatacacacacacatatgtatatatatatacgcatatatacatatacacacatatatgtatacatatatacacacatatgtatatatacacacatatatacatatacacacatatatgtatacatatatacatatatatgtatatatacatatatatgtatatatacatatatatgtatatatacatatatatgtatatatacatatagatatgtatacatatacacacatatatacatacatatatacacacatatacacatgtgtatatatacacacgtgtacatatgtgtgtatatacacacgtgtacatatgtgtgtgtatatacacacgtgtacatatgtgtgtgtatatacacacgtgtacatatgtgtgtatatacacacatatgtgtactacattttctttatcgacttgttcattgatgggcatttgggctggttccatatttttgcaattgcagattgtgctgctgtaaacgtgcatgtgcaagtatctttttcctataatcactttttttccttgggtagactcctagtagtgggattgctggatcaaacgctagagctacttttatctttaaggaatccccacactgttttccacagtggttgtactagtttatatttccaccaacagtgtaaaaatgttcccttttcaccacatccatgccaacatctattcttttttgattttttgattatggccattcttgcaagagtgaggtggtatcacattgtggtttcgatttgcatttccctgataattgatgatgctgagcattttcccatatgcttgttggctatttgtatatcttcttttgataattgtctaaaagtgggctaatgtccttagcccattttttgatgggattgtttttttcttgctgatttgtttgagttctttgtagattctatatattagttctttgtaggatgtatagattgtgaagattttctcccactctactgattatttcttttgctgtgtagaagccttttagtttaattaagtctcatctatttatcatttttgttgcatttgctttcgggttcttggtcatgaagtctttgcttaagccaatgtctagaaggatttttccaatgttatcctctagaatctttatggtttcaggtcttagatttaagtctttgatccctctataaggcaagctttctaatatatattttgagtacataaatgtaagcttcaagatatatttttagaacttgacttttatattatggaattgttattaaataggatatcctttaccctcaaatgaaaataattaagatttttgtttccagacgtatatgagtataagggtggcattaatatgttttcattcactttttcatcacctgtccattcttagtgggggaaaaacccttcctgttaattagaaggatcggaaaatgtaataaactgctacctgagtgagagcttggtttaaactagaaggctttacacagacattggtcatctaatctaatctaatgtactgtggagaagattcttgctggataacctgtgagatcccttttagttttgagaaggtgtgattgatcagggatcaggactctagtcagaaatagattgctcaactttacatttagaagaaaaatcaagcaatcttttattttgcctctaacaagtagcacctagtgtctgctgtcaggtaattgacaatttctgttgataacagcatcaacagtttcatccccctgctgttagtggaactctctgtgatacaggctagtgcaataaagccaacagtggcagtcagagatggtgattctcattgagcattatgcaagtctgattaaaatgtcagaaggcctgcaggcagactgtagccaggaatgtaccaggccctgagttagacgacttaatacttttttacattcttaacaaacttataatgtaagtcttaatgatccccatttcgctgataaaaagctggggctcggatggacaacaattaccaaaatcaaagtaaatagtagagccagaatttaaatccacacctgtctgattagaaagctgtgctcttttcagtacctccccaccccaaatcctatctgtatatttaggatgtgaagacctgcatagaaaaccatacttctcagtctcacatgtatacttgggaatattgtttccatggagatatattttgtctctaattctataaaagctgaattttgctatagcaaggatcacaattgaataagcaaactgaattgtttttttttcaggtcatttcaggtcctcagtttcttttgttgtaaaaatgaaagggctaatactagatgattcttaaggttccttttagcgtgcactgtttgcgcttcctgttttcctgttgctgaagcaagtaatcaatgcttgtttttcaagttagggcatgctttctgctttagtttttagctttacagcaacagcacattaatttagttggaggtataggattcaaatgatagctttatttcaattttacttcttcaaagtgtgacatactttgctttacttgatgtttgtaaaatcaatttttaatttattgcaaattgaattcctagctattttttattttgcttccctttgggaacaaatgatttacattcaggaaaaagcatatatgtgcttgatattttacttggcaaaatttaatttagtttttcatgatttttttttttgagacggggtctcgctttgtcgcccagggtggagtgcagtggcgtggtctctgctcactgcaagctccgactcctgggtccacgccattctcctgcctcagcctcccgagtagctgggaccacaggcgcccgccaccacgcccggctaatgttttgtatctttagtagagatggggtttcatcgtgttagccaggatggtctcaatctcctgacctcatgatccacccgcctcggcctcccaaagtgctgggactacaggcgtgagccactgcgcccggcctagtttttcatgattgttaatggagataatacaatttattttatgaattaaagtacttttaaatattataataaatgcttatggtttacaaaacagtttaataaaaggccattccttcattcaaatattattaagcccttacctagatgttggggatatagtaggaagcaaaactggtaaaaattcttctcgtgtggagttttcattctagtgagtggagacagacagtaaatatgtaatgtgtatgatcaattacatgataataagatgaaaaatgataaacacagtgaggaggaagggagcactaggttgtagggcgggatttttcgatttcatgtagggtagttctgataaaccttctaataaggtgacatttgagctgttgacatgaaggaagtttgggagagaacatgtggattccgagggagagcccaaggccgcagccagcgtggccagtttgagcaatgtgaagagttgactgtggctgcggcagatggagtgagggagaaagttgtaggagccgcagtgggagctggaacaggtagtgctcagtgggctgttgtgtggattcttggctttcatagtgacagaggtggggagctataggtgggttttgaacaaaggacaactcaccctaatttgcatttttaaatgatctctctggctgcctgttaagaataaactagacagaggacagaaacagggagaccaggaaggagactgttgtagttatccacgtgagagacggtggtggctgggactggggtggtatgaagaggatggtaagtgaaggatttggatataatgtaaagatcccatcaagatttgcagatgggttgggtgtgaggtttgagagagagaacagaatcaaggatgattccaaggtttggactgagcaactggtaggctggagaggcaatttacccaggtgggaaagacaacaggaagagcatgcgtcggggagtgggagttggaagtcaggatcttggttttgatcatgttaaaattgagttagctattaaacaatttcatttgaatgtttatgttaatattatacgaattcatgtttaatccttaaaaatgggcaatgtgctcatcattttcatatttaagaaacttttggctgggtgcagtggcttattcctgtaatctcagcactttaggaagccgaagtgggcagatcacgtgaggtcaggagttcgagaccagcttggccaacatggcgaacccccccgtctctactaaaaatacaaaaattagccaggcgtggtggcggtcacctgtagtcccagctactcaggaggctgaggccaggagaatcgcttgaacctgggaggtggaggttgcagtgagctgagattgtgccattgcactccaacctgggtgacagagcgagactccatctcaaaaaagaaactttttactgtagaatgtatttgcaaaagtatatataacaacatatattaagaataataatgaacactcatgaaactgaccatctaggttaagaaacagaacattagaagtaccttgaaaaccacctgcaataccttgttttcattataattgcaatctctccctagaggtgaccattattctgattttttcattaattatttccttgctttttataatttaattatatctctgtagctaaacaatatactgtttagcctgcttttgaacttaatgtagttaaaatcttactgatttttaaattacttgcatcatttacttaaaatgtattttgagattcttttctgtggatgagggcattagtagtttgttcactctcactgcttcatagtatatttcgtcatgtgactatcccacagtttggtgcccattgtaatattaatggacgcttgggttttaggttgtttccacctccttttccacacttggtactgattaaaatttttgccagcctgacagctgagaaatggtatctcaaggtggtttaaaagtttgtagttccctgattacaagtaggattgaacagccttttatatgtttatacaacatttgtgtcttctattaaacacgtattttttgcctgtttttctgttgagttgctcatttattgattcatgagttctctagttttagaattttaataaaacatcttttaatgttttgttatgacattttaaacagaaaaactgaaaattttatattgagcatccttatgcatatcatctagatcctacaatcaacatcttacttgctttatatgtatctgtccacctctctattcacgtacttatccgtcacgttttcttgtgcatttcacattaagttgcagataccagttcacttcctcctaaatacttcagtgtgcatctaattaactagagataagtatttagggttttctttttcatttcagatagaagtcacacatataatgacatacatatggatttatttgggttctaactaatatatatatacccttgaattagaaacctctatcaagttattaaaacaattttaagaagaaatcattcatgtatctcaaatcaaaattaaaaagtacaataaaatatctcatttccatttttatcccctctgcctcagttgcctgcttactccatccttcgtttctcactagtcacagtttttatgaatttcttatatatctttccagtgtttctttatacaatataaatattcttattcccccttcccttttaattcaagaagtgtagtagatacactattctgctgtttgctttattctcttaattttatatgttagaactctttgtatatttgcaaacagaggttcttgttttttatagtgtataattttccattgtacggaaaaaaatttcataatttatttaaccagtttcctatcaatggacatttgggttgtttctgactttttgatattgcacacaatgttaccgtaacctgtacatgtctgtttcccacatgtgctagcatatctggaggatatatatattcccagaagtggagttgcttgatgaaagggcgtatgcgttggtattgttctggatattgttaattgccttcagtcgtagatataacaatttatattcctgccagtagaatacaagggggaacttatagctttcccatgagagtgtgttactaacttttttcccaatctgatagataaaaaatatatttcagtgtatataatacatttgcaaatagaaatttgcatttctctgagtgatgttgaacatttttgcatatgattaagggcaatttttctttctgtgaactgtttgcatctgttgcctatttttaaattgggttaggttattggccttttttctcactgatttcttcatgtgttagggtggcaaactcttctgtgatgcgagatgcaaatgttgcccactcttccaccctcatttgtcatttgtctttttttaaaattgcttatttttctggtcaccctcatttgtttttattgtggtaaaatatacctaacaggatgtaccattttaacaatttttaagtgtataattcagtgtaagtatgtttacagttgtgcaaccatcaccactatctatttccagaaatcttgttcattatcccaaatagaaactctatactcatgaagagatagctgccggttcctctttccctccagcctctgctcatctctgttctctgctctctgtccttatgactttgcttactctgggtatctcatattagtggaatcatacatatgtcctttggagctggtgcatttcacttggtgtgatgtttttgactttggtgctttttgccttgcaggatttataaaatttttatgctgttgtattcttttagttttaatagattctggattttgagttactgtaaggttataaaggaatttccctgtgttttcttctagtactctgtggttttagtacatatctctatatctatctatctatctatctatctatctatatctttgacccatttctgttttatgtggtatatgatgtgaaatataaatccaatctagtttttatttttgcccacaggtagaagataccctgttgtcttagtatcatttattaaaaagtccctctttactggtttgagaggccactttcatcatactaaatttccacgtgtagcgtggtatatttctggactttctattctgtcttcccacgtttcaataccacattgttcttaatgatttttaaaaaattgtatatattcatggggtacaagtgtaattgtgctacactactgtattgcattgtggtgaggtcagggccttcagcacatccatcactggagcaatgcacattatacccaccaagcaacctcccatcatccaccccccgccaccccaagccccctttattcatctttccacactctgcttccacgtgtgattctttatgtgttttaatattattaacactagtctcctctcactgttcttttgaattttcctgttctatactgttttcaaaatagtagtcttcttgatagttttgcgtttttacatttaagtgtgttattcacttagatttggttttgaacaggatatgaaatatgggtacagatatccaatttgaccttccatgcttgctgcgtataaatcaagtttccagatgtacacgtgtggatctttctgagccctgtcatttccctacactaaagcctatccatagctttagaagtcttggtagctgtgagagtacatttccattgtttgttttcttaatgaatgtcttggctattgttagcctttgggcttcattgtaagtttaactatcagcttctcaaatactataagagagttctgttaggattttggaattgcaattaatctgtagaacaattggaggagaattgacatttctatgatattaaaacttctaatatataaaccttgtgtatcctttcatttatttaatttccttttggtaaaattttataattttctccatgaagagcttacttgcattttgatgcattataaagcatattttctaacagtgtcatgctgatgtagaaatacaattgactttttttttagaaaacagctttactgagatctagtttataattcactcagagtgtacaaatcagtgcattttagtgcatttacagacatgtgcaattgtcaagataattttagaacattttcatcacctctaaaagaaacgctgcaccccttagtgatcatctcccaaacccttcatccttgtttagtcctaagcaactaccagtctacttctgtctctgcatatttgccttttctggacatttcatttaaatggaatcacattatatgtggtcttttgtgatttacttttttcacttagcataatgttttcaaggttcctccatgttgtagcatgtgccagaatttccgtccttcttaaggcagaataatattccattgtatggacacatcacatgttgtttattaatcagtagatagatatttaggtttttttttcaccttttggctaaaatgaataatgctgctacaaacatgcatgtacaagttgttgtgtggacatatgcttttgtttctcttgggtttatatctaggagtggaattgctgagtcatatgataactctatgtttaaccatttgtggaactgccagactgtttcccaaagcagccacaccattttacattcctactagcagtgtgtaagcgttttggtttcttcatgtccttgtcaatacttgttattatctgacttttttattctagccatcctagtgggaatgaagtcattttcaattgactttcgtgtgctgatttttcttacaaacagacttactaaaatatcttattcacaatccatggattacttataaaatattcagtcattatagtttgcacataataacagttttgcctcttctgaattcttttatttttaaaaatggtttcttactgtcctagctaggacctctaaatacaatattgaatagaagtagtgatggaaggcatcttggcctttttttctgatcttaaagaaaatgctttcaacatttcattattaaatgtgatgtttgctatagagttttattgttgtatctgtcatttatcaggttagagaagttacctactgttcctagttttctaacagttttatcatgaattgatgttgaattttatcaacccctttttctctattgagataatcctattttcttttaatctgctaattttcttatattgaatcaaccttacatccatgatgtaaacccaacctcctcatgattcatactttgcttggtccagtttgctagtatttgcatcctgtttttaaaatctctgtttataagagatattggcctatactttttcccttttagctgtccttgtctggttttggaatcaaagtcgtgcttgtctcataaagtacctgggaaaggtttcttttattttgttatttgaaagagtttatgtgagattagaattacctattccttgactatttgacaaagcttctttttgtggaaatgtttagctactgatgaaatatcctttaacatttgtttgtttttgattgtcttttgcaagttttattttttatgaatgtatccatttaattcattttcaaagctttgggcataatgttgtttataaaagcctcttaattttctgttcaacctcagcagcatctgcccttgtgttcctattttcatccaaaatgttaatcatttgtgctttcttatattcttcaccaatcttaccagtggtttctgactttcattttttcaaaggaccaacttttggctttcttaattctttctagatatacttgttattgtttaaaatatgctactatttttactgtgtaactagtgcattttttaggtctaagcccgtagttctcagcctgggatgcttttgtctcctggggacatttggcagtgtctggagatttttgattgccacatctgaggtgagagtactactggcctctaatgcatggagaccagtgatgcttctaaacttcctacagtgcacagggcagccctacacaacacagaattatctggttcagaaccttagtagaactgagcttgagacactgtgtcctaagcaaattctaggagttatgctcattttataatgttaacttgctggatagctatgggggaatcacttgaaaaacaaattttctttcattatttatgtattcttgcagggataaccaattctatgctaatattgtttttcccagagtaacatggctaaatgtaatttcacttgtcttacgaaatcaaatacaggcatacctaattttatagcgcttttctttattgtgcttcacagatatgtgttttttattaattgaaggtttgtggcaattctgctttgggcaagtctgtcaatgccatttttccaatagcatgtgcacacttcgtgtctctgtgtcacattttggtaattcctgcaatatttcaaactttttcattattattatatctgttatggtgatctgtaatcaatgatctttgaggtgactattgaaattgttttaaggcaccacaaaccacacccatataagatgacaaactccactgataaatgttgtgtgtattctgactgctccactgactagtggggcctctgtctctctcactccttgggcctccctatttcctgatacccaaaaatattaaaattaggccaagtcataatcctacaatggcctctaagtgttccagtgaaagagagagttgcatatctctcactttaaatcaaaagctagaaatgattaagcttagtgaggaaggtatgttgaaaaccgagagagactgaaaactaggcctcttgtgccaaagttagctaagttgtgaatgcaaaggaatatttcctgaaggaaattaaaagtgctactttagtgaacacatgaatgataaaaaagcaaaacagccttattgctgatatggagaaaggtttagttatctggatagaagatcaaaccagcacattcccttaagccaaagcctaatccagagcaaggccctaactctcttcaattctgaaaggctgagagaggtaagaaagctgcagaagaaaagttggaagctcgcacaggttggttcataaactttaaggaaagatgtcatcaccataacagaaaagtgcaagatgaagcagcaagtgctgatatagaaactgctgcaagttatcagaagatctagctaagttaattgatgaaagtggctacattaaataaaagattttcagtgtaggcaaaacagccttctattggaagaagataccatctaagactttcatagctgagatgagtagtcaatgcctggcttcaaagcttcaaaggataggctgactcttttgttaggggttaatgcagttggtgactttaagttgaagccaggattctgaaaatcccaaaatccttaagaattatgctaaatctactctgcctgtgctctataaatggaacaacaaagactggatgacaacacatgtgtttatagcatgcttaactgaatattttaagtctactgttgagacctactgctcagaaaaaggattcctttcaaaacattactgttcattgatgatgcaactggtcactcaaaagctttgatggagatgcacaaggagattaatgttgttttcatgcttgctagcacaataactgttctgcagcatatggatcaaggagtaatttctatttgcaagttttatttaagaaatacattctgtaaggctgccatagatcaggattcctctgacagactgggcaaagtcaattgaaaactgtctgaaaaggattcaccattctagatgccatcaagaacattcatgatttatgggaggaggtcaaaatatcaacattaacaggagtttgggagaagttgattccaaccctcatggatgactttgagggactgaagatttcagtggaaaaaataactgtagatgtggtggaagtagcaaaagagctagaactagaggtggagcctgaaaatgtacttgactgaattgctataatctcatgatcaaacttgagcggatgaagaaaggaaaagtggttcattgagatgacatcaactcctggtgaggatattgtgaacatcgttgagatgacaacaaaggatttagaatattccataaacttagtaaagaagcagcagggcttgggagaggattaactccagttttgaaagaacttctattgtgagtaaaatgctatcaagcagtatcacatgctacagagaaatcttttatgaaagaaagagccaacttcattgttgtcttattttaggaaattgccacggtcactccaactttcagcaaccatcaccgtgatcagtcagcacccatccacactgaggcaagagcctccaccagcaaaaagactatgactccttgaaggctcagataatcattaacattttttagcaatgaaatatttttaaaattaaggtatatacattattttcaataacataatggtattgcacacgtaatggactacagtatagtgtaaacatagctttcatatgcactgggaaacaaaaacacttgtgtgacttgctttattgtgatatttgctttattgtggtggtctggaacagaacctacaatatctccagggtgtgcctgtgtgggtttgtgggtttcaattttttttttttttaatttccatagagtacttttgaaagctcaaaaaataattaaaaaaaaaagcattttagattgaaagtaaccgttctctttacctaccttaattgcatttctttgaattttacattttacaactgaatgcaattcattatactgaataagttaggagactagggaaatcattagtttagtattataatttaagattgagatacctgaactatgaagttggcttatgtataattgattgtttttctcagttggctgtagaataaatacttgaagtgctttctcccacacacacactctagagctgtatttccttctgtctattttttccacatctcaatttggtttgaaatgtaaattatcttgggttctacagtagcacttaaaaagcaaagcaaagaaaaaaaccaccctttctatttttcctggaatataacctgacaaggaattcttcattagtagtatttatcttaaaaacatttacggttttgttttattaaaatattggtggaggattgagataattaaaattagttacatgaatatcttgggcgtcacttgtcaggcacactttgatcttctaaatcagtagttatcattgtcattattgctggctcagagcagtgaagagaaagaaaaagaatgatatttttttttcttttaaagcttgattttcataaaccctcaataggagataattaagaatgataccagcatttataacataatacataaattacacttatttgtcaacaaaataaagcttgcaaatagactttaaaaactaaagttgtttaaatgaaaattaatttagtttacttaaatgagtcttcatctgcctttcatgtcatcattaggactcttttcttgaggggaaaaaaaagtcaaagtgtctcctttagttccttagtttctttttcttgcccaattaccttcatccgtgaaacaaaattaatatttacagcatttaaaaaagaaaaaagattcttttcagagcagttgaatggctgggaagcttaggaaagaattctttctagtcaattgcttgtaatagttggcttctgaaggatacctttgattgaaagatgcaggaatcttaaacctgttataaaattgtttctctcttatatttctgttctaaatggttaaaaacactgctaacatatctaatttgacattatgttcatgttcttgaagttgttatgatgaagcatatcaattagcaccaccccaaaattatacatttcggtttttctagttcaacctgtgtcttctgttctagttgtgggggttgggagtataatgctgtttttttgacgatctctacgatcaagatagtgaacatatccatcaccccaaaatatgtcccttgggatccctccctctgcctcttcctgtcctctcaaccccctacattcagacaaccactggtcttctttacatcagtatacacttgttcacatttttaaggattttacaaaagtggaataactcagaatgcattcttttttgtctggcttatttcactcgacataattattttttattcatccatgttgtcctttttattgttgatatggttatattagtttctatatccattcacttgttgatggacacttgagtttttttcagtttttggctattatgaataatgctgctatgaaaatttgtgtacgaatctttgtatggacatatgccttcatttcacttgggtacttacctagatgtggaatggctggtaatatcataggtgactgttaacttaaataaaacccccaaaccttccaagctgtgtttccaaagtggttgcattattttacattcccagaagcagtatatgagagatacagttcttccatatctttgccaacacttggtatgatcagttttttaaattttagtaacatctaattgtggttttactctgcgcttcattggtgaccagtgatatcaaacatctttccatgtgcatatttgtcatctgtatatcttctttggtttagtatctgtgaaagtctttggccgattattaattgtttctttatgattgggttttgagagttatttataaattttgaatacaaacccttttgcagatatatgctttacagcatttcagattattatagattcacatgcagagagagggaccctgtgtgccctttagccaatttttcccagcggtaacattaacatgttgtaaaacaagacgtgtgcaacatcacaaccagaatgttgaccctgatacaatcaagaagcagaacattcccatcccacaaagatctcttatcttgcccttttactgccgcacaaattccctcttcctcctgccccatccttaacctctgacaaccactcatctgctgtcgatttctgtaattcagtcatttcaagaatgttacataaatggagttgtacagtatgtaaccttttgagactggctcttttttcactgagcataattctctggagatttatctacattattttatatatatccatggattgttcctgtttattcctgagtaatattccatattatggatgtatcagtttgtttaactgtttagctgttgaaggacatctggtttgtttccagtttttggctattatgaataatgcttttataaatatttgtgtgtagtttcctgagtgcacataaatctttatttcttgacataattgtccaagtgcgtattcggtgatatttgcaaatttagtttcttaagaaaccgctaaactgttttccagagtgactgtactcttactttaccactggcaatatatgggtaatctggtttctctgtatcctttccagcatttgatgttgtccctatttttaattttagccattcagagagatttgtagttgtatttcactgtgattttgatttgaatttacctgatggctgctgatgttgaacatcgttccgtgtactcactgtcatctgtatatattctttttctttctttcttttttttttttttgagatggagtcttgctctgttcacccaggctggagtatagtggcgtgatctcggctcactgtaacctccacctcctgggttcaagtgattctcctgcctcagcctcccaagtagctgggattacaggtgtgcgcccccgagcccagctaatttttgtgttcttagtagagagagggtttcaccatgttggccaggctggtctcgaactcctgacctcaagtgatccacctgcctcggcttcccaaagtgctgggattacaggcatgagcccctgcacccagccttcgtatatattcttgagtgaaaggtgtcctcatctcttttgcccaggttctcattggatcctgtgcttttttactgttgagttttgagaagtctttatgtattctagatactaattctttgttcaatatatggtttgcacattttatttcccaatgtgtagcttgtcttttcatcctcttaatagggtctttcacagagtacaagatttttatttttatgaagtccaatttatagtttttcttgtgtgggtcaagcttttgtgtcaagttcgacaacttttgtttagctctacatatggaagattttctcctaagtttttaaaaattgaaatgtaatatgttgtgcaaccctcaccactatccagttccagaacattttcatgggaacccagtacccattaagcagttacttcccattgtctcttaccctgagaccctgacaaccactgatctgctttctatctctacagatttgcctattctggacatttcacataaatagaataaaagatatgtggcttttgtgtctggcttcttcagttaagcataatcttttcaaggttcatccgtatgatagcaaaatcagtactctaaccttctttatggttgaataatattccaataaatggatctgccgtattttgtttagccatttttcagtcgatggacgtcagtttctagtttttgactattattaaaaatgctgctgtgaacattcatatacaagttattctgtggacatctgttttcagttctgttgggtactccctaggagtagaattgctgggtcatgtggtgactgtgtgtttagtcatttgtggaactgccaaatggttttctgaaggagctgcaccatttacttttccagccacaatgtatgagggttctaatttctttgcatccttgttctctgttttccaaaaagtttcatagatttactttttacatttaagtctataatctattttgagttaatttggtataagttgtgagacttaagtagaatttttttttaaaaaatctatggatatctaattgttccatcactatttgttgaaaagactctttcttccattgaattatttttctacctttgtcaaaattcagttgggtatatttatgtgggtctatttcttggttctccattctgttccattgatctgtgtgtctgtcctactgcccataccacagtctcgatcactgcggctaactagtaagtcttgcaatctattaaactaattcctcctactttattcttttccaaaattattttagttattctagatcttttgcctttccatatgcattttagagtaatcttgtgtacatctatacaaaatcttcttgagattttgataggaattacattaaacctgtatataactttggggagaattgatatcctttggctagagagagcaaaactttggttggggccttcttttgtctatgcctattgatgtttccagggtgctgatttttttatctctaagtatgggataagaatgtagtcaagaagaaaacccagagggaaatctctgtgatgttatttcttaggtcttgaggttcctagctggtctaccttctcatctctacctttcaaagtcttcttatatttgttttatatattatgtctagagattttagttgtacttagcaaaagaaataggaagtacatctactttatcttcccagaagtagaagttgcaccttcctttttaacttaacaatagatattagagattatttcatattagtacataagttgtatacttggtcttttgtttaaatcattgaattatatttcattttatgcatgtaccataatttttgaaccagcctcctactgatgagcatttaggttgttttcaatcttttgctgttataaacagtgcttcagtgaataactttgtatctgtgtatcagttagcatgtgtgccagtataaaaagataacttcctaggagtagaattgctatgcattttacattttgatagacagtaatacatggctttcatagagattgcttgtcaatcggagtcaccatgaatgttgcctgtataggcagtactcctggtcctatgagacagttagagctggagccctgaagaaggataatttgaagcaccagatatcagcatgcaacttttggtgttatctatatggcaccttcaagcatttcttgaagaatttttcatatactattatggaaaatatttattctgagcaggaacccaaccttttagagatttttgaatagttgctatgtaggatatttctggcatcgggtttaataatacctcattctactcaagtaaactgtattttcttcacaagatttctgtggatgttaaattctcatttgagtctgaattatgctcttgtggctgctgatgttaagcggtacattaattaaacaatttctcttaatttactgggtcattcaaattcatagacatttcatttgatttgaacaataacttgttcactagtttattgttatgatttcctgctcaagattctccaagggatttttctttttctggttaaatcaacaagtgatggataagctgtgaattttatcatttaaatgcaatcttgctgtgtatacataatggatacttttggtttggtttcttttgctgaacacaatgtccatgttgccctgtttatcagtagtttgttccttttttattgctatgtagtattccattgtatgaatagaccataatttgtttctctattcttctgtagaatagcttgtttccagcttttgattagaatgaatagggctgctctgtacatttttactcatgctgtttggtggaattatcttctatatcttttaatatctttaatcaggtttgttttaatcacacaaaattgccagctgaatttatcttaccttgctttccatcccatatttatctttttctgagttggtaatcacttataattcatttaactttgaaagctttgcttcatgacccaagtagttttgggccatgaacacagttgtgacaaagtaataagaaatatttggtgtgtaattgctggagggcaattagaggtggtttgtgcccctttgtctgtatagaattctgatggaatgtcttcttcttcagagctgatatttgaccccctctcagacagcctttgacagaaggtagccacagtttccaactccagtgcccccctgctcacattcctaatctttggagctcctccctagtgtcacctgcagaactgtcaccaccggccatccagttggctctccagtcctgccaggctaccttcaaagcctaacaaagggaagagcacttgcttcatttgttataatggttactaactatataatggatctatatcgtggtatacatgtgaacatactttaaaaatgttatatgcagttaattacagttaatagtgggagttgtttttctttaggaaatttatatgctataatttaggaactcttctcagtgactaagattttccttctgaagtatctgtcatgggtgctatttaaagatatctgaatgacaacatcataaaagaacagtggtctcctctttcatcaagggatacttccaagacccccagtggatacctgaaactatggatagtactgaaccctacgtatactgtgtttttcctctacattcatgcctctgataaagtttaatttatatattaggcacaataagatattgaaaacaataatcagagaagagacaataataacaatatggcaacatcactactcgtgtacttcaggactattattaagtaaaataagggtgacttgaatgtaagcactgtgatactgcaatagttgatctgatgactgaggtggctactaagtgactaacaaggcagggagtagacacagtgtggagatgctggacggggatgggttacgtcaggggttatggattaggatggtgcaagatttcgttataatactcaaaacagcatgcaacttaaaacttacgaattgtctgtttctgcaattttttatttaatatttttggacagtggttgactgtgggtaactgataccgtggaaggtaaaagtgtggataagtggggaccacagtattagtacatagcttttctcttattatatcacttgatcgaaatcgtggttaattggtataatttttgaattaaaatattttcatattctattggatcatattatgagatgtttaagatatagtttaataacacatccccctcctctttcaaccatggaaaaaagttaccaagtatttacatataattcatttagtaaatttcctctttttttaagaaaagtcttttccttgtgtttaaaatgtaaaaattttcctatttctttctttctgtcctcaaatccactgtgggtgatatcgtttttgctgacacacagctttatcaggtatgactcctaagtgtcgtgttggactccacggatgtattgttgaatttttcaaaggaagaacttttcacactgcctcttctacattcccttgatcagtatttaggagtattctatgatcattgctgggctttaaggtctagagtggtctttgtattcaaaacaagtttgccacacttattacacctatatttcagaaataattgtgagtgttttcttcaaatatattattgttgtgtgtctctggctttctgtatttttaatctatgcataattctctatgttttcctcttttatatgtataagtgtttgtatacacatctgtgttattcttaacatatatgtttttaaaaacagatatatgttcttaaccagaactttctttcctaaccatgatacatattcctaaccaggcttttttcaaactgtgttcatgaaataatattaatctgagatgctaagcaaagtggcacaaaaatttttatcaataagtttattttgtttctccctgagcagttcacaatgcacattagcatattaaaggctctggttccgtgcagtaaagaaattgtttatctttgtttatctcagcatcttcaagaaatatttgagttcgaaacacttcataatacacaggggtgttctaagcctgctgatttgggaaatgctgtaaaaaaccgagtaagattttctttgtagtgttttaagagatcaaataaaattgactacaagtgattaaattttcaagaggttaaagcatttagctgaattgtattttgagagggtattttcttatagaaattacattttgaaatacagcattggttttttcccccatagtattatctttttcaatacttttgatggcctttaaaaggcatttgtaaaactaaaaattctgcctttttgtggaaagagggtttttttattttgttactgtcattccttgtttctcttctataagaatttgcctttatctttaaaaaacatgcttactgtttcagagagtgtgacgcaggaaaggaggcctcccaaacttgcctttatgtcaagaggtgttggggacaaaggttcatccagtcataataaaccaaaggctacaggtatggattaatagcatataacctttagtaatttgcataatgcctaacttgccatagcattaaaaaagattataagctattacttctgaacatgtatgtagactttttttctttcaaacatttttagtagtgaaactaaagtttgtatataaatactgttgcttaagccaagtgttcccagccttttttacctcaggaagagttccccatagggtcttgtgtgttttgctggtctataatcaaatggtttttggaactccttacttggaatatttgtatgtatagtttaggattgcaactgtgtaaaataatcctatatggataatgttatataggataaagtatactagaggttaattaaatggattttgctaactagatttggtacaaattaaatcccaaactgctaagcaaaaatttcttctctttcccagaagcttcctcacaatatgtgtggagcttacagctcttttttttgttagcttccacatacttcatagatttatagaatagtagttatacaagccaaagagctcattaaaaaggctctgagaatttttgttaactcagatgcgagttaggaaaagaatattttttcctcaattattacaattttggctcatttaaaaggaaattgtactttaagaattattttatgtgacattggggcctgggagacttaggattaattgcaggatatataggtaacagtcttttttatgttaacctatagatctatataggatagctcaaacttgctactctcacttaaatagaaacagactaaagattttcttaagctatggcatgttaattgtattgtagtagatcttaaagttataaaatgtacagctacctgctttaatttgaaaagggaaatcagcttttttgtgggttctggagagcccactgccctccactgtgtgtggtatgtccttgaattaatactgaggcagggtaatgtcatgaaatggctgtggcatagctacactcgccctctcacgtataataaatccaatctgtaagaaataatagtgcttgattttttcaaagacacaaggaatttgatgaccaaaaattccaaaatgtttaaaacttaactatttttaaatgtaatttgtgtattgatttatatatagaatttgaggattaccttcttttaaaataataggttaaatttgtgaaccaatgggtctatgaaatgaagctggagaatggtgattttgacatttagaaataagctgtggtacatggaacaatttcttaaagcagttcattttttttaaaaatgagtgggcttttcttttaacttactcctgtttccctcctatcttgacttttgggctgaaaaatatttttaatattgtcaaaatggttaccaaatttttaaaagctgaagacagttaaaaaacatattgtgtttatatacatttattggttatgtaaacagttattaacatcatattcataataatttctcttactaaaaaaaaactttgatgctatattgactttatttttaaatgaaacttttcttgttcctataggatctacctcagaccctggaaatagaaacagatctgaattattttataccttaaatgggtcttctgttgactcacaaccacaatccaaatcaaaaaatacatggtacattgatgaaggtaatcagtaattttagtgttctttataatgatcctttctttctaactcatcagagaaaaatggttttttatatcaatatttgtagtttttggaaacagaataagtagaccgctctttgtaatattgctgaactaaaatattgtacacagtttgaaccgtactgctgttaagattattaaaatgtttaagaaatgtattagtaatttgttcttttcctttaactgctgatctatttagggtggaagatttctgtctggttccttcctgacctctttaaagcactcccttttaaaaaattttatcttcccttggtcctgggacatcattttcacctagtttattctcttctttgttcatttgttcaacaaatatttattgagtgcttatgattgccaggcattcttttaggcatcaagatgaaaatggtgagaaaaaatagacatggttcatgccctttgtgagtttgcagttgttaagttgttgagatagaaattagtcaaacaaccacagacacagtagagttgccttggtggtgtgtgcagtgaaggtgcatgatgctgtgagaatacaccaaagatgatttttctcagggtcttaggggtgtttctttggggcagtgacacatgcttaggtttaccagaggagtgacagatgacaaagtgaaaggggctagaacttcctcgggagaagaaatagcatagggaaagtcctcctggaagaatggaagctagtgtttgccagggactagaacacagacagaggcatgacattcatgagatgagaatggaaaggcaaacaggcctgactctgtggtctcccagcctttagagttttgcctgccacatttgtttttaaggcacctggagctgattttcatgtaaagtatgagtaggattcctgtttaatttttttttaaaaatatggataaccaattatctcaacagcatttagtaagaagttcattcttttgtcattgatctgcaatacctgcctgtcagctgtattagtcattttaagaaaatagcttttggctgtggctctctttatcatgtgtttggtttctcttaaattacattctgtgtttgtgtttattctggctttgaacttcttattgtatgtttgttttctctcttctgttgtttctgttctttagtttattcttctctacttttttgagggttattctgttcttttaacttcccaagttgtatgctgagttcatatttagcttttgtttttttctgaaataagcaatgaagtctataaaattcccttataagtattaatttagccatgtttcacaaggattctttctttctttgttactttttctctcttttttctttattgttaaaacgtattatttcttttttgatccattagatatatagaagcgtttcttaaggttttcggtatctttttgtactgccttctcaattaattgtattttggacaaagactatcacgtatacgatacccgctgataatagatttttttggtttgaacagttgggtgccattgactgaggtgcataaatatggaggtggagagaggagcgagaacactgttggagataataactttgtgatgcctatgagagtactattaatagcagggaggtcaggtgggcagttggactagatctgtatataaatttttagaaatgtaagacagagtcaatatccttgaatacatttctgtaattaggaataattttttagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggtaatttaacttgacccaaaaatttcaatttttttctctgtgaggttttgtgcagatttcgccctattatatgctttttgacaaactgttatatttgtcagaaaagctatcactgcagaataattttctcaccatgttttctgacttccctttgccgcccctgaagcttgcgacccacttgtcctaatgttagttgatttatgttcaaggaatgaaagttgatttttaggccaatcgatttaggctccttatattaaacagaatttagtaaatcaagcaaatttgccatcagcttttctctttcttcttcagccccttcccctggtcagttctaataattatatcactggctttaaagttaatcaccatttttagagatcttttgagacctttgctagagggaaaggttttccctttagagatcaggagaacatatcatttgatattttgtaatcaggaaaggagaagttgagtatgtttaggatttatttagagatggggtctcactctgtcacccagactggagtgcagtagcacggtcagggctcactgcagcctcgacctcctgggctcaagctattctcctgcctcagtcacctgagtagctggaattacagacatgtaccatcatgcttggtaattttttgtatttttagtagagacagggttttgccatgttgcccaggctggtctcaaactcctggactcaagtgatctgcccgccttggcctcctaaagtgctaggattatgggcatgagccaccacacctggccaatttaaatatatttctttttttttttttcttgtttgtttccatgctagtgaatactatcttatggggcatggtggggaggcaagaatgagggttaaaataaatagccttctccttccctgcctgttttaatgcttgtagaaatggtgcgggaaagcccgtttaaccaggggaggttgaagcatatattctgaaaggaaatacaagaaggacttcatgctggattaaggaagtcacttcttaaatcagtagctgtgggctgaagcactgattactcaactcctttttcttgatgaggttctcagtacaggtgcgaagagggagtggtgagaaagggtatactagaaacaggtcttagaaaccttagttctttgtatactatctctgtaaggcacggtataatgcatattgaagcatttctttttcaggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttaggtatttggatgctttttgtttacttaacaacctggaatgactctaattctaatctcatatcatgttatattaggtgatggtgacagtgttttaatatatttcttgccaacgctcattaagctttaaatcagtaaaaatgttgcatggtgtataagaaagttgttttaagaggggacatcttaaaaaagtattaggacgtgcgtttgggacttataaagtgaataatagtgtggtttgtttttctcttcctgttgatgacagacatttagttttcagcaatactagtggtagaaattgaaatgtaaccttcttttttttttttactgacttccctcacagtgtcttgtttacagcagtgagtgtatcttacaaagaaatcagcattttagtgtaagaagtagatttcaactgattgctggaggacagctctcctcatcatgtgtaattggtggcagtttcctggtgctgttcctttccacttctacataatagtggaaaagcatcttggggcttcagcaggtgcaaacaggaaagccatctttatgaaaaacactcttattatgttgaaatagtactttggaattttcattttcttttcaaacttgaaagtgaagcaacttcagataaatagtgaaatatttgggaaacatattttacttgacagatgctttttacacataatactctaaagtgtgtttttaaatcttggaggaaatgaagttgaaaatgaacaatagcaatttttataagccaagtcaaatagcagttaaccaaagcctactttccacttaaagaaaaaattttgcatcaaaatacaaaaacattttaaaatgaaaaaatatttatgggaatacatattgtaatagtttaaaagaattcttttcatttactttttttaaaaaaatcttttcagcatttggaggctacttaagtgaagtagtagaagaaaatactccaccaaaaatggaaaaagaaggcttggagataatgattgggaagaagaaaggcatccagggtcattacaattcttgttacttagactcaaccttattctggtaagtttaaaaagaatgcaataggtatagatagtgccatgaggcagggacacataccggtgtgtgtgtgtgtgtgcgtgtgagtgtgtgtgaaagaaactgccatctgcctctgagtagagaaactggatgactgtgggtcaggattgaaagggagatttgctttttatgacatactccttttaagcttttgaatgttgtctcatgtttctgtgtccagaaaggtgaatgatattggtacaatggaatagatatacagagggtatctgggaaatctttgtgcatgtctcaaacaacataacttgcagtaaagccattggctgttatgtgctgtatttcttttagtaggtaaaggcagtcataaaactactgtctttaaaaaaacgattttcagtagcagcactgctgccctcatatatgcaattttttccaaagtggaacaacttaagattttttttttttttttttttttttttgagacagagtctcactctgtcccccaggctggaatgcagcggcacaatctgggctcattgcaacctctgcctcccaggttcaagcgattctcttgactcagcctcctgagtagctgggattacaggtgtgaaccaccacttctggctaactttcttttttgtattttcagtagagacgggggtttcaccacgttggccaggctggtctcgaacgtctcacctcaaatgatctacccgccttggcctcccaaagtgcttgggattacgggcatgagccaccacgcccagccttaacattgcaaggatctttaagctctggaaattgaaccaagaatctttaggctctgaggattgtagactgggctaaattgagagtagcctgccagttctgtagccatatgataagaattaggaagttaatatgggatgttaacatttttaaagtaggaagaagaataaagtggcggccattttatttgcagaatactttgacaaaaacaaaccttgtagcattgatataatattctttagatttcctgataaaaatctatattagctaaattttctttttctttgataacagcaagttactgctgtcactcgtttatttttttgagaaggagtctcgctgtgtcgcccaggctggaatgcagtgacgtgatctcggctcactggaacctccacctcccgggttcaagcgattctcctatctcagcctcccaagtagctgggacttcaggtgcactccatcatgcctggctaatttttgtatttttagtagagacggggtttcaccatattggtcaggctggtctcaaactcctgacctcaggtgattcacccgtctcggcctcccaaagttctgggattgcaggcatgagccaccgcacctggcctgttagtcactcataagtgattttagcatttaaagaaatttattaatgtaatagatctttgcaaaggggcatggggagagggaagtggggcactgaatagtgcttgcctcgggaagtcgtttccaaatgctgtcctctgttgtctgtttgtaatttgactgatatttgtagtctctctatcaacttttgcaaagaagttttctttcttaatattctgttggcacgttgttatcctttaacactgccaatctgccgtttgctttctcagtattattggtgttgtccttaacatggaaggatctgtaggtcctgatgattgaaccatgggtatcttcacaggggtcctggtacctgtgttaatgaaaaacacaaattgttatgttatttgttctccagactttacttattttcctcttctaattctgttaaaaatctgtttcttgaaaaatatgtttacagcatgaagaaaattatcctttttcttttgcagcttatttgcttttagttctgttctggacactgtgttacttagacccaaagaaaagaacgatgtagaatattatagtgaaacccaagagctactgaggacagaaattgttaatcctctgagaatgtaagtagaaaacaaattgctattttgcctttacatggtgttctatttgctgttttctggtatagtaattaatttataccttgtcttcatgtaataagagatgggtgaaaattagttcttatggtaaaatattacgtttttaaacctttggtccttgtacttttttgcttatttaatttcttaaatgtggccaaggtgtagaacatagcatattccatgaaatgatttaacctattttgctagagtaaactataatttagcaattgcagtatgtttaggaaagctaatacataatacttaggattcttatcttttgaaatagtttattccaacacttctgctacaagtaatcatgcttattagttaaattggtgtagtctagcttcttaaatctgaaagaaaaggagaaagggaaattctttatagaatagctagtgtttaatactttggactagcaacagatgagatgtattttagtaccatattttttggttaaaggaatatatttggcctctttccacctgccttaaaaaggtgattctttttccatttcctactttaggaattataaatatgtctttttatggccacaggaagcaatttgtaatggtacaagcacaagtgacaggagatatctagtaaagactttgaataagtggtagtagtgatatgtgataatgtcacattataaaatttaaactatgaagaattaggaccatagatcataaaacaaatttgttcattcaggaatatagagagaaagtgatttatttaaagtccatattaagataaatttgaatccttttatatactgttcttatttatcaattaaagtaaaaaatagtttgatatcaaatttgaaccaaaaaagcagaatactcaaatacaatgaggattccaaattatctgctatatcacatgactaggaaagtaaattataagagaataaatttcctcacttatatcttttgctttctttaaattctgtaatgatttctctaatgatcttactctttaagataattgtgaatcttgattttcacatcaactattttgtcttatgcaaatttttaaacatacgatttttttcccccaagtaattgatactggaacaagacaggtcaaacccgaaactctaaggcatgttaacacctccttcctagaagagaggaagaataaacattctttggatcctattgttcagccagttaagaatcatagttaatcacactttcttaccctgtccacggtaagaaactggtcagatgccctgttgtgatcaggattccctgtgtctgtagcattcatatctgtatatagctgactggttttatttggtgctgaaatctctgcttttcttcagagaccctgtctttttaaccttactcattttgtattcccagtggctgacaggttacgttactatgtaagtggtagattctcagtctgtattggttgcaggaaactaatgagtgaatgaatagtataaaaagtggatataaaattagctagttctgacttgtccttagtaaacttatggtagccgccaagttctcctctgaagccatttttagaattacaaatttaaagtgatattaaactgattgaatgtgtcttgcattcagacaaagaagagagaaaatgtcatcattatgccaattggtttgattgcagattttagattttcagtttcttataaattccctttcccatttcccttggtggctgtttcacacttcagtattaaaaggatattctctctcaaaattgtatattctgctttataaagtaaatgctttaatttcccaagcaaatattatttaaaaaatcagtcacagcaaacctaaaaattttttatcttagtgtatgacagttacttgtagagcatataatagtgtctaggataattctggttctagatctttaattttgcaaacttcaagaagaagcttatcattgttttcttcaaaaataattgtctaacctattgatttatgacatactggagttgtataagaaatgtgttggccaggtgtggtggcgcacacctgtaatcccagcactttgggaggccgaggtgggcggatcacttgaggccaggagttcaagagcagcctggccaacatggtgaaaccctgtttctactaaaaatacaaaaattagctggatgtggtggtgcacgcctgtaattccagctactttggtggctgaggcatgagaatctcttgagcctggaaggcggaggttgcagtgagctgagatcgggccactgcacactccagcctgagtgatagagtgagactctatctcaaaaaaaaaaaagaaaaaaagaaatatgtgattaagatgtgttatataatttaatacatgccaatatcaattaatagttttttactaacttagatatggatatgtgtgtgccacaaaaattatgaaactgaggaaaatacttgaaaaggtggaggctgcatcaggatttacctctgaagaaaaaggtgaccatcttaacttatatgcgttaaaaataactgaagagcatattcacatgtcaaagtattagctgaaatgtgtgtctgtgtagttggggggttttcttttaaattagaaatttctttttatgtgatatatggttagctcctctttttgtaaattcttcctctcttctaaaagtgattgatgatgtggaataatgaactcctttaagaagctggctggttctagtatattaaatgcttaaataaaaagtcctttcctttccacctagcaatgatattctcagttgtttctctcttgtggtgcagagttgcattgggttttctacattttcccactgagtcttccctgttgtaaaagggagttagaaagctgctaactaggattaagtttatagtcagggaacagtgttataatctcttcctagctaatgggcttactcaaagattcaccacctgactttgaatttgtcagcagcatactgtaaacagctgtaatgttcagaggcttgcaggaaaaaacagagcatacttcagattgtactccatttaccttaacccctccaaaggaaataacagctatttcattatgtgcaatgtgttacaccctttcaaatgtaataaactcacaacaaaattgaaacataatacttgattataacttattaaatgtcttttatgtttttcctttgtcaggaaaacttgaaaactgtgcttttaattgaaataatattggatgaatgaaactgaattcagtattaaaatttgactgttagaaatgaaaaataaaatgatttaaaaattttgcctgtgacttatttgatttttaaattttctcctagatcctgaggaattcttgaatattctgtttcatcatattttaagggtagaacctttgctaaaaataaggtaacctttaaattgttctagaagcattggaaaaatagacaattctcatttctactgccattattcaacagacatgatttccagaatgatttcttaatattgtatttgtttagggctcttaataggctaggggaatatcatgcaagttaattttatttgttgtccttgccacagtaccatagtttacttgaagatcaaatccaatgtaaatttatactacaatttttaaccctagcgataagtattattgcaaatcattttcttttgaaactgtatatatattttcataatttcaattaatgaaccttttaagaaaaaatatctcattctaacttaatcagacacttcaagaagactgttttctgtctactcatcactcaaaaaatttagtcttaaattagctttcctgtttttagttgtataactttgtctcccctccccacccaccatgttgaatgaaagccttgtttaatgtagtaaagttcttaatgaaatgttctaaatgactgaacgttccaggtagtttgaatgttctcagtctaaacaatggacctttttacattttagcttgggtttctctgttgagaatcttagtaatatcctatacacttccctaaaagctaagcatagacgagcactcttcctcatctctgtgtcttaaagtgatattgtttgatgccactgttgaactgatgggtgaggagaatagagggaggctgggtggtgccatggctgtggtttgatattgtttgggaagttcttatgaatgaaatgagactgatacataaccatcaagagttcatattatctgttcaaagatgataatagccatatgtacacctaaaaatcctagagaatggcctaaaaattactacaattagcaaaataattcataatttgtctatgtaaaatatccatggaaaaatcaatagcatttctgtataccttcaagcaaatatgaaaaagtaatttaatacttcatgaaagtataaaataccaagaaatcaattttattgagatagattttttttaaaagacttatacagagctaaaagggttttgattaattagtgagaaagattacgttctgggtaggacaattaaataatttaaagatgattacataataatttgcacacaagcaagatcttaacatacttcaggaaagtggatttagagttctctacaaaatgaagtgggaaaaaatcttgaagaatgcttttaaaatagatttctattataagctacgaaggcaaagcaatagactttaaaatagtgtgtgatactagcatatgattagaaatatggatcaatggggccaaatagaaagctcagaaatagaattaactgtatgtagaatttcagtatcttataagtcaactttcaaacagaaatgggaaaggaaagatatgtttaatacatgatgtaggaaacctagaaggcactttgggagaaaaaagtcaatttggtttttcattttaaagagataaatttcagatgcttaaaacagttgttttcatcgtttttaccctttttctagcctacacacttatggaatgtaatacacgcccagtaataacataggttgaatactgagtgatcctcagagtgggtagggagggatcagggcatctctgaatatatctcagagtctgaatgccttgtgggacttgaaagggccctgggaagttcttacaccccctgaagggtacactgtccccttcacccctgcaaacaacctcttcatattgagaatcactttttaaagattataaatattctaagttggctctttttcaagagtaattcttcccctccactagcatttcattttgacagacagagtcagcagatgcaacaaataggaggataagtaccttaaaaaaaatctaaaataattaaatagtctaaaagagactataagatgttcttaaatgattgaagagacaaaagaactagatgacaatgaaaggtaaaacagatttgataaacagaatcaaataaccaaagacagaatctccagaaatagaaaccatatcatgatgttacctcattgatgcagtgtgcacagctgaagagagaattgctcatttggaagacagagctgaggaaagtacccagaatgttgcacaaagggataaagagttagaaaacaagaaagagaggataatagacatggaatatggattctaactggagttccagaaggagatactagagagaatagggaaaaggcaatgtttcaacagataatagctgaataaattttagaatttttgatagactgaaattctaagaataaaaatattcagaatttctgagcaggaagaaccaggactaaattaccattcagagacttactataggatgtacttcagtaaaacaaaactgagtttagaataaaggagtgggatgcaagaaacaagggaaagtcaagaaattagtaaattgtcttctccatcctcatttctgccttctttccctcagtgtttgcaatgcagtggtccgttcaaccaccagccctcctcccctgctgccattattatgattacaactacttacctctactacttcctggtttcttattttcctctcttattttttttttcctgtaaactgttaattttctatgctttttggctttcacagaaaaattctggtcttttgtcatagtcatcaacaactgattaaaacattggtatatcatagccttcaggttttttgattatcatctgtttgtatttgttgtgggtctccagaatctcctgttttgttatcaattaaattttgtttatttggggatataagttgctttgggaagctgagaatttttgcaggctgatctctgaatagctgagttttttttttttaagtgaaaactatgttaatattttctcctaaaaatcttaaaatctagatataagtttagatgtaaatagtctaactttatatccagaaattctgctgaaaaggtaaatagtaaacttaaggattattagtccttctggtagagttaaagactaatggcatgctatagtaaaatatttaggaggaaagatgctcaaaatataagagtaacactgtgattggcatatggtaggtgcttacttggtatttgttgaataaatgagtgactatcagacagcatgctttagcagaaagaatggtaagcagtggttagggcccctagattctttacccagctctgcttttgacttgctgagaagtcattctccttccctagatctcagcgccttcattttagaaatgaaaagttcgatctagaaggtctgctaagggtctgtcacatccagcatataataatttattttcaggcattaaatacagtttgctgctttctagatttgggcagtgaagttgcactaagtgatttaccttttggttagttctgttcacacagtgcttcttgattgagattattattccattatttttttcctaatcactaggagaactttccagtctaaaaactaagcaaaataaatcatttataaggtcttgtgcctgagcacatttaattattttatccaaatcatttatttctctctgttgttctgactatccaaagctacaccatcaattttatggtttttctgttctcaaatactgctgggacaacttaacattttgatttaagcatttgataaataggttgtatgtatttttttctctgcgtgtttttagatcagcaggtcaaaaggtacaagattgttacttctatcaaatttttatggaaaaaaatgagaaagttggcgttcccacaattcagcagttgttagaatggtcttttatcaacagtaacctgaaatttgcagaggttagtgatactcacctgtggtattttatgtgaaagtctgtgggagtcttaagactattggtagtttcagtatctattgattttaactagctgagaaaagtttgaaacacaaactgttaagaaacacaaattttaaaaagtatgcagtgtttcaactttgcctttacagaaaatgtcttagaattaagattgaattttttggatttctgctgccaaagaaaacaccaagctaatctgcgtaacttgaaaacttttaggtagtttaaagcaaaaggagacttacgttttttaaaatgccattttatgcaagcatattatccaaatacatcaaaatataatgtttacttccccccttcattaagagacaaaatgtcaataaattcatttatatttgctaatgaaccagtgatagaaattatttttcttttattgtccaagaatctcagtaattttaatagtatatgcttgtggtttattttgattgtattcatttctgaagtcatttttggtaaaaccttaacagccacagttatttatttgttgaaatataatgagtagtatccttctgtgatgacattttctgtattatatttgcaaaaacaatctgtccaaaacctttaataaatataaacccaaataaaatgccatgattttatttgagactcaagattattgaactctgtgacctctaggtgctggtgtgcccctgcgatcatgagccacttgaagacttgtggcttattggtgtcctctgtccacagcccatggtcacgtgtggatcctgtttcataggacaccaatattaaggcagaactgttttgtttgacagccatgactattttggtttcatagggaaaagtgttttttttaacactttgattctaaaaatatctgtcttttttataggcaccatcatgtctgattattcagatgcctcgatttggaaaagactttaaactatttaaaaaaatttttccttctctggaattaaatataacagatttacttgaagacagtaagtatgagatttttttagtttgttttgttggttttgtggaaattgtcagataattctcatcagttgtgggttagactctaactggacacagtatttcccaaggcaattcagtatctgaagagcctggaaatatgaaaccagtcattttatttctaggaatttattctgagaaaacacaaatgaaaataaatatttgatatgcaaatatacttattattatatgattaagaaattagaaacaacttgaatgttaaccagaggagaatggttaaatgagtgtgtatctaacaattaaactactgccattaaaattcatggttttgaagaccaatgtgtatgaaatggtcatgatgtaatattaagtggaaaggtaagtacgttgatatattctacaaaaggagccatatacacacacacacacacacacacacacacacacatgcatatatacctatgtaaatattcagtatgaaattattagagaaaattcataatcatattgacagtggttatcttctgccaactaaaattgtagatgcttttagttttctccattatactttcttgtatctttgaattttcatcaatgggtattttataatgaagggaaaaatactctaggagacactatttagaaaaactatttggtccaaaaaaatgtttttaaagatatttcaaatactaactgagagcttaagcagatggaagagaaagagacttttttgaagccatgaacattgtcctttttaaagcctaacttttctttacatcttcttcatgaaagaatgcattttttttaaagtcctcttaacttcccttccccttctcacatttcagctcccagacagtgccggatatgtggagggcttgcaatgtatgagtgtagagaatgctacgacgatccggacatctcagctggaaaaatcaagcagttttgtaaaacctgcaacactcaagtgagcttcccttcacttaatggataaacttttgttgaacagtaacttatttatagttgaaaacacaatgctcgttttggaaagttttttaaaatcataattaacggttaaaaattcacaataaaatggtattgcttttgccttttctgtttacttgagagctgttggtgaagtacttgattgctataagggatgtatttagtaagagtaaggaagcccattcacttgacacattgagtttctctcattaatgacatttttttttttttttttttgagactgagagactgagagagactaatgcccaggctggagtgcagtggcacgatctcggcccactgcaacctccgcctccgggatttaaatgattctcctgcctcagcctcccgagtagctgggactgcaggcgcctgccaccacgcccagctaatttttgtatttttaacagagacagggtttcaccatcttgatcaggctggtcttgaactcctgacctcgtgatccaccagcctcggcctaatgacattcttttcatggtccattttaggtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtactgaaaacgcctttcttctgcatgtggcacagggttctggtttgtagtgggacagtttgtagtgggatcgcctgttctgagtgatattttctgagaaaatcctttcaggattattctggtgacaacagtcttatatcttggattgcattaacaaccttgctagctgaactaaggaataatatgctgtgtttttttttttccttttttgagatggagtctcactctgtcacccaggctggagtgcagcagcgtgatcttggctcattgcaacctccacctctcaggttcaagcaatcctcccacctcagcctcctgagtagctgggactacacgcatatgccaccatgcctggctaatttttgtatttttagtagagatgggcttctgccatgttgcccaagctggtctcaaattcctggcctcaagtgattaaccctccttttcctctcgatgtgctgggattacaagaggagccagtgcacccagcctcatattgtgatattttgacatgcatatgctctttttttaaaaaaaagaatcctaaaattcttatttcagccctgagggatcttatttccagcttcgctgtcttctttcaggcccctctcatttttgtaggagccacggtagctgtttattgagcaccattaagtcattctacctaaatcctggcaagatggggattattcctgtttttctgttattaaagctgaggtttaaggggcttgaggtattgtagtttgtgtttaactcagtctttctgatctcagtgcatatgtttttttgtactaaaccatgttatcttccaattgccaaaagctgagagcagaagtaaacatccttttcagaaaagtaaagcctcttctgcatgtagtatctttctccctgaagtggggaataggctgcagttgccaggccactttctaggatgcttaatcattatttaactaatgcttaatgaatgccaggcaggatagtgggttgtaggtaagaaatgtttgttaaagcagccctgcctctacctataaggagtttgcaggttaagaccaggcctgggcaaggttgtgaggtgtgactctcatgttcctccattcttataccctatttttcctttagctgctctctcagatccagcccccacggccttctggtgtggccctccagtagcctaagacattccctgtggcagcctcttgaacagaggcccaggccctagatcaagagttctccaccttttctcagttctctgatgcttgagggatacatcccagccccatctgtagatgtgcccccaacccagttaacatttgcactaaacagcgtaacacaacagcataggtttggaaaagccactgaggtaacccagaggagcctttcctggaatctctgaaatcacaccccagagcaccttcatcagggcctggtgatgtgtcaaacaaactgtattagagttgcgtaaggatgtgtttaaagtgtagggagctataatagcgttcatttgactagatctattccaaattggacagtcttatggtgaagtgtgctgggtggcttgtgtctgggaggaaatgaaatgtgaggaacagagtgtcgtctacatatgtattgataatatgattcagagagaagtctggaaagtaggttgggggcttacctcagaattcgtgtccttttaccaggtttattcactgttggccccagaatcctttcagaaaccaagaaatgagaatatgtcaagggttaaaggaggctttcacttccagaaatcagaagtaaaataaaggcttttagagcctgaaattagctttttggaaatgataggattataaaatcactggcaaaagggtttagaacttgactgccctataaagagttcttcctctgtgccataggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaa

SEQ ID NO: 38730 - DNA, 7900 bp, Homo sapiens
atcagcgggcgcggagccggaagtgttgtggccgccgccgccgcgcgtcgcggaggcacgtgtggagccccggcagcaggagcgtcgcaggtgagactccgcggggtacagggtggcagggcgcgggtgagggtgacccgggccgggcacggcgcgcagggcctgtccctccagcctcgcatgggcggcccccgccggcccggcctggccccttgttgcctctgcatcggctgggcggtgtttgcgtggacggccagctccgcgtccccagccccttactggggagccctgaatcctctgtcataccctgccacctagcccccgtgggggagactggggtgaggaatcaagcctggcttggaggtgacctcattgaccatttgcctctcccccgccggtggacacctcgcaaaggcgcttcctcatctcacatcttgggaatgggagtcaagctcctggagaagggtgatgggagggtcgggtcctcactccgggaatccttgggaccgaactccgccattgccaagcctcagtcttttcatctctgatttaggctcatagtccctgtctcttgtcctagaccaagaaaggcttcagaggccaggccagagtgcagcgctattgggctccctgtcaggcagtggcagagactgaggctgagctagccacaccccgcccatgcccactgctgggatgtaggcctcgaagccttctacctagaccctaggccctcatcctgcctcctgacttgctcatgcctacacacacccctccccaggtccttggcccttgccagacattagcaccatgagcttcgtggcatacgaggagctgatcaaggagggtgacacggccatcctgtcactgggccatggtgcaatggtggcggtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggtgagttcctcaggctgcctcagtttaacgcagaaattgacacaaaggtggaggtcagagcctccagcctgcccttcctacagacacatgtggctcctcagtttctattttcacatctttccgggatgctgacagcagggagtgaaggtggaggcagagaagcccgttaggaggctggtgctgtaactggagtgagaggtggtgggaaatggaccaggaggagctggggaggactggtgctctagtgagggtcctgcttgccttggtggggcgtggccagcttgatgcttggcgctgtcctaggtactgaccgtcaacctctagtcctccgtgctgatggtgaagcagagagagttgccccttctggaaagaggccagggctaccccgaggagctcactgtaggtggggagccttccccatcctcatccatgatcagatcctcacctgctaccaatgaatgtgagcaccattgttgagtccagggcctgggctgtgggaacccctgcacatatacaggtgctggggccgcccagtgtggcgattgaagccaagattggccccaggcgctgatgcatctaggttgttggtggcgtgttcctcccgggcaggagagctagggtccaggttcacgaagagtgcctagcactgccatgctggctttctgagggctgcaggtcaccatgtccctccctggggtgtctgggtgggaggggtggagagcaggacttagccaactccatcagctgctgctcctgtgcatcctgtggtgggtgctggcctctccgcccctgccccactctcgcgagagagctcaatcaagcagcaccttctcctggcctcctcagatatgccaggtcccctcctaggaaccgtgaactagagagaccaggttcctgccctcgaggagggggacacagcctaggtgagcatctcagtgccgctggttgctgtgaagcctgtgagacagggctgcgtgtctgaggggtacccagagtggggactctccagctaggccaggcagggaagacctctctgaggaggggacatttgagttgaaaatgatgaggagggacctacgaagagccaagggacagctctgcaccaaggaggagccgtgccgaggccctgcagttggagcatgctgccgagtcaggctcagtgggggaggcagaggggctgggagtgaggttggaggggaagcgagctccaccccggaggctaacaagtctgacttgccccttagtgggaagggggcatggccaggctttgcagaggggcgaggcagcaggctgggggcacccaggggaggggctggacaggtggggagaggggctggcccctgaaaggaatgtgggaggtggcaggacgtgggacgggatagagggagtggaggcacctccatgggtctggcccaagcacttgcgatgctcagcgctatttgggttccaggcatgggtggcaagtgtgcagtggctgctctagcaggagtctccagtggaggggcctggggatgggagtggcatcaggtagatggcccctgaagctggagtgggaggagggatgcaagccttgaccctctccataagacaggaagtcaagcagaggggccatcttgagggaagctggggagggaagctgggggcaggtgcgctggggaggactggggccgtgtggctggtggccaggccctgcgtcctgagtccaaccaggccagggcagagccccagcccctgtgtggtgggggcaggtttgggcaggcttggtgggggtgggctgtctcaaggggaccaaggagcttctggggagaggtgggcatgaggaccggcagggtgggccactgttgacggggattgaggaagtgatgggccatgcatggaataagacagggctgagtgatgggatggcctccctgtcccccttgcacagatttccccggaggctccaggcagctgggctgctctcattccctatacctgcgctaggcaggatagggcagggttgccactggcctcgcctgtgcccacaacagacagcacggcatacacagcctgtcaaccccagctcacccctagacagggtgcccaacccagggctagcctggggctttaggcagccaggaccatacagccctggaatgacgcccacctgtagcttggggtcctcccaagccctgtgtgggtctccagggtgaggtgggggttgtttcctgggaggctgtgggtcccgagcagtcccaactgatgccttgcccatcccttcttgtcctgccaggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggtgcatccggggttccgggagaggtacagcctgggtgggggtggggcaagggtgcaggactgagctcctgggatctcagaggggtccagagaccaagccacaccatggcagtggccaggccagggccccactttggcctgaggtgaggagtgggtcaggctggccaggggaggcagagctggggaggatggtccctggctgggccctgctcctggtctctggcctctcccaaccccctgatggaggaaggtggcagcgccacccaagtgcagggcaggcccggccggaggagtctggagtcccctccctgctgtttcccaaaacctctcctcccccaggctctggagcccagggagctggccccttttagggaagatgctgggtgcggaggcggggcagccctggggaaggtcgggcctcaagccagggaggtggctgggaggcccagggtttttcccttttctggagaaggagcagctcaggcagcaggggccccttccttcttcccagctgagagttgtattctgagagggttgaagggtggaggtgctgggcgccccaccccacctcaaagatgagccgaggcctggtgcgaacagcaaggctgtggccgggggtcccctgctggctccagcccagccctgactcctgggtcctggtctctgctgaggtgggtagctgtggggatctccacaccctgcctcctaggcttcctgctctggggacacttctgggcctggaccatagtcccagggaggctgaacccggcagagcctcccctggggcccccctgctgcctttgtgactccttcctccagcgtggctcggggaacccgcgcctgcctctgggacctgtccctttccctgcgagctcccccttctgggtccaaaggctcctggctcattcatgggcccggcatctcctgccggccacgggagcccgctggggaggatgcggcatgctcagcctctgtgccctgtctaggctgttgtcacacagcaggtgcctcctctaaccccgaacctcctggcggccccgtgttagggtacagctgaggagaccaaacctcagggacgtttgaggacacttgcctgggccacatacctctacccggccctggcttccccaggtcctccctgccaggacagggacccgggctgggttctcattcactgcaggccaggccaagtgaagcccgtggctgccctggtgggaggcggcagggaggggctgtcatgctcgggctctgcttcgagtaggcgcctcctgttcccgggagcagcgacagcctctaatttcctgtgacagcagcggcccccgcaccgccccacgctgccgtgctgtcagagctgctccgggcccagagctccagcagccctgtggaaggcaggagagcagtgcccgctgtgggccaagtgagacaatggcagcgcgggcttgacccggtgcctggcacatgggagggcctggcatggctaagctgggtgacatgaacagcggcgccaggccccatggggggctgtcagttgagggccaggcccctctgccctgcagtcccagctcttggagagcttgcagtctgtgttggggctgtcttaggctggcctcagaccctagggtgggagtccagggatgctagggccagacgggccaggctctgccacccctgccctctgaccctcgggtcctgtttcccacaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagtcctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttataggacacataggcctcaggcaccgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttc

SEQ ID NO: 38731 - DNA, 53192 bp, Homo sapiens; identical to SEQ ID NO: 36727

SEQ ID NO: 38732 - DNA, 23768 bp, Homo sapiens; identical to SEQ ID NO: 38693

SEQ ID NO: 38733 - DNA, 9733 bp, Homo sapiens
aatgagggcctccagggggcgggtcggactgccgcgggccggggagcgctctgggtggccagctgtgggcccgggccgtcgtgggctccggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggtcaggccagtgtgccgggcaggcgccctccgccccgggcccaggagcatcgctgcacgaggccgaggggttccgccgcgccgggctggggagcggggctccatccgccggggtctgtctgaaggttcgagccgggttagggcgaggagtactgccctggagtagagtctgggctgagggtgtagttgatttcactgggtcttgaggatctggggctctgtactgttgccaacttgagcagtaggtaaagtcctaaaggttcacttatcctcacttcgagctaatataggcgtttcggggcgatttgtcaatgactgactcggaggagggtggcccgctgcctgactgctctgcacggttaggaaactcatagtaaggacccactgtgagataggtactttcgcggacactttggggaggttggaagccattggcctactcgtgggtaaggtctagggctgtcgatggtggggagagggctgaggttgcccttgaggctagtgaggtcggaggctgatctcgcttggctcacggctcagggtgtcaagcatcatcctctgtggttgctacaagcaaagggttgggacagctgtcggctgaccttagtcgggatctatgttgtcggggaagagtcatgacatttggctttagatactcaagcacagggctgaatttatgtgggccagggcttggagaggtttgtggggaaaagaagcagccctggctcctgggccctgggctaactcactggctcagccttggagcccagggggccagggcaccagggaccagatggattaggccgggagagggaaggctgcagctaataagcatcttttccaagtactccacgtgcattcgccagtcttatctgagtaggggaggaggaagaggccaggcacaagggcctgctccttggccaggatggtcagggttggtggaaaactgggaaggctgtaccttttccttctagagagtgacttaggatacctgcatcccagttagagactttcagtgactgagtccctgcatgtccctagctaaaaagaggtgccagttgtgtgctaaaaataggtgccaggttctctgttactctaaattcgaaattactaatcatagtcattgcttacaatgatgagacaggctggtgtttggaaaagctttgggttgacatcctcttctgtggctaatcaggtgtaaaacttaagtcactcacctgcatttgaggataatgagacaatttggcaaagtttgtgttaggaagccaaagtaaaaattatagaaagtgtgtattattttacctggcacagaaagcacccggtaaatggtagctggcttcgtattagcacttgatggttttcaaatgtattttttcccagattatctagtccttaaagactcttggggataactgatcctccatttgctgtaggtgatagtggtggtgggtgggacctagaaagcatgttgagttgaggagtcgagagggcaggttcaaattaccacgtatatgtaatattaccatgtgttattctcatgacccttttgtcttccttgtcaactagtatgccaccagttactgggctcagttttatcatgtgcaaggcaagggacctgcagtcttccttcgaagacagcttctctgcttaaaagaggagtaactattttgcagtcttttgacagagaccttgcagggagtcccctgcaaattgccaatatggcactagtaaaaaagtggtgttgttatctcgcttagtatcatgtttcgagggtctttggtttgtgaatttattttctcttgtttaatataactggaaatgagatatgctggaatatagctagtaaacggaaaataggagcaaaaatacgaatatgtactgataacattttatttttctgtcttttatccacgtctggtgtctggtttctgagcttactttcttaagttttcaaacagcagcgacaggaatttaacccttacattccttgaccactgagtttcatcagattgctattttggttaataaacgcgttgcatatatattgaatataacatacctcttttattgattagaaaagtaaagattagtaagtattaacatttggactgggcagggtggtaaaagcacgttccccaaatggggattagttcagccaggttattaagactcttcccctcttccctatacagctttatttaccaagagcaactaacgggctgtccgatgcttgcttttgccagccgaaactatgtttgtacaccagatccaaggtcatttctagtaataggaacggagctcttgcaaaactggccttttgttggttcttatgccaaggagacctgaactttacaaagtgcctaaaccggaggaaaacattctttcctagttttgagtactgggttcccaggagtgtgatacagacacatcttgagactgtgacccaaggaacaaaggtgactatgaggcagcattgtgttctggccttctcaagaccttcttgtccttctctttttatctggagtgcacacagaagacagtcacaaagggatcaggtcccagtagactgacatcatcatttcctaatcctggtcttaataaaggaacttatgctcatggaagcaatgtagaaaacactgaaaagtttaaagaaggaaaatcacctgtaatttatggaaactattgtattaacatttagatctagttcctaacagtttttttttttttaacacattgagaccatgcttgtctatacatagtattttgccctccagagacgagggaatatgtcttatgccactgcctgtggtgctgtgtgtaccgcttatgcaaagcaagctttcagtgagcattttaataaataaataaatactgcttttatttatcattatattgcaaactctgcggccttaaaggcattataaacatttgctgccgatttagatcatcattgtagtccttgcatctggaacagtgacagaatagggactcaaatgatttgttgaataaataaccatatcctgttgttgaatgtttattaagcatttgaaaatacgctccaccttttcagtatcagggaattgaagacagtagtgaaacatgtcatgctggtgaaccttaaaagttggataacaagttgtgtgtatgtgcttgtgtggtgcacatgtatgctgcagatgggagtataaaatggtaccaacactttggaggagtaactatcagtacccagtcaagctatgggtgaacagagcctaagacccagctgcgtgactcctaggtatatattctagagagggggatctgcaaacttaccctagtaaagggccagagactaagtacgtcaggctttgtgggctgtgtggtttttgttgcatctattcaactctgctgttatatagcctgaagtcagtcatgggcaatatgtagatgaatgagcaggctgagtttcaataaaactttatttatgaaaatacagctttaattacgaagtagactggatttggcctgaagaccatagtttatctgtccctggcctagagactgacttctgcatgtgtgtgttaggacatgggtccccaacccccaggccagggatcgaggacttacagcaggaggtaagcggtgggtaagtgagctttaccgcctgagctccgcctcctgccacatcagtgacgacattaggttctcataggagcacaaactctattgtgaactgcacatgtgaggaatctaggttgtgcgttccttacgagaatgtaactaatgcctgatgatgtgaggtggaaccgtttcatcccgaagctatccccacccttccctggtccgtggaaaaattgtcttccacaaaaccagtccctggtgccaaaaaggttggggacctctgtgttaggatacctgtgttggcgcgttcattgcagcatggcttgcaataatgaaaaactgacaggaagggatcttggtctattagcagcagaccagataaataaactttagtcacatgatggaaagctaaactgtagttaaaatgaactagatctagatgtatttaacatggctgaatctcaaaaatacaatatttagtcaaaaagcaagttgcaaacacgtaattatggcataataccatttgtatatgtaaatgttaaaggcataaaacagtcccatatattgcagatatgtgtgcagtgcacttgtagctcctgggcaggagtgagatggcagctagagggtagaggccacctctggtgagggactcaggtagcatgtggttaagagtctgggcttttgtactcctggaagcctggatataaatcctggtttcactgcgctgtcactgtgagtttcggtaagttacttaacccttctgagccttagtttcttcatcttatgtaaagtagggataattgtacctgccttgtcagatttttgtaaagattaaataagattatttttgtaaaacgcttaaagagtatgaaactcagtaatccttaactcaataaatggtatatatatatatatttttttttttttgagagagtgttactctgctgcctaggctgaagtgcagggggcaatctcggctcactgccacccctgcctcccgggttcaagcgattctcctgcctcagcctcccaaggagctgggattgcaggcacctggcaccatgcctggctaattttttttatttttagtagggacagggtttcaccatgttggccaggctggtcttgaactcctgacctcaggtgatgcaccagccttggcctcccaaagtgctgggattacaggtgtgagccaccgcacctggcctgaatggcgttttcattactttagggtatacttaatcactttttcctgctttattttcctatgctttttctgttgcctttctcagaaaagcattactgtgaagggtgggtggtggagcatgttggtatggagagaatgtccacactgtacctggtactatgctgggagctcaattcatttcattccttagatatcatggaatcttcataatatgtgaggcgtagagtatattcccattttacagatgaggaaactgaggctaaaagattaacagatttgtctgaggctacatttacaggctagcaaaccagatctactgatccttaagcctgtgccttgcccactctgccccgtgccttgcttttcctctagtgagggtctactgatttccgtgctttcagctcagatcatcttatctcgacttaacgccattctctaaattagagaatatgaagaaattgtgactctcagaggtggtgtaacttgcccaagatcacagagtctagtaggtaagagacagagttggaactcatatcagattctgaagctactgtagtgaggttctaccaggaaaaataaaaagaaagaaaactatgattatgctgctctcgtaatttagtgtccaaatcaggagtaatgcccagtgttctgaatgtgatgaattttgaaaaataccttttgaaagttctggaagggaattttaaagtatcatttctgtactctttctgggttgatactttggaatatgaatttgtttgtatgggtttttttggtggagcattagatgcgtgtaaactgactttgtaagatagcctcctaactcccagttcctagtgttactctgccatataactttgcagtcagcattttctgccccagatggaatcaccaccgtctatcacatatgaaataatgattatcattaaaattcattcttggatgtgattttctaattttcaggagtagctctctgattctgagttaatttcaagtgatatttgtaagaactaccactgcatattgcagtttttgaaaactaaagtgtgagagagattaaccatgtgtaaacagttacttgtggatccgcaggattcattttaatattcaacttatgaagagtagtcttttattattattaggagtttctcacttcactctataggaagcaattgggtatttccttaaatatttaaactggtaatcaactttcttaaaaatggaaaagagcatagtcattaagaagggtgccaacgtttggccttgatgccagctgcctattacacctattcatctaaaaattaaagaagcagctaagtttaattttgataaaccgtcagctgctgtcaagaacaggcaggtggctcatgagaagttagtatcacttgcatgtggctgtgtgtgttgggtgttgagaatgtctgaaagcctgcttgttttgataattttggtggtaaggattctgggggtctccccttctctcgtagtcaggacatatgatcaacagcaacataaagtttaatcaatgaggcaagcccaatgcttcgattgagtgtgatactataaaagtgattgatgaaaagcaattttactttaaaaacatgtattttttgggtaaaacatgtagttttgggtagttctcaggcagcaaacatttccatttttggtgtgtttcagaaattatagacatccatcaaaataaatcagtaaaaattgattatcatggaaagcttcacacaatatattattcattgaaacaaaacaggtcgttcatgcacataaatgattcatttgtataaaaggtatttaagaaagttgaagataatgaaaagaagctcacgtttactttaaatatttcttaattctcgcacccagctctcagtcatcataaaggtaaaagttttgtaatcggcatcattgtaaaaagtgagttttgatagactttgtatttgaggacagagtttgaagaaagtaaaaaaacacacaaattatgctagttgtttttgttgatggagcatcaaacatcaccatgatgaacaacttgaattcatcagggtattctactatgtctagatatttggcattataaagacattttgatgattaatggaatttaccctttattggcagctgccaaagagctagctgttgtttctttactagcacccagagtggctgagaggtgtccttttggaggcctagagcaatgtaaccctttcttaatatgtgaagtctggagaaggaagataaagcccttggttcaggggctttctttagggctgtcatttagagcaaagtcagtttttttaataaggcaataacttttaagaaaaaaataaatagtatattgggacttgtgatataactgaaatcagtaattttatttggaaaatgtttgataataaattatagggtatcaagagcaagtttttgtatttttagtttgtttacataaaaatcgatttgtgtaaactgtactggacttgaacaatctgttgacttttccgttttgtttatccatatgctcattttggccatttaaaaatatctatctatgtaaatataaaagtgtcacataagtgttagttattatatgccatgctttgaccatcttcgtttttaacatgaccaatacaggctttttaatggccgactatgtttttgaaagcacagtcatctcaacatacaagtagaaaaggaagtagactgatgaagaggaatgttaagagtaatcttttatgtcttaagattgaagccacatttctttcttaccattttgttacagtcatcatccttgtggctcagaattgaacagagtagttgcacagctgcgctgtcacagagtgtccctcatctcatgtgtgtcctcagagccatttgcacacaggactgatcacatgcatgctggttggtttcttggctgctgtgagcgcttaagagcagagcgggtctcactcccccacccctcagccctggacagggaccttgctgagctctgggccttcattagactcaccagtcacttcgggttctgcacagagcctcatcatccactccacagagagcccatcacagtggctggatagatgggaactgacaacccatagctgtgggacagggatttttccctgggtaaaagtaattgttaaaaattaaaaaaaaaaaaaactcaacaactcatcatctcgaggagaagtgactgacggcctgcaccaacttagacagtcacagtcatgaaaagtgcacaggtgggattgcccgagttggccatgaattaccgtgatggatccatttggaaatgaagttggttgtgacatttcttcaagttttgtttcgcttgaagcttgactggtagatggagaattttggccttatgtatcttatgtgacttgcattacccagtccagtcctctgccattaatctaaggtccgcaatgtatcaggtattttactgagaatcttgcttacctaattctcacaaaaaaaaaaaccttgggagatgagggtggaaacaggatgagaggtcaggtgacttgtctgagggctgacggtttgtaattggaagagtcagggcctaaccactggtctctttgacacaaaaactcatgctcttagtggcaagcacagtgttctcaagattgggggaagccagggagggacagtgggttgtctgctactagtgggtcaaaattacatatttagtcatgaatggttcagcttttaccatttaaataacaaataaatgttctttctccataggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcgtgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtgaacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaattgc

SEQ ID NO: 38734 - DNA, 38454 bp, Homo sapiens
gagcggcagtagccggttatgacgactccctcctctggaacagccgccgtctcctccgcctcctcctcggtagttcacggctgccccggctccaggtgggactcccccgcaatctgcggagccttcccccgctctccttcccgccgccgcagcgctctgcgctgttcttgcccgggtggtagccgctcccggcgcggcttcccggagggctatagcctacgcacgcactccgcccgcgccttcccattccctgcgggccgggaggcgggcgtcggaagccgatcctggccctccccggccccgggcgcccggccccttcccagcgcccggagcgcaggcgggccccgggccctagccgcgttgaccaggtttccagccggggcggagccgctccccggggcccctcccaggcgcgctggggacccggggcgccgcggtgcacggtggcgggcggccccgggagatcaccgaccccgaagcaatccctggcggcgcccggggtccggaaccccagcgcggcgtctcagccgcggcggggtgctcgccactgacccctcagcccttggccgggactgacgttcaagcggacagctgggctctgccgggactgacgttcaaggggcagccgagcacttcctgagccctgcctggcacccgccgagagactttttggcacaagtaggggccagccgttgaggtgtcattcggggtctcacgtgttgaactttccatttgcccactgccgtctttaaacttttccaagctctctctctctgcgacattgccccatttcgcccgctgtgtcaaccccaggttttgcctcctatccatcatctttcagatgtttcccttttttccttcctcattaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggtgagtttagtgatggccagagctcactggaggacaatggacttggataaccaaaggtcagggcttggtcataacaatgactttattaccgggaaggacgagtcaaaaaataggaaggcctgggaaccctcaggctcgccactctaggtgggtagccctgtgattcagccagtgggattactgctgtgagaatgggaaagttgtttgcttctgggaatgtttgatccactaagtatcctgttggccagttccagtggatgcctgtagaaagtgggccacctcctcccgttccccattggaatctggtccgagttgctgtgttgggggtggtgcctgtgaactcgagtatagcagtgtggtattcattaaggaaaagaaagcgcaccaccggccaggccttctggctgagagttatcacgttacattattttctttcttaatatttcctttaattcacaacatcatctgaatgatcaggtttactttagcatccttttaaggtaatatgtttcatttctgacaggttttagagacctgaaacatcacagaagcttctgagtggttctgaagattcaagaggtatatatttttattacaagtagagtcattgttactattaatatgtgtttttaaatttttataaaactgctgtcaactcattcttggataaaagctccaagtgaaaatgttattgtaattcagatcagatttacagcagataacaccatactcttgagggccgccaaagtgaaaaaccacaatacttaactactccaaggggggaaaatgggggaaaaaggattcctttttggtgtccccactgttcacttagaattccatggccttggaacttgaggtttgatggaacatagcagtcaatttccttttcttctttctttctttgtttttttttttttttgagacagagtctccctcgcattacccaggctggagtgcagtggcgagatcacgactcactgcatccttgacttcccaggctaaagtgatcctcccacttcagctgggactacagctgattttttgtattcttagcagagaccgggtttcatcacgttgcccaagctggtctcgaactcagggactcaagcaatctgccagtcttggcctcccaaagtgctactattacaggcctgcagtctgtttctaaaggttccatcttcacagcccataatcaatgaagactgatttcgaaagttgggttttccggtatgacccaggaaacagcagtcctagctgatgaacatccagtgtgtattaagactctgtcatccagtggaaagagcacttaaaaaaaaaaaaagaacaaagatcccactaaagtgacctgagaatggcaggatcattgtctgggatatataggagaaatctggtccaagagatttaacacttactgggtgaattagaaatgcagtgaggtttctgaccattatcactgttcacaatgtaaaggcatgatgggagagcttaagggcacagtctttgaggcagactgcttagtgtcctggagtttctaagtcttagctattatagctgattattatacctactagcatgtaagcttcacaagggcaatgagtttagttcgtgactgcaccttcattgctgtatcctgagtacagaagcgctcctggaacattgtctgtgctcataccttgattatgattataattttttattcagcagacacacacttgctcagagccatcccactccctttgctctctcacagatacttttcccctcctcatcattcagatctcagctttaatgttatttaggccccttctctgccccacatggctttaaacttttatttaataaacatttccatagcatttagcatgtgccagatagttttcgaaacactttaccaataactaactcatttaactcatgacagctctatgatgaaggtttattattatttccattttacagatgggaaagcttaggtgcagaaaggttaagtaacttgttccaggtcttacagctgggaagctgcagatttgcgattcaaatccaggtggttaagctttaaatgttcaccatgctatgttgtctatcatattactttatttagtttcaggtatcactaaactggatcctatcaagcccttccataatttttgtaagttaaaaagttttattggaacacagcctcatccattcttttataatagaccatggctacttttttggacagaggcattgttgtgtagttgccacagagatcttatgtctggcaaagccaaaaatatttactgcttctcctttacaggaaaagtttgctggcccctagttggtttgattcacaggcccagtcatcagctgaagttgtttatttgattgcttgtttatgacagttgtagtaggtttaaaggcaccatgagagcaaggctctttcttgttttgttcacctctgtatacccatttgctaacgtggtgcctggcaccaagcaagtgctcaaaaaaaattgaataaaggatcattattcagtgggatagcaaagtgctttgtaattatacttagcccttgaccctttgttttttttttttttttgttgttgttgttgttgttgttttggcttttaaaggaaatttgttaacaaagttgtcttcattttgatctctaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataaggtaggtattatttcttttctccttatttttatgaggatgcaatttcagctggcttacaggttctgctttataacctgaaactgaaggcagaattctaattttcggttgtcactgtataagttaatcattgtttcatataatacttctaagtgactaaactgcttaaaattatgtcccattcataagagagaaatttaaaatctaaatcacttctaaaacaaataagtagccaatactatttgtaaactctgtaaagaagcaattagattttatgcaggaaagaacatcttgttaaaagtaactaaagaatttcacacctcttctttcttaaacggcacatgagaggatcggttagcacttaatttcagtaataacacctcagcctctgtctccacataattaagcctgttactgtggctttctttctgttttagaggagttggaaaggcctcaaataggagcccattaagacatctcacagggccccagagatcaaagctgggcattgtgagacacttcctttcccatggtgctggcacaggaagcatatggaaaagcagacttgggaatcagaccagcattgctcctggggccttgcagaagagcattctcaactccttggccagcagcagctgggtggttcccaagggtggcagagttgtccatgtgttgtggggtctctgctgatcttgattgctaagtgaagttgctgattgattcagtttagctgtgattcctttggtagcacaaattccagtttatatgtcttttagggactgattttagaatccgcttgctcactgagaaaggtggtttcttaagctacttcaagaaattcaaattcaagtggtctttgagcgtctaggtaaagcccagactttcggttaggggaccgatatggtgggggtgatgagtaaggaggattgttaagaaccttgagactgctctttttagaattaactgtaagttttaaatttattgttataagaatacgtattataaatgtaaatgtgaatgctctataatgatttgttttcttaatggaaaaatctaagagtcttctctaaatgtcagaagaagggaaatcaatgtaagttttatgttctagaaacacctagagaagctaaagtactgctggggttatgagaaatcctgcaaaccagagttcaggtttggttacccagtttgcagctatgtcgacatgggatggtaagtttccatatggaataccctcttcaagtcttcctctttctatacagtgtatgttgatgccctaatttccagctagattcttttggttttagatagtaattcatttagatattaatttgcttgcacagtcatgaattcaacttgactatttcatactgggataggaatatctgtcatttcctctgccagagggagaaacagccaggaccatagataattttttcccccagtgtatagtaagaagataaatggatggtttcttcttgattcttcctgggagaattaagtataattagtacttccaatacatgcaatgttaatgaggtaaagaaaatatagtaattaagaatgcatcattggcttcagtttcaggtgataacttcatacatgtctgttatgtattttatgataaaggaataattctgtgaataacttagtttcgtaacttcatgtagtgaggcgtagttttggaaaaactatgataatatactgtaacaaaattaaagtaataaggaacctctagcattttaacctttagaatgaaaattcaaggtccaaaaaagtaaaaagaaaaaaacacagaatatttttatttgcaaataggacggacactcttgagtcagctgaggacatattttggaaacaagctgactttggatatgccagagagaggctggaggagatgcatgtgctctgtcagcctaaggaaacggtgggtattttgctccttactaaataaacttgtttatttaattttaattttatttatttttgagacggagtttctgtctattgccctggctggagtgcagtggcgcgatcccagctcactgcaacctctgcctcccaggttcaaggaattctcctgcttcagcctcctgagtagcttggattacaggcgcgtgccacccccccccgctaatttttatatttttagtaaaggtggggtttcgccatgttgccaggctgatcgcgaactcctgacctcaagggatccacccacctcagcctcccaaagtgctgggattacaggcgtgagccactgtgcccaactaagctattttatttttattacttattattgatttttaatatttatcatttagcttgtaatgtaaaaacaagatagacggcactatgaaaggaattcctcactctcacttagttattggcatagaattttatgtaacttccccaaataggttgttttctttcctttggaaaccctgtcctccttatcccacatttatcagatagtcatattttaagacagtcgaaatatttttaggtttagaatcattcccccaaacatgtgctaatgaagagaaattgataaactgcgtctttacaaattcattctcagatagtttgggacagatgatataacaccaccatactgctctatatttgcccagagctttacagtttgcagaaagcttttctgtgtgttatctcgtttgatgcttataagcgttatagcagatactactgatgccactttatcagtatggaaaacagggtcctcagaggagttaagcaacttctccaagactgcacagctaccttttaaaattaattacacatctaggattaaaatgcaggtttttttccagtttactttcaaccataccatatcgtacctcagtggatcagataaacacgttgtcaagaggtggtttggggtagtaaatacaagagcaggctctcaactacaattcagatcctgagtcttagacaaggtacttaggctttccttgtttcaatttcctctgccttaaagccatgcccattatgtagcatatggtaaggaagaaatgaggttctgcagataaaaatgctcagtgcagcagggcctggttcccggccaagggctcagcattattttttaaaggttgatgaagttgtaagcacttacgattaaggtacactgttcaatgatcctgaaccctgagtctctgacatctcaggggtctccgatctccaaccacactggagaactaaaaaaattttttaatttactcacattcaaaaactgagtatatactttatagagctattggagggtgtcacgtaatagagctttgagcattctagcaaggtgaatgaggcctcaggatgtgaggcatgccattaaactgcacggccgcagggtgtctttaacagagttctgttctgtcttgcacatttggctcaagtctagctgttcacatggaaagggcaagataataatgacaacccctatcttgcactcctctttcaaggtggcttgtagaatgttcttttgattaagatttaccttgatttgctttgtgctagcagagtatgatccttgtcttagttgtttgggctgttataacaaaataccatagactgggtagcttctaaacaatatcatcacattgggggttagaatttcaacatatgaatttggcagagacacggacattcagtccattgcaatattttaccaactacagactccaaaacaccatgcaggtcaagattgagactttgtgttcattgggagttttgggaaaaacaattaaaatggcatttaaatctataaataaaacccagagcagataaaagtttttgaagttctgagcataacccagattggttgaaatagaatcaggctctggtagctgactcttcgactcctttcttcaattatttagaaaatattgccctcatgttgctgttgagacagaggctcccacaagctttacggtttgcagaaagcacctcttattaaaactggcaaacttccctccctgcttttaatgtctcttacatgtgcatttttccttgtttcttttggcttttggaagctgctttttcatatagctgtgggggtagtagtactggatctgggtactttttttttcttttaaaggggactgaactgagccacatatacagctcttggctttaaaatttgaggtgacagatcgttggggagttttccatggtaacttaaaagtgggaaactggcaaaagtatgcttggccagggtctgctgggaaggagaaaatatccttcagcagatgcagtctttggagagctttccttgtcatgttgtgtggtttgaatgtgagggtatccgtgctgtcagtgtgtctagcaagtccggatgagtctttgctgtgttaatactcagagtcattcttttcttttgctcaaccttcagagtgactcaagtctggtgtgttcccgttatcttcagtactgcagagcaaccaatctctatcttgatttaagaaacatcaagagaaatcatgacaggtactttagtggttaatgttaacatctagtataaattctgaaatattttcagatccagggatttttttttttttttttgagacagggtcttgctctgttgcccaggctggagtgcagcggtgtaatcatggctcagtgcagctgtgacctcccaaacccaagtgatcctcccacttgagcctctcaagtagctgggatacagaagcgcaccgccaggcttggctaattttttaatttttgaagagatggggtcttctaacgttgcccaggcgggtctcaaactcctgagttcaggtgatcctctcacctcagcctcccaaagtgctgggattataggtgtgagccaccaagccttgctgaaggggtatatcttgaatttgtttttgatgatatggcagaggggttggggaatgggtggggggatggatgactcagacaggccatgagttaatcgcattgcaaagttgggttgtggatacattagggtcctgataggattctgttactttcatatacacttgaaattttctattgtaaatagttaaattcttttaaaaaattcagtttggaaattggtaatccactttagttacaacccacgtgcttgggtcatgaagacgttttctgaacttaacttaatgttttgttatataccagatttaaggaggactttttccagagtggtgaaattggagggcactgtaaacttgacatccgtacattgacgtctgaaggtcagcgcaaaagccctctgcagtcatggtaagatatttttaacgtatctgtttcggaaatatttgcctttatttacggcacttgcagatattaatggagactctcaaatggaaaatgttacttcatttgtacataatttggcatgagcttctgggaagtgacggaaaccgagtgaatccctcagttgcatctgaattaagtatgtgtttataatagtagatacagtacttactgtttgctaatgaaagaaaaaaatcagcttaaaaatccatttttattaactcacaattgccaagttttattcacttacaaagtcacataggttacttacataatgttaatttttgaggtcaaacgtccatgccaaggccaggaatggtggctcatgcctataatctcagcactttggaaggccaaggtagaagtattacttgagcccaggagttcaaggccagcctgggcaatatgatgagacctcaaatctaaaaaataaaaatgtgttttggggaacccatttaaaaaacaatacacatatattaaagtatgtaaaagcatacagaaaaaggtacagtttggattgtgaaaaagtgaacccacccatgtaacttttacccaggtccaaaaatagaacattgtcagcacctcagtctccctcccaggctctacccccatccccctctccaaaggtagatgctactctgactgttaacatcattggccagctttttgaatttaaaaagtttgtattttaaaataattttagactcatagaagtttaaaaatagtatgtattatacccaagactgactaacttacaaaggaaagaggtttaatggactcatggttcctcatggctggggaggcctcacaatcatggtagaaggcaaaggaggaacaaaggcacgtcttacatgacagcagacaagagagcgtgtgcagagggaactgccctttataaaactatcagatcttgagaacagcgcaggaaaaacccacccccatgattcagttacctcccaccgggtgcctcccatgatgggagctacaattcaagatgagatctgggtggagacacagccaaaccatatcatactacaaggagaacttgtacgttgtctaattccctgagcttcctctaatgataatatctcatataaccatggcacaatgatcacaaccatgaaattgacattggtacagtagtattaacttgtgcaggttttaccagcaattacctgtactcattaaaattttatcacttgtgtaggtgcgggtatgtaggtagggagagagagggggaggaggacggggagggcgaccaccacaatcaggatgcagaattgttccatcatcccaaagaaactctcctgctactcctgtatagtcacataggttacttacataatgttaatttgtaaggtcaaatgtccataccaaggccaggaatggcggctcatgcctataatcacagcactttgggaggccaaggcagaagtattacttgaagccaggagttcaagaccagcctgagcaacatgatgagacctcatctctaaaaaagaaaaataaaaaataaaaataaattagctgggcgagatggcatgcccctgtaatcctagctacttgggaggctgaggcgggaggactgcttgagctcaggaggtcgaggctgcagtgagctatgattgcaccactgcactccagcctgggcgatggatcaagaccctgtctcaaaaaaaaaaagaaattcatgctgagcaaaccttttttttttttgtccttaaagaggcctcactgcctggctgcagatcattcagaataatgatctaccacacatttatctgggattttgcagtctgcaatgcaatgtctcaagtcacttagcagacttttacaagaggtagtttctatattcaagtgggctttttgattcctggtactttctgatatttgattccacatggtagttgctcagggcataattgtattagttgcttattgctgtgtgacaggctattccaaagtgtaccctagggtatatttatatttattacctattgttgtataacaaatgactctaaaatttagcagcttaaaatacaaacatttattatctcacagtacttctgagggtcagggtttgggagcagcttggctgagttggccagggctgtagccatctctagactcaacctgggcctggagaatctgctgctaaactcactcaggttgttgtaagcctcggctccttttggcaccatctcggctcactgcaacctctgcctcccaggttcaagcgattctcctgcttcgggctcctgaaaatggctgggactaaaggcgctcgccactacgcccagctaatttttgtatttttagtagagatggggtttcaccgtgttgaccaggatggtcttgatctcctgacctcgtgatctgactgcctctgcctcccaaagtgctgggattacaggtttgagccactgcacccggtctgttccttgtcttaacattaaaattgatatcaacctatataaaagtcagtaagttttagaagttacaggtgtccataggagtgtctgtaccatttagaggtaaaatctgcctaatgaacagatcctaagttacagtgttctaataggaagtttgggagaatcagtttgaagtcatgtcccaattcataatttcaggtttgctgagctacaaagctatactcagctcaacttcagacctatagaagatgctaaatgtgacattgtcattgaaaaaccaacatatttcatgaaattagatgcaggtgagaaataactttttctgttatttgtgtatttgttaatgagatattattcctttttttggatgtagtaattctctctgaattttttggaagcagtatgacaaacagtagatttgttttttttgctttcttctctgaagaagtagttgaactaatttgaacttcccattattttataacttgggcattttagaagaaactttcacatttatatcaaaggacttaaccaaaatcaaaggacgagaggtgaaggcatatttatgccttttgtaactaaatttacctcatctggtttctctaatcacttggtttagattgtctttcattaagatgtttaaaatcaaaagctaagccgggcgcggtggctcacacctgtaatcccagcactgtgggaggccgaggcaggcagatcacgaggtcaggagatcgagaccatcctggccaacatggtgaaacctcgtctctactaaaaaaacacaaaaaattagctgggcgtggtggcaggcacctatagtcccagctactcgggaggttgaagcgggggaatcgcttgaacccaggaggcagaggttgcagtgagccaagatcgtgccgctgcactccagcctggtgacagagcaagactccgtcttaaaaaaaaaaaaaaaaaatcaaaagccatgtgtatagtatgggtgggaaagaagtgtccatgacctgcgctgacaaactttctgtatcatttccatgactaaagtgaacttaaaattcttctggaagttaccagtgtaatttattcttgacataaaattaaaattattttatcatttatacttatagcctctttctcagcttgcaagcagagctttaactttgcgaactagttacactggggaggagaaacacagattgtactatattatctctttcattatgagagacagggattactgtgctagatcatatcaaaattcatgagaggttgggtttacagtgaaatatagagagcctctgtcacaaatatttcagaattagtataatttattgatcatagttttaatgtgctctgccttctgaagtcatagttcttatattacaaagtattaaattcagaaatcagacaagtttaggtttttgaaataaaagcgagtaaaaatgctatgttccaggttttgactcgtttttaaaacatgcaaattaaaaaggggcaaagaaaacactgatccgtctgtaaaagtggcaaatatgtgtgagctattaaatttatgcagatacttatacaataaagtatataaagtgagaataataggctagagtagacatgtctcatttctttcctatattcataactctacttttttcttctaatttatgctgtcttccaattttacttttctttctttagagacaggtcttgctctgttgcccaggctggagtacagtggcatgatcacagctcattgcagcctcaacttcctgggctcaagtgattctcccaccttggcctgccaagtagctgggactacaggcatatgcaccaccatgcctggctaatttttaacatatgttttgtagagatggggtctcatggattgctcagactggtcttgaactcctgggctcaagtgatccccctgccttggcctccaaaagttctgggattacaggtgtgagtaactgtgcctggttcagttttccttttcatgttaacttgtaccttagggaaatgaacattctacagatcaggactcattagggggcacatttctcaaggatggagcttatgttttcttctctgtttataaattcttgcaaccccaagcactgatttgtgcttgctgcattcctcagtaactgttaggaactcactaaatgttacgtgaaagagctcatgtgtgctctatggctaacctgggaaaagaggatagattctgatagaactttatttttcttgttaatttgaaaatatattctttgccaagatttttctgggtgaaaaaattagcccttccaaacaatcagctaagatacgaggctgaaaaaaacagagtatttttatactgttatttctggcacacaatgttattattcactgtgggaatgaagtcagaatattttatgatttctgcatttgagagtccctgtttttcttttactcagcattttcctacctttaaaatgcatgctctaagtgtcagttcttggaatttcatcccatttagatttgtatatttccaggatgaatattgggtcctgcatacctaagtggagagggtgcacattctgtttctttttaatgaatggcatgtgaacttacaaatagtagttcccacaaccctctccactctatctgacctagtgggatccagctagtcttcattcaggtcttcctatgtgcctggcactgggatgggtactttaagatgtattatctttgggtttctcataataaagctggcacttaggtaactatttcccatttctatagagaagctaaagcttagggactttataaactcatctaagaatgttgcgcatgcttggctgtgctggaattcaacttcttctttctccagaattgcttctctttcaatcagaacacaagacattcacttcttttatatgatagttggttaatgtttttccaggaatgatacatgtaatgattaaatagggaaaaaagagacaggaatgaaaattaccaaaatgttagttgccatcattgccagtacttccctgatgaacagatgtttcttaattgatttttttttttctggttttttttttttttttagacagagtctcactctgttgctcagactggagtgcagtggtgtgatcttggttcactgcagcctccacctcccaggttcaagcaaattctcctgcctcagcctcctgagtggctaaccacgcctgcctaatttttgtatttttagtagagatgggatttcactatgttggccaggctgttctcaaactcctggtctcaagtgattggcctgcctcagcctcccaaagtgctgtgattacaggtgtgagccactgtgcctggccccttaattgactttaaaaaacaactgatcaagctaggcatggtggcacatgccaccatagcaagaccccacccctgattaaaaaaataaataaagtcagaagaaataatggtttgtcttcatggccctgtagttctactcagttttgagttaaatagacctaccttgtttttttctgggaacttaatgatcacttgttacttgggatatatgggaaaatgcattcctgattttaaataaccaattttagagtgacttttgaaacccaggcagtccataaattgaggactacctatgtatctagatcatttcatgtttggaaaaacaaaacagttatttttttccccatttatttaaactaaaattctcttaaactgtaaatagatgggatagaataaaacttgcttgatcatgtgctctttggtgttaattaatgtagtttcattttccaacactaggtgttaacatgtatcaccacttctgtgatttcatcaatctttatattactcagcacgttaataactcattcagtactgacgtgtacatcgtgatgtgggacaccgtaagtaagaatgtgctctccgcttcagtactgtctttcccttgtatcagtgtgtgactctgatgttgtgaaacagaattttcaaagacacatatatttcaacatgtacagccgcacataatgcggatgggtgcgaatgtatctgtacatatatgtgttgacatgtgcatatacgtataggcagataggtatgtatgtgtgtaccttcattctttgaattttagaatgaggcagtggggaaggtttctttctctttctgggtgggtggagctccaaaggccagagattcagtgactttggcttagtgttcctctgggacacacatatgaaagactgccattcagcagggcgtggtggctcacgcctataatcacagcactttgggaggccgaggcaggtggatcatttgaggccaggagttcgagactagcctggccaacatggtgaaatcttgtttctactaaaaatacaaaaattagccagatacggtggcagacacatgttgtcccagctactcaggaggctgtggtcggagaatcacttgaacctgggaggtggaggttgcattgagccgagatcgtgccactgcactgcaacctgggtgacagagcaagactctgtctcaaaaaaaaaaaaaaaggctgtcattcactcaacctctgtaacctatgttggaagtgcttgcctctgtttactgtttggccttttgcatttactgtctgcctttgcttaatagcagcttccttgttactgtgtcctttgtgctgaattatgctgtgtgtttcagctcactgtaaagggcaggtcttaggcatgcacataaatgcatgtgttgagtgacacctgctatttatttgtttttagtgcaatctttttttccttctctctctttgcctgccttttccctgcttcttcccatatctggcccctccacttgctgaggaaaccccaagatgtgccccagaatcttcagctctgaaatgagatagtgagataatgacatttacctaggtgtcattttgagaatgaaccgtgtagtgtgtgaacagtcaccatgcctggtacacagtacttgtgctctgaatgttaactgtgacaattacaataaggagaataaatggtttgtagtgtacatgagagaggctgtctaaactgggaagttggaacacccaccaaggggtcatataaggttccactcaacattctgactcacgacactcatatgctcggctcttggtgtgagtctattcaggatgacattgcaggggaaccacagcttgctggcagggcagcctcaggtgtttcttccagagggagtgctagcagttcacacagcacagctcaggtgcaaggagacaagattcgcctggggcaggtacaggcgatgccttggcttaggagcctcatatcctgtaggggccaacatctcctgacacagctgtgttggcaaagtccccaggatccctgaaagagacatgcctggttccaggagtcagcgtactcagggaatccgaaacatggctttcccagtccagatgcagtttacccatcaagcatctttttagatcagaagcattgttgcctaggcttgttgacacaagctgtcctcatttgcagagagccgacttagctagttaacaggaggtcaaattctcatgcagaaggagagacagttttgccgacccttaatttcactgataagaggcttgtagtagagctgtgtaaaaaggttttcaggatcactgctccctagactttgagttagatttgaagtctgatgagactataattcttggcgtgttaatgctttattttccgtctatatgcatttacattttcctcttgtatttcagttttgctgccaccacagtttcatttcttcgaaatgttttgtgagcaaagggaacaacaatccctttcttttcttctttttgtatcagtgaagtcaggccacactcaccagccattacaagccctaaattattaactcagggttgttttgccgtttttaaacaaaactatttttaaattttgtaattaacataaattatgttacttcatttcatgcttatgacccccgtggacttgagttttcattagcttatcttacagacaagaggccgaggcctgagcagcaggtgagtgttctaagataatgctgtcagcgagggcagaaccaaagtttccatccaggcagcctgaccccagacctgtgctcagacaccacagtgctctgtcgtcttcttaaagtcctctgaagaggactctacctaagttgccaaacagaattttatcagatgacagaaatttatcagatggcttccagaagcttccttgtacctgttgcatgcttttctacatcttcctcaaatgggcttagtataacttagtcacattagctcactgtaagtgagccagctcctacaaccctccccttctctgtggctgctggagtaggatgcacggccaccatgaagaccccaggttactcagtcagctgagcatgagacatgagggcagtctgacctcagctctggcacagttaagcaggatgggtgtagcccagcagggtggccgcctggtgttacctccttcctttgccactccatgtgcatccattttaaacccggacgcttggtcaaagaagccatttactaagccaggttctcaggacaggcaattctgccagattgctccagaattcaggtccacagggtaggttggatggggatggcgctaagtaagggtttgtgtggctgctgtttcccttttgttggtaaggacttaaattaagcatcactgtgacctgcaggctgactatgacatgaatccctcccggtggatggtgttgccagagtcctgatggtcttggatgagcagtttgcccagggaagagcagggaggtaactgtgactgcagttcacatcttggtgatattttccaacctgtcatcacaaggaagcctatggggcctttccctctcctccttgaaaagctctgcagtttactcccttcagcatgtggcatcttcagtgggatgggcaaggccaccaacctgcaaacatgcatagagggacccatcttcagatgcctctctgggcacagcagggttgctcttatcaaacagaatgaataaaaggagaaattacggcaggctttccacatttgcttgtgctgagaagtagtatagctttatgattactttttttctgtttgtttttgagacagagtcttgcttgtcacccaggctcaagtgcagtgtcgcgatcttgcctcactgcaacttccgcttcccaggttcaagcgattctcctgcctcggcctccccagtatctgggatgacagtgtgtgctatcacacctggctaatttttatatttttagtagagacagggtttcaccatgttgaccaggctggtttcgaactcctgaccataggtgatccgcctgccttggcctcccaaagtgctgggattacagatgtgagccaccgtgtccagccatgattacttttttaattatgaaagtaatacctgattataatgagttcaaacaacacagaagtatgtgaagtttttaaaaaagtctccttcttcctctccaattccctgttcccccaagggtaactgcatttaacgtgtgtgagtcccttgcaggactctctttattttaataagtgcaaatatgtcacccaggctaaagtccaggaatatgatcctagctcactgcagccttgctctcctgggctcaggtgatcttcctgcctcagcctcccaagtagctaggactacatgtgcatgccaccatacctggctattcttttccatatatgtgttatatatgtgttatgacaatatagtcataacatatgtgtgtgtgcgtatatataatatatattactgtcttctgatttgacatctggctaatttttaaatttattttctgtagagacaagatctcgttatggtacccagattggtccttgatatggtttggctgtgtccccaccaaatttcagcttgaattgtatctcccagaattcccacatgttgtgggagggacccagggggaggtaattgaatcctgggggccagtctttcctgtgttattcttgtgatagtgagtaagtctcatgagatctgatgggtttatctagggtttccacttttgcttcttcctcattttcccttgctgccaccatgtaagaagtgcctttacctcccactatgattctgaggcctccccagccatgtggaactgtaagtccagttaaacctctttttcttcccagtctcgggtgtatctttatcagcagactgaaaacggactcatacagtaaattggtaccagtagagtggggtgttgctgaaaagatacctgaaagtgtggaggtgactttggaactgggtagcaagcagcgattggaacagtttgaagggctcagaagacgacaggaaaatgtgggaaagtttgcaacttcctagagacttgttgaatagctttgcccaaaatgctgatagtgatatggacaataaaattcaggctgaggtggtctcagatggagatgaggaacctgttgggaactggagcaaaggtgactcttgttatgttttagcaaagagagtggcagcattttgccgtgccctagagatttgtggaactttgaacttgagagagatgatttagggtatttggcagaagaaatttctaagcaggaaagtattcaaaaggtgatttgggtgctgtgaaagacactcagttttaaaagggaaacagagcatcaaagttcagaaaatttgcagcctgattgtgcaatagaaaataaaaaccaactttctggggagaatttcaagtcagctgcagaactttgcataaatagcaaggagcctaatgttacttcccaagaccatgaggaaaatgtcttcaaggcatgtcagaaaccttcatggcggccgcttcccatcacaggcctggagacccaggaggaagaagtggttttgtgggctgagcccagggtccccatgctgtatgcagcctagggacttggtgccttgtgtcctagccgctccagccatggctgaaaggagccaatgtacagctcaggctgtggcttcagagggtggaagccccaagccttggcagcttctatgtggtgttgagcctgcggtgcacagaagtcaagaattgaggtttgggaacctccacctagatttcagaagatgtatggaaatgcctagatgccctggcagaagtttgctgcaggggcggggctctcatgaagaacctctgctaaggcagtgtggaagggaaatgtggggttggagcccccaaacagagtccttagtggggtgctgcctagtggagctgtgagaagagggccatcatcctccagaccccagaatggtagatccactgacagcttgaactgtgcacctggaagagccgcagacactcaatgccagcccgtgaaagcagccagaagggaggctgtaccctgcaaaaccacaggggcagagctgcccaagactgtgggaacccacttcatgcttcagtgtaacctggatgtgagacctggagtcaaaggagatcattctggagctttaaagtttgactgccatgcaggatttcggacttgcatgggccctgtaacccctttgttttggccaatttctcccatttggaacggctgtaattacccaatacgtgtatccccatcgtatctaggaaggaactagcttgcttttgtttttacagactcataggtggaagggacttgccttgtctcagatgagactttggactgtggacttttgggttagtgctgaaatgagttaagacttttgggggactgttgggaaggcatggtttgttttgaaatgtggggacacgagatttagagagccctgggcagaatgatatggtttggctgtgtccccaccaaatttcaacttgaattgcatctcccagaattcccacatcttatgggagggacccaaggggaggtaattgaatcatgagggccagtctttcctatgctattctcgtgatagtgaataagtctcatgagatctgatgggtttatcagggttttccacttttgcttcttcctcattttctcttgccgctgccatgtaagaagtgtctttcacctcccgccatggttctgaggcctccccagccatgtggaactgtaagtccagttaaacttctttttcttcccagtctcagggtatgtctttatcagcagtgtgaaaactggctaatacagtcttgaactcctggcctcaagtgatcctcccacctcagcctcccaaagcactgggattacagccatgagcctggccaatatgtttatattcttatggaaaatacattctctgtctcatattgccaccttagtattatctgtggaatgtctttttaagtcagtacctttagggctatccttgctttagatgttatgtggtattctgtttaatggatgttttggaagttggatgcatgcatcagtgcatgtattcatttcccactccaccccccatcacatttagttttgtttccagttctgtgctatttactgaaatgtgaccataaacacatatgtcctttcaatatacctatatcttcacatgctcatcctagcatttctgtaggacagattcctataattggaatttctaagtcatagattatgtgcatgtttaaatttgagacacactaaaggaaattttatgtcatcttgaagactatccaaatattcttcaacatgagtataggaagaagtgcctccttcccaaatggtggataatttggacttgggaaacatggaaaagaagcttttggaggtggttcttattcaataatgtatgacttccctgaggaaggatcagtcaggattactgtattttattattaaaatttcctttcaaacatattttattttatctgaagtattttatctcaggaaaccatctagaatcacttcttttaattgccctttatttattattgagccagaacagggacatttcattttagatggtgttgagaagggcctttattagaatggcattggaggaacatggaaagaaggcttttttttttttttttcacatctaacagatctcaataactttgaaataactgtaatatgtgcaacataaaattttcaaaatctgagaaaagaatgctataaaaaagagacatgaacataatgtataactgtagagcttgaatgtagtgctacaatgcatatttctgatttctattggctgaatttttcaatctaagtgaaaccatttaaaaattaattgatcttcttagctaatggagctcataatcaactacttttcaaaaaataaatcaggctgggtgtggtttctgtaatctcagcactttaggaggccgtggtaggcggagcacttgagctcaggagtttgagaccagcctggccaatatggtgaaaccctgtctctatcaaaagatacaaaaattagccgggtgtggtggcgtgcgcctgtaatcccagctactcgggaggctggggcaggagaattgcttgaacttgggaggtggaggttgcagtgagcccagatcacgacatggcactctagcctgggcaacagggtgagactcagtctcaaaaaaaaaaaaaaaaaaaaaagcatgtggtaattatactggaaagaactaattcctgctgaaaggcagctgtcagatggaagtggcagcacaggctgggttgaataccagctctataactcagctgcttcgcaatgtaggcaaatgacttaaaattgtgtctcagtttcctcatctgcaaaatagagaaaatgatattatcaactcattaggcttgtgggtggcttaatgtacattaataatatcaagtgcccaaaaaaactgcctggaacataggaagtatgtaagatgctattattattatataaagttgttattgacaccattaatattaatgggaaattaccactttttattcactagtcaatgggtggggggatatttcatagaattacatatgttatatatttttattttattttattttattagagacaaggtcttgctctgttgcccaggctggagtatatggcatgatcatagctcactgcagccttaaacttcaaggctcaagtgatcctcccactttgcctcccaaagcgctggaattacaagcatgagccactgtgaccagcctatatttttaatgttaaacctttcttttttttttttttttttttttgagatggagtttcgctcttgttgcccaggctggagtgcaatggcatgatctcggctcactgcaacccccgcctcccaggttcaagtgattctcctgtctcagcctcccgagtagctgggattataagcacatgccaccatgcctggctaatttttgtatttttagtagagatggggtttcatcatattggtcaggctggtctcaaactcctgacctcaggtgatctgcccgcctcggcctcccaaagtgctgggattacagctgtgagccaccgcacccagccagtgttaaaactttgaacccattttcttgctctgaaatttttttccaaagatttttcattcaccctgatggtttttgcacactgagcataagagtgtgtgtaaacggtggcatagtgtgtgttgtgtgtatctataatttggataagatgttcacaggaaaaagccctgaactacaaagatgtgagaataaaagaagttaaggtagaaaaatgaaacactattaatggctaagagtataattgtgataattatttctgatgatatttcatcaaattaggcatttgctctggcccaagatgaagatccattttgcttgtatggattttatgaacttgcgtaggattgttagtttttaacacaggcaaattcaggtattttgttgcatctttgaaaagtcatgttatatccttttattgccctaaaaccttgttttgtttctactttcagagttcttacggatatggtgacctattctccgacacatggaatgcatttactgattatgacgttatacatttgaaaacttatgattccaaaagggtactggaaattttcctgaaatgtctgtgaatatttcttgagtgcagatgactcactcataaaataaacatttattatgagttcctattagccattaccactgatttctgaatttctgaatttcttttataattagaatcctcagtgttgttaatcatgcagcctttgaaaagttttttctataatctttccaaaaatatgaattctgttctctttgaatgaaatagtgtgctattcaagcaatgcaaaatggagattaattaaaatctatttctcaaaattatacgtgctatttttggtgtgaagggtgcaaattacatcttcttttaatgtatctttgttcttaggtatgttttaaagaagctgttttttcattactcccccgcatgaggtatgggctgttctataatactcctctggtaagcacattgtctaccattagcattcatatttacagacataacatttatacataagttgacagtatcttaaattataatacagaagtattcattgtaatatgaaccagtgtttttattttagatatctggctgtcaaaatactggactattcagggcatttgcccagcatgtactacacagactaaacatcacacaagaaggacctaaggtaatggatacactgcggattctgaggtgggcttgagttttcttccctaataaaaatcgataccaccttttcagaaacagaaataatcaggagaccatgtttttgtgttaacattttctggggaggccaaggcaggtggatcacttgagtccaggatttcaagaccagcctggccaacatggcaaaaccccatctctgcaaaaaatacaaaaattagctggacgaggtggcatgtgcctgtagtcccagctactcaggaggctggggcatgagaatcgcttgaacccaggaggcagaggctgcagtgagccaagatcatgtcactgcactcccgcctgggcgacagagcaagactgccccaaaacaaaacccaaaaacattttctgacctggagtcatctgaaaccaggtgtcaaaaacctataaaagagaagctaagggatattacaagaatgtgcttcctcctgtcctcctttcccccttcattggttatatctccctcacctccccaaatgttcatgtaacatacacaacccctgccaaaaaattcacccacccaaccaaacagacaatgtaatgagctggtttttgccttcggtggttgaagtggatacatttttattccctgagagtggtgaaggaatcaagctaaaaaagaagagttctattaatgtatcctggttgagtttcatctctttgtgaaaatcacattttgggttcagatgttcattcatctacccaggcatatgcagtgttattttaccgtttcattttgattacaggatggaaaaattcgagtcaccattcttgcacggagcacagaataccggaaaatccttaaccaaaatgaggttagtttttggtatgcatttttaatgccttcatattcaattcatagagcaaattgtgtttttttttttttcacattacgttaaaagctttggtttaaaacttagttttgagaaaagtttgatggcctatgcccggtttatttattagatttgaatttctagtgagattcaccaaaccacccatagacaaactagctttgccttatagtaaatttcatctgcatcaactcagcatggaaaaagctgtcagaatcttgccttgactgcagtagagggcatccggacagacaagtagcaaaaatgtaagactttcttttgcatagttgatgcaacagatggttgaggccattaatcctgtggtatcagcagcagatttagttggaagaatctctgtcctcttacatgaccatgtcttagaaactgcattttcagcatccttactcatttcagtagcaccaactcataaattacatttaacctcaatgagatcaccatgcaaggccactacctacaacatcatggcctgaagatagcctctcagtagtaagaatttattctacaatagttaattgagcacctgctatgtgtcaggccatgttctaggccctggagatagagtagagcaaagacggggaaggtgcctgacctcatggagcttacaccgtagaggtgagagacagataagaagtaagtgaaaacgtcaataagtacggtgatgtcaggcagtgataagtgctttgaaggatgaaccagggtgatgtcatagagactggggatgtggatggatgggggtttgtactcacatgagggcattcaaagacctaatcagagaagaatctagcaagggagagagcctctcgggcagagtcaaatgtattctagtggactgagctttcagtattctagaaacagaataccaatatgactgtagcatcttgagagaggtggggcgatatccaagaggtcaggcatggtgcagggggccacagatcgtatcagcctcctagaccttggtgggagagggattttattccagtgtaggggaaagccattgtgaagttttaaagcagggcgttgttggtagaataatgtctcttcctgctcctcccaaaggatgtccacatccaaatccctggaatctgtgaacaggttaggttacatggcatagggaaagtaaggttgcagatggaattaaggtccccaaccaactggccttaaagtaagaagattatcttggatcatccacgtgagcccagtataatcacaaatgggccttaaactccatctgctagagaacttttgcctcggcctggacagctcttttcttcactggattcttctcactgatcaaatcagagttcataatttccttaaaagtgggagagggagatataagggaagtggggccagagagatgccatgttgctggcttcgaagatggagggggcaggcctatgagtcatggagtgtggagggcttctagaagctggaaaaggtgaggcagtgggttctttcctggagcctgcaggaggaacacagccctgctgacaccctggtgttagtccagtgagacccacgtcaggctcccatcctgcagaactgtaaggggataaattgtgttgtgttaagctgctaaatttgtggcagtttgttacagcagcagatagaaaacaaatacagagggagagacatgaattgacatttatttttaagtcattctgcaaggagattgatcagaagttgttattgtggcccaggggagagtgtttagccaaagtgatgacagtagagatgacatggtagatgcattcaagacatattttggagataggacctatgatacttacttttggaatgtaaaagtacattcacattagagaaggccaggaaaggtatcaaggatcaagtgtgacttgaggcttttaacttgagcagataagtggaaacaaactggaaaatattcagtaagaggaaagttgaggggggaggtggtgtgtgtcatgttttgatgggtaaaatattttacacagactaatttggctgcctaacaggctgatccgaattatgtaattaacatctcttcctgagacccatatggattacagaggacatgaacatatggcataatgaggtgttaattgtaagctctgtggatggaagaaatgagcagtgtgtgtgtttgtatgtgtgtgtttaaagacctagaaatacgaacgtatcaaatagtgcaatgttgggaatacaaatgagaagcctcactagccaacagatcaacagtatatattggtatagaccatacatattgagtgcagttgggggtcaagcatattattgtgtgctccttttgtacattgtgccccccaaccctcccagcaaacccatgaggtaggtattgtattattatcctctattctagacaaggacactgaggctcagtggttaaaaaacatgcctaaggtcacccggctggtgattagagtaacgggggcgtgagtcaaggtagtcagggactgaaactgctttcttagccagagtgtgctactactaaaacagcaaatagatttcagaggaggcagaagctacctctggccccagtccatcaggaaggggcaggctgaggaacaacatcaggccactgcagagaagtccagtagaaaggtatagtgctggtagatgctttagtgcatgtgtgaggttttcagatccagtcatgcgcattgcccagatgatggcacccaaaggcgaaatttgatcattcagcccccaactccaagccaaagagcacccaactggctgcttctttcttgaggattggatgttactagaaaggcagctcctgggaagggaagaaagcacctttggctatactttgattaataaacaggtatgtattaatcaacccaaatggcctcattaaatcatggcttgtggaattctgcccaactttagggtttgaatagccatcggaagggatagggccacctttttcgtgcaactagaagtcatgaaaaagggcatgcttgccctgagaccgtcagcacacatgattccttttatgtgggcaatcttgttaaaagaccaaggcttatgccatctgccatctctcctgtaaaacagaattctaatcttcttaccccttcaactctttataagatttcagtggctgtctggagagggaaatttccatgttatgactgtgtgcgtgtgtgtgtgtgtgagtgtgagagagagagagagaggggaggggattaaatgttggtcactgcttgttgctttctgtaagcaggacaatagagtgcactggttaagaacgcaggttctggggtcagaagacctagatttatttttggctgtgcatttgggagctgtgagatcctgggaaagttatttcacttctctgagcctatcttgtctaatttgtaaagtgggcatagtactaatacttacttggtatgatatttggtatgtttttttctttttttagacagagttttgctcttgttgcccaggctggagtgcagtggcacgatctcggctcactgcagcctccatctctcgggttcaagtgattctcttctcttagcctcccgagtagctgggattacaggcatgtgccaccacacccagctaattttgtatttttagtagagacggggtttcaccatgttggtcaggttggtctcgaactcctgacctcaggtgatctgcccgcctcggcctcccaaagtgctgggattgcaggtgtgagccactgcgcccagccactggtgtgattcttacgaggattaagtgaagtaaacctaacgacactcttagaaatgccagcaccatttacatgccccatcaatgatacttgcaactgttgatgttgctgttgcagtgcagtgcatgccacaaggcaacatgacacagttgcagaaatttctgaatggtggtgatcccccgtggcctaattgtgagggacagagaaccatgactatatttttgataatagattaacaatgctttgttactttctgtttgctagaagaataattgtttttctatgtagaagtactgaaaatgtttttctgccaagaccttagtattttcagaggatgaggttcaaagcgctagtgttgtctgaaatgagataatggatggggcaaaaactcttaaggtaaagtctagaacattttgggcattctgatgcccaaaaatgtgtgttgaaagttgagggaataataagcaaatggtaataacaacagttaatggttagctatttctgtgcctagcactttacttccctgaattgtcttctcctttcagcctcacagcaacacagtgcattggtatctgagggaggtagagtcgtgtgttcacaggtggggcctggatttgaacttaatgacagttcagaactattgacctgaatgatatttatttattttctttttatttgttgttgttgttaccaaatgatatttaatatctgaaatagtatatgcaaaaaaagaaattttaggactcataagggaaaaacagaagtgaaagaaggaaaagaaatgctaaatgtttctctttttttcccagcttgtaaatgcactgaaaacagtatctacatttgaagtccagattgttgattacaagtataggtaagtaatagccaatctcagcagacactgtcaacttttgcttggatgaggtcaagggggctagaaagcatttttccagtgggagccattggcatttgtaggcccagaagggacaagtagacactacagatgaatgaaatgggcaggtgaagtccctggtaacaagggcagttactctttggctttctggggcctgatgttgtcactccatctccttattcaaaagaagtgatgaattcagattttcatttaaaatttcagaattttttgtttgtttgtttgtttgtttttgagacagaatcttgctctgtcacccaggctggagtgcagtggtgccatctcagctcactgcaacctccacctcctgggttcaagtaattctcctgcctctgcctcccgagtagctgggactacaggcgtgtgccaccatatccggctaatttttgtattttttgtagagacgaggtttcaccatattggtcaggctggtcttgaagtcgtgacctcaagtgatctgcccgcctctgcctcccaaagtgctgcaattaaaggcatgagccaccacacccggcctaaaatttcataattttaaaaaattggcagactggccacgatggctcacgcctgtaatcctagcactttgggagactgagatgggtggattgcctgggctcaggagttcaagaccaacctggacaacatggtgcaaccccatctctactaaaaaataaaaaaaattagccgagtgtggcagcgtgtgcctgtagtcctagctgttcaggatgctgaggcaggagaatggcttgaacccaggaggtagaagttgaagggagctgacattgcaccattgcactccggcctgtgtgacagtacgaggctctgtctcaaaaaaaaaaaaattggcaactagttcaaaatttaggtgttataaaatttatcaaatatttgataacattatcaaatgtttgataacaaaaaagttatcaaaatttagatgttataaacctaatttgccctgcctcctgccagatttcaacatctgactgaaaattatttatatggggataatttgagggtcagaataacatgaaattttaaaaaaacttaccaaatatttacatttcttttaaaactcttaacacaactaaaaggcttagaaagacagaatatgcctattattcacagtttgggtaattcctgttgctagaattacatcttcctggtaaaagtagtacatgtttctggttgaaaagtcaagcagtatagaaaagatcaaaaggaaaagtgaaaacttctgtctccatgtccacctacagtcacagctgtgtttcccaaatctaacactgtgaacactttccagttaaaagaagtatacatatcccagcatgtgggtatctaatatagatacacttaatttcagagaatgttggcatgggagctttgcacttcattcatcatacattagttcatttgtgcaataaatctctattggggacccatgagctggtcaccagtctcagcagtaggaatcccattatggcggatggcatagccctggtcttgaggatctcagacactgaatagaggtaaatagcaattgtaaaaacagctactatttatcgaaatgtacttttatgcttacttgctttatctcatctcacgctttcaacagtcttctgagttggcccagctagtcccattttacagattatgtaaaatctgctgcgctgaagaaatgttgtgtcagtgttgcttgaagaaatgagtgagccaatatggggcccccacatcagtcccaaaaccattcacctagatgaggctgggaagaaatggaaagaactgggcagggcacctctgaggctgtatcattgactggcttttaaggatatgttgtagtttctcagataagcaagaatgataatgaattcgtaccttgccagtctgcgggaaatactagtaacatgttggcatggggattggtgagtgctgaccacaggcgtttccacaactggcagtgcaggggtatgttcacctgggtgaatggccgtccttcccttggcatcagttcacattcctggagaaactgaggcacatgttctcgttgtgatacacatacacatggagctgtcatctttttcctatgcggagtttttgttgttagctggtgtaaaagggaattcagcttcccttcgtagatccaaaataatcttgatcatttatttttctttactttgggtaagttggggctgggagatctcatttctttctgtttattcagagtgtcacccttattccagcatttctccctagcctcacctcagtgaattgtttggggactgatttttggttcaaagtttacacactggttagtgtcttggatttagagaacacttgtacagtcctaacatgcataaaattgtggatttgtctgttccaaaggcaggataatgccctggtggtatctgagatcattttggaggtacccagagggcattataaaaacttaaatcacacaaggagaaatgtttctttttaaaaagtgcttctattgtcctaaggaaatagtttttaatttagtgctagtgtgtcacaacatctctttaacacttgccaatttctctttttcatgaagaaagagcaggcctcaggctctgagctttgtcttgcaatagtatctacctcgatttgaacactacttagtttgattatatcaatttttacagttttgttgatgtcatatgtcactgcttttccatttaagacagatattaaagtttcctttaaaaaaagtacttaaacctaaaaggataggtgagcttacttagaaaatatgttaaattattaagaaacttattaattactagagcgcacttgaaattggcaaaaatgcttcttaaaaatggaatgtggtttaaaatgggcaatacacttttataaatatccttactgtgaatcatgaactaactcaacctaatacttctctcttctccccatctctctcatgttattctgtatgttcacagagaacttgggtttttagatcaactaaggatcacacacaacacggacatatttattggaatgcatggagctggtctgacccatttacttttccttccagactgggctgctgtatttgaactgtaagtgttgggaggcagttttacactgaagcaactgataatgctttttatgcatgctaaagctttcattctgagcatcaaaaggcttaatatttaatcattcaaaaagagaagtcacatcatatagacaatctggaaagaaaagaggcctgaagctaaaaatacaaagtctgcagcctgccattgcacttagtaagccaactaccccttcatcttcccatcccgagcatgatatggaagatgtgaatctgtggtttccttattctgagtttgttcctgcatacctcccaaactctgagcgtcttcttgcaaacagtgtagttattgtgttaaaagaaagcatttatgtctcatgcacgacatagcttcaaaacacaagccaaccacttaacttagtgcttgctgatcccatacacagggaaactgaggcccttgggtgttcatgatttgcccagggcatacttttaactcagtggttggtttatggagacatgaccttccctctcataataattctgctgttggcactgtgctccattttaggtcttgagacactaatagcagttactgttacctgtttccccccattatgtctaaatatctgggttctatggtttcattttaaaagtgatttgactctgtatttaaataggaggctatttaggaaaaaagttgtcatgaacttccaatgccctgcaaaacatttcaaaaatatatatgatatatgtagagaaatagccagataatggattctatctctgtcatttctcttatagagagagaaggaaggatggaagaaaggagagagaagggagagaaatgtaactgagaaaactcaagccttatagtctaatggacctgggttctacttttgcatccttcactatttagttatatgaccttggaagtgttacctatcccccttgcctctttcatacatttaaagacagaggtattataaggtcatgccaagtccataggcagcaggccctattgaataaggtcaattctctccattccatgaccctattttgttttttaaaagttaagttcatttagttcagagaatatttttacattctcttcctcagtcttgtttactgtcttcctcagtcttgtttacaaccttttgcaaggacatatttgggagctgcattttattttcgcagagttgttgatttggaaaaaaccttggacaaaagcctcatgttgtgacacccttgtgtccttaggtacaactgtgaagatgaacgctgttacttagacttggccaggctgagaggcgttcactacatcacttggcgacggcagaacaaagtctttcctcaggataaggtaaagttcaatcacaaaacttaccttgcttcatttttaattggtttaaagtatccaattattgatatgaaaaatggttattgaacttcagtgctgcaaagataaactgttctctggaatactgaattgttttattttatatttgcaaataggagaaaaaggggaattaagcaacctatatctttaatgttacaaaggcagcttcgtgaaatttgggcttagaaagatctattagattatatatagagacgggatcaacaagcaacagccctgtgggcaaatccagcccatgacatgtttttgtaaagaaagcacagtcatgcctgtctgtttatgcactgtctctagttgtttgtgcacttcaacgacagtggagtaactgtgactgagaccttagagtcagcagagctgaaaatatttatcatctggcccttatcaggaaaagtttgctggtctctgatgtagaacataaattagttgccttaaccaaagtaacataattttcctgctgtagagaaaaccatgccctcattgagttatggattcgtgttttggtttattttcacagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttgaatatcagaacc

SEQ ID NO: 38735 - DNA, 5912 bp, Homo sapiens; identical to SEQ ID NO: 38490

SEQ ID NO: 38736 - DNA, 12503 bp, Homo sapiens
ccgcgcctccccgcccctccccgcccctcccagcgcctccccgccccctcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtaaccgcccctcccggagcccctcccggaacccaaccggctgcgcccgaactcgccggccccaacctgccctgcgcgcagccgacctgcccggccgcctcaccgggctccccgagggaatccccgctcgcttaatccgccagagttcaccgccccgaaactcagggctcagagttagtcaggagggcgccggccagggaaggcgacctacggctccacaaggccgccctgattctgccccacgggggcccccccagccccggggtacgcccaccctgcgcccctccctctggtccacaccgcccgacaagtgccctcctgcccaggtgctccccttaaactgggtctgacagggccctgccctgggggaccacagggcccttggggacagtgtggtacatcctccttgggaaggccagcgtgggcgtggcccaggagaagggctcggggtgacccttctaggaaagggacctccaggtggcatctgctgtcccctcgcaggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagtgcgtgcctgagcccctgccccgccagtcctcccaccaggctccccagggcaccggggctggctgagctccgctcttgcttgggtatgggagggacaggagaccatttgtcctccccattccgacagactggttgctcctttccctagttttgctcatttaagccaaaaaagttatttctgagagagagtgtttaaaagaaggaaaggtaaggctgagtgcggtggctcacgcctgtaatcccagcactttgggaggctgaggcaggtggatcatgaggtcaggagttcaagaacagcctggccaacatggtgaaatcccatctctactaaaaatacaaaaattagccgggcgtgatggtgcatgcctgtaatcccagctactcgggaggctgaggcaggagaattgcttgaacctgggaggcggaggttgcagtgagccaagactgcgccattgcactccaacctgggcgacagagtgagactccatctcaaaagagaaaaaaagaagaagagtaaagacttctcttgctcctgtatttatgaggggcttcaactgcagagggggccagacaggccctctccctgtggcagggtggctgccaggtaccaggtgcagatgagaccctcctcgggctgtcccgtcacccctggtgttggccccaaggctcctggccaggcaatgggcatttgtgagtcaggaactctgtggtggtaaggaggaagccctggttccggcagattgccttgagtgctctgtgcccactgaaccctcccttacagcctggagggcaggtatgagcatccttgaggtggaaaaccacagagtggagctgacctccttgctggccctgagcgatggagagctccccgcagctacctttgatgcgggtgggaactcagagcacgtatttccaccagtcctgcccttccagggactgggcctctacgaaaccagcacttccgtctttctaggggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggtaggtcaggttttcagcccaaacccccatcccaagtgcccccgcctctgcccttaccctgcctcagttggctctggggcgtttgcttgtgtacgaagctcacattttcgttctagtaagttccagataggtggaaggaatgattctgttatgttttgtagcaattacatgctttggaattaagggtttcaccgtaagaaaaaacgcgagtaagtatgcgtcctgctcgcttggaggtaaccgtttagggttgcgacggccttggagattaaccacaccgcactttgctgcagacaggaaaaggcatgaaaggcctggtctgaaggtcaggcctggggtgacctgttgaaggagccgtgtgtataattctgtttaattctagatctggtgctttagatctgtccttgagtagaggtggtttgaagctgttttataaaaggtggagatggttgaaaacagagttactaggataattgctgtcaactggacatttgcttcccacgggtttcacgctgccgtgggtctctgcctgagttatctcattgactcaggcagccttgggaggtgtctgtcattgtcccacatatgacagatttgaacatctaggcaagtagagagaagtcacttaattgcccaagttcacaaagctagcgattgccagcactcacttggaaatctaggtgtgattgacaggtgtgtgatgaaaagcaggagcctccgcagccctaactcctgtctccaaggggtggctttgccctccccggggcagggatgagcactgagaccccattgctgtttcccagagatgcagtcgtcgtccacacatgaacatctgctgctggctgggcacggtggctcacgcttgtaatcccagccctttgggaagctgaggcaggcggatcacctgaggtcaggagttcgagaccagcctggtcaacatgatgaaaccctgtctctactaaaaatccaaaaattagctgggcatggtggcaggcacctgtaattccagctacttgggaggctgaggcaggagaatcgcttgaacgggggaggcagaggtcacagtgagccgagatggtgtcattgcactccagcctgggtgacagagtgagactctgtctcagaaaaaaaaaaaaaccaaaaatctgctgctcagtttgcctgtttttgttttttgtttttttcttaatagaacttgtcagtgtttccaaatcagcacacatagatctacagcggtcttttttgtttccctccagtggctttgttcattcacgtttggagtaagtgcttgcaggccctgctaagtgctgatcacggggacattgtcagtagatacattgctacaactgtgagcattttgtttataaggagccagttcacaaaaattagccgtcgggtgcctgtagtcccagctactcaggaggctgaggctggagaattgcttgaacccaggaggcagaggttgcagtgagccgagattgtgccattgcactccagcctgggagaccagagcgaaactccgtctcaaaaaaaaaggagcgggttaatttgccacgcagtgttttcttgtcattatttcataagcatagatggaaatttaggtggccttcactttttctatttcatgcagttttacatgtgcacttaaaaacacttgtgttggccaggcacggtggctcacgcctgtaatcccagcacttcgggaggctgaggcaggtagatcacctgaggtcacgagttcaagaccagcctaaccaacatggcaagaccccatctctactaaaaatagaaaaattagctgggcctggtcgtgggtgcctgtaatcccagctatttgggaagctgaggcaggagaatcactagaacctgggaggtggaggttgcagtgagccaagatggcatcgttgcattccagcttgggcgacagagtgagaatccatctcaaaaaaaaaaaaaaaaagaaaacccaaaaaacaaaaaaacaaaaaacacttgtgtgaaaggtggggaacagaggctcacgcctgtaatcccagcagtttgggaggccaaagtgggaggactgagccagggaggtcaaggctgcagtgagccctgatcatggtgctgcatgcactctagcctgggcaacagagcaagaccctatctcaaaaacaaggacaaaaaagtaaaactgcttgtgtgaatgtgtctgtaggataaacaccagcaggggaaattgctggatccaaggtctggacagacaggacttccgtggagggctttatgtgatgtaagaagagtccaattctgaattccaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtacgtttgctccctgagaagttctgcgagtggctggctcataggccttcatctgatggaggacgcagcagtgtgtctgttcactgcagggtatttctagggggtttaatgggtagggttcccatgagcgcccccccaccaggtgctggctgcacctgggcctgacccctgcggggacagatggcgccctgctgtatgcgggttgtcagcgtccctcagggcccagaatgtgtttgtagacttgcaggcaggctcagtcttcagtcagtgggaacgtgtttactggaatgttgcagggagctggggcttgtagatacagaagaactttgaaacaccatctgcccatacgtggggagacaatacttaaatgggatgaaataattgaaggaaacattccgagaagtaatggaatgggagacccacagaggaagggctcccttgtatgggctggccctcttagaaacagcatatctagaccacgtggcgattcaggagttaatcccatgagtgatgtggggatggagggactgacttttccagcaagattaaaacacaaagacagcctgatatagtcagatggcagaaataattccacgtttccactgagagatgccgcaggagggggcaccaagttcttgttctgaaagacccgggatggggtgggatgtagggcatgcctgccagatggttcatagttgccatccactgggagcaggaggctgcaggctgcagaccagccctgcacctgtgacgggggaagcctgtgtgtctccttcacactgaagagaaaactggcatttcggccaggcgcggtggctcatgtctgtaatccctgcactttgggaggctgaggcgggtggatcacctgaggtcaggagttcgagaccagcctggccaacatgatgaaaccccgtctctactaaaaatacaaaaaattagccggtgtggtggcacgcacctgtaatcacagctactcaggaggctgaggcaggacaatcgcttgaacctgggaggcagaggttgcagtgagctgagattgtgccactgcactccagccttggcaacaagagcaaaactctgtctaaaaaaaaaaagaaagaaaactggcattccaggtgttgagataggcctgggttgctggtgggcagccgggtgggtgactgtgtgtagagccacctgctccaggcccagccccacctcctgtgctctcttgcttaggacatcagtgggaccctgagtgctttggtgggaccctgtctgtggcacggggtggtagctgtcccatccttttatatacctgcaaagggttggggatctcaaagagcttttgtttatgtgagtcacatctgtaaatttaccccatgataaataaaatatttttttgtttttgagatggagtctcgctctgtcccccagactggagtgcagtggtgcaatcttggctcactgcaagccccacctcctgggttcacgccattctcctgcctcagcctcctgagtagctggaactacaggcacccaccaccacgcccggctaattgtttgtatttttagtagagacagggtttcaccgtgttagccaggatggtctcgatctcctgacctcgtgatccgcccgcctcggcctcccaaagtgctgggattacaggcatgagccaccgcacccagtcaccacatgataaattaaattattatttgagatgatagtaacaaacctattctatgttagcataaataacatttttaaatgaatattttcttaaaatttaatgaagggtggcagcagttttgtcttttctgcaaaactttttttttttttttttgagacaaggtctctctgtcacccaggctggaatgcatggaatgcagtggcgtgatctcagctcactgcaacctctgcctcttgggttcaagcgattttcctgcctcagcctcccgagtagctgggattataggtgtgtgccaccatgcccagctaatttttgtagttttagtagagacagggttttgccatgttggccaggctggtctcgaactcctggcctcaagtgatccgcccaccttggcctcccaaagtgctgggattacaggtgtgagccaccacgcccggccttttctgcaaaactcttcagtgttacacttaatagaagacatctgggttctcaggcctcctctgcattcattctgtggtgatgttttattttggttgaaacataggaagaaaatgtggatctacatggatatgtggttggaagaaggagtgatatttgtttatttatgagatggagttttgcttttgtcgcccaggctggagtgtaatagctcgatctcggttcactgcaacctccgcctcccgggttcaagcaattctcctgcctcagcctcctgagtagctgggattacaggtgcccaccaccacacccggctaatttagtatttttagcagagatggggtttctccatgttggtcaggctggtctcgaactcctgacctcaagtgatctgcccaccttggcctcccaaagtattgggattacaggcgtgagctactgcgcccggccaaaggagtgatatttaaatagcttttgaaatgattgtgggtattctttgatactacctcaaaagtcaagatgtagtagtaattccttaaaggttggccaaatatgaaattggagagcacaccagtgaattttttgtcttctgtgacactgaaatctatttgtctgtcttgcactttaaatggatcttttatctatccatggctttagtcattggaaaatactaggctgggcttggtggctcatgccggtaattccagcactttgggaggccaaggtgtgcagatggcttgaactcaggagttcgagaccagcctgggcaacatagcaagacccagtctctaccaaaaatacaaaaagctagccagatgtggtggtgcgtgcctgtggtcccagctactgggaggctgaggtgggaggattgcttgagcccaggaggcggaggttgcagtgagctgtgatcaagccactgaactccagcctgggcaacagagggaggccatgtcttaaaaaaataaaatatatatatattggttcatgtagtcttccaaatgttgatacatttcattatacaatataaaaaatcaaatttattaacataccactgatctcagaaaagtctttcaggattgggaagctgttatgctgttggtggcagaaacaagcttttctaaaattgcagtttttgcttgagagcttaaactttgtcattgtctataaatactatttgttagttgttttcctgtgatagagacactttgctcattttcaagaaaatgtcaccaaataccacaccatgatttgtctgactggtgctctcctgagttctgagcctgtctgtgaaagacgcaccagccccgcctggaatagcgtgtgctaggtgagtcctccacggccaccgtgcaccacgcgcagcaggagtgttctatgcggatcccgcttctccacgcagattattattattttttgagatggagtcttactctgtcgcccaggctggagagcagtggcgcgatcttggctcaccgcaacctccacctcccgggttcatgccattctcctgcctcaacctgccgagtagctgggactacaggtgcccgccaccacgcctggctaatttttgtatttttattagacagggctttaccatattgaccaggctggtctcgaactcctgacctcgtgatccgcccgccttggcctcccaaagtgctgggattacaggcctgagccactgtgcctggccctccacgcagattattaaaaagacatgaactcgaggatcaagatttaataaaattagtaacttttactgcctttgatcaaggacattctcaagtgaaagcagcatttttatttattttttaatatatatattttaatttttatattcagaggcagggatatacgtgcaggtttgttatgtagctaaccgtgtatcatgggggcttgttgtacagattagttctatcacccaggaattaaacctagtacccattagttatttttcctgctcctctccctcctcccatcctccactctcccataggccccagtgtgtgttctcatcatttagctcccacttgaaagggaaaacatgtgctgtctgcttttctgttcctgtgttagtttgctaaggataatggcctccagctccatccatgtccctgcaaaggacatgatctcgttctttgacggctgcaaaaagcagcattttgtaaccctcatgtgcagtggtgggaacgcctgtaggcgcatgtggatcctgttgctgcctgattctgctaagggacggtttacctgccctggctcttgctcaggtgcaaatgtcggcgtggtggaaacagcaaatgctgtcttagcgtctgaagatggctgtgaccttgagggtccctggcagggccttcggacccccaggactttgccgcccacactctgcgaactgctgcctgagggacgctctgtggggtggctctttgtgcctctggggcccctgctccatcagtggttccttgctgagaaacgcgggcggagagctgggctggacactgtcatcccggggctctctttctccatgcaggtctggtcatcccagggctctctttctccatgcaggtctggtcatcccagggctctctttctccatgcaggtctggtcatcccagggctctctttctccatgcaggtctgtccacgttctctgtgggttcattgccggacttgagtctgagttcatggagactctgtcggatgaagaagtacttctgtgtctcacccaagtgctccggagagtgacaggtaggtactcaccacacacgctggttcctgcctctgctcgttactggttgatctctaaacagaaactagactttgcagaacagagaaaaactaaatttggctgactctgtacatctccagggaccatccttcctcatgttagtggggtcagtaacagttcttacctccgaggaactgaaatgactttgcaaacacttcctacttctgccaccaaaataaatgccgttgtccttgatcagatttttacagaggaggaacccaaggctcggaaacagtagctgctgctgtcacagctcccgggtcccggcccgctgctgtcgggtcagaggcccccgggtcccagcccactgctctcgggtcagaggcggcaggaagagcctctcctgacacactctgctgctcacttttcttcctgcatagcatctttcacgttaaactgctcaatctttaaaaatgacaaaaacagttgcagacctgtgggtgagagttctcggttaacatgcagtgtctctgtggctcaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccaggtatgtggcgtgccccagtcggggggcgtgggtcccgctgcagaggcccccgccgagtctgggcgctgcaggagcaccagccagtggcgggtgggctgggatcccagactcggaagccattttctttttgaaactaagaataatttttaaatgtactgtttttgtgagaattatacacacacagcttaaaaagtcagagaattctgcagtgctaacaaaagaaaataaaaccaaaatggcaggtggagccccttttgcccttctcagacggtgctcccagctgattctcatcgctaagtttactgcatctctaaaaacatgtttctgctaccacgttttgagatacatttcctgtgcaaaatgtcaaacatactaaagtagggagaacctttcagtgcccaccaggcttcccctaagccaagcttctccccgcccacccccgcccttttttattaagcatgactcacacaggacattgtctcacctcaggatattttggtgcctgtttctaaaagataaagacatccttgtaaaatacttaactatgatgctgagggcagtggctcacacctgtaatcctagtgctttgggaggcctaggcaggaggtttgctgaggccaagagttcgagaccagcctgggcaacatagtgagagtcggtctccacacacacacacacacacacacacacacacacacaagtagccaggcatggtagcatgcacctgtagtcccagctgctcaggcttgggcccaggaagttgaggctggagtaagctatgactgcaccactggactccagcctgggtgtcagagcaagactctgtctcagaaaacataaaaataaaaccatataactatgataccatttacccacttaaaaattaataatcattcctcaatatgatccaatatttagtcactgttcagttttccaatcagctcatggtctctcttcagtgaacctgcttggaaatgttgcttcttgagttttcagtttcaggtgttactaattgacttctcattacatcagataaggctgtagctttcttcctctgcccacccgactcccagatccctcccccaccctccccatatgtgatccaggagttgaggccagatcactattcagtgtttacaccccttgttttctctaaaagctgttcacacctgagctgcggggtgcagtggcttcctttcccacccattggtggatgcgtgtgagccgtcttcccacccgttggtggatgcgtgtgagccgttttcccgcccgttggtggatgcgtgtgagccgttttcccgcccgttggtggatgcgtgtgagccgttttcctggctgttgatggatacatgtgagctgttttcctgcccgttggtggatgtgtgtgagctgttttcctggctattggtgggtacacgtgagcccttttctcgtccgttggtggaggtgtgtgagctgttttcctgcttcttggtggatgcttgtgagccattttctgtgtttccttgcccagaccctgctgtctgaattgcatccccattctaaccctggctcttctttgcagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccac

SEQ ID NO: 38737 - DNA, 134102 bp, Homo sapiens
gatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattggtaagtgcggagagctgcaaacttttccccctttctgtcttttcgggccccttccctctttgcctcttgggctacttgttacagtatcactgccttgcttctatgatctaattagtccggctattgtgcttaagaaagcagagctccatggggctccgtggggcacaatccagtctagtggctaagagaaaaggaggggaaaaagttttggcctagtttcagtatccacttgaaaggcaagaggggggcggcgggggtgggaatcttaagcatggcgacggatcgcgcgaggaagcgctgggttacaaagttgattgctcgcccccccccccccccgctttttcccgcgttcccccccttttcctctcggttcccttccaatcagctccgggagggcaacgtaatcgactttattaggaacaacagaagagtcggggaactgtgcccggcgcaaacccggagctctgttacaaggctgagatacttgcacggttgtaaatgcatttggtcgtctttgctaggggctgagggtttgcaatttggggtcccgaccttcgcgccctctgctttcccgccgcactccaccccacgctctgccgtggacaggtccgaattgtcggccgggaggttgggtgggatggggtggggtgggagggagtccttgaccagcgccgcgggaagttggagaggtcggaggggaaaagcgtatccgaaaggtgttgcttttggcctcctgcccactcgtgaatatcccttcccccactacttagagccccgagagccggtgactgtgaatgtccccgtcctcttttggcgcttaggagagcgccctcagctcccaccacagccccccgcaggtgacagctcgccggcctcctcggcgacagcgcccgccccgggagacctcccctggcgtgcacctcccggacctctctgagtcaaacaggcttccgggtgaagaaaaccgcctcacggaccgtccactcggaaaaactcccttcccctcactgtctccccatctgcatccatcctcccgcctctctgcacactcgcgccccccgccccctcaagatttgggacatcccggcacaaacttcaatgccaactttgcagcgggcgcggacgggaggttcggtttccttacttcacggctttgttaaactttgcggagtggggagtccacggaggggctttctccgcgcgtgcctttacgggcgcccacgcgatgtggggtgcggggaaaacgcccgggggcgccggcggcgtcgctgccagagctgcacaggcttgggcacctccagtcgtgtgcttggcgttttgtctccagacttgggtttgatgggaacaaattaaagggagtttggtactgtaaatcacggtaacatccaagccaattgtcttaaacaaaggagagtgggtgaagcttcatcaaggagagaaatacctaaaggagacagtgctcttttctctgtgtgcatttatccacaaaacagaaaagggttcagagttttcaaacaatctcttatccccagtgtgggccaaacagcttcacattttctttctggaaccctcaccctcaacacacacacacacacacacacacacgcgcgcacacacacacacgggttggcttttgtgttaggagcttctgtttggctacatgcaatctcgtttccccgtattggatttttcgaggctcttaataccttctctgctgggagctgaaggcagccttccctgtgccctcacagtgattatgcagcggttacaattacacctcttgtctcccttgatgagcagttgcagttagatgccattggatcttgtgtgatttcagtggcagaccataattaaaatttcttgcaccttgtgctttcagaattaaattggcctattatccctgtctgaccttcatcctctttgaggtttttgcacaagcagcaaaccattacacatagtttcctggtgtttgttggtgtgtttctttttctaggctgatctcctagctttgcagacagagcccattatccaagaagtaggcttcctagggcacttctgaaactagtaggatttctgggatgctaccaccaaggagaagccctaagggcactcgtgagtggctggtggacattggagcgactatagggtcagaacacttgtctgttccaaacagggtttgtctggagtaagtggtgccaaagattgtttttcccgaagaatttggttaatgacgacaacctcaaaaagtccgcggcaggtgctaactgtaactagcttcccctcaattaataaactgctttattccaatttccttgaaaaatatctatgtataacacttcttggaggaaactgtataagtttactgcttacctctccttcctcaattgcaaaggctgtgtctccaattcagatcagatctagcccatgttgaacagtgacttagcctttcctctttcacttaaacagtaatttttttttgctcttaaatctaaaatttgggtaggacccaaatatgggaaataaatatcaacaaaatgtaagtgaaaaattttcccaccaaacttccctaagctggaaaacaaaggaaactaaggaaagaatagcaacaaagtgggcaagcggagacagtagttgaaggaacagtttgtaggctggaagtcaaggtaaagttcagaaacctcctctgctctctcgagtgagaagagaactcctccgctgctcattgttattgccacttaaaaagtcagttgtcctgggtgtgaagtgtctctctaatatatctgcagtaggccaagtgagaaaaagaaatgtcccctttgaactggccagaatatatttttctttttgatcactctttttgctgatgaaagtaaacttaggaagagcaacttaggaaggggagaatataaatggcaaagctcttgtttgtaagggtgtgagtactgcatacaccacacacacaaatatacagcacaaaaacaaccaccccaccaaacaataacaatccgtgaaccccagagtgaccaggcaagtgagttaactagcaggcttcaggctcctcattggtagaggaaggagtttaaggtccctttcggttctaaaattgtgtaactctttcagtacttagagaattgtacatgacatttaggctgttgtttcgttgtagccttctagatttgatggagaaaatttaaacattcactataaaagcaactagcctccaggaattggctttggtttagccagcttaaatattctcctatttcaacatccttcttaccaaaaaaaaaaaaaaacaaaaaaaaacacatttttttgcttgcttttttttttttttttttttttttttttggcaccagtgtctgtaagctaaacctttaatgggattttgcaaaaaggctctgaaagcaacatcttacatagtagaacttagggtatttataaattcactgatttatataatgcttttttaaaaactttgagccactatgaaaccatacatctgatacatctactattctaaatacatctaaatacattctaaatatttagaaattatttaaaaatgcggtagtacctgaaggaaaagataaatatttttaaaaatataactttatcctccttaaaaataagcctgcagaaaacttaaaaataattctcttttgatttcatgttgggtgaatttagctcctgaaaaggcagctttgggggtggtggtagaagcagggagggaaggagaccatgtaccctgaaaagagagtgcagactaaaaatcatgaacttgaatcccattatgtgcaatttgctcagcttcaaattagtcatgtctcagaaatataatggttgaaaaagcaggtcactgttctcagctcttctaaaactgctaagagtatgaagatcagaactggattaatagaaaattgttgcattgttttcagcatacccataaatgagactattccaaacataaactgtaagtatcaacaaatcaccaattattatttctttagaaaagatcattgtttcttccaaaaggtaacttatgtgagtggcctttttaaatttttaatgttgaggatgtaatgtatactgtataagatataacatacacacatatgtaatcaattttctcaaattgtgcatggattatctacttctttcaaggatgtagcccacacgattgtgctagtattgtttaagtggaggcaactggtctttactgtgacccatttatgtgagcttttgtttctgctgctgttgtttatttggaagttgcagaattttaagaaattaaattacagttatgcagagtatatgtgtttactctccaatttattagattttaagcttgttgcatttcttttaatatatcttaatgatgcaatagttgtaatccttcagtatttgggtgtctggtgagaatcttgacaagaatcttgacaagattaatcaattggtttttggttgatgttaagtcatatttttctgtattcaattctgctttttattttgtaaaatgtcattgttttcctctttgttaactactagaagtatctaatgtggtttgtaggagtactgtgcaaccttataaattaatcttttttaaaagagcatgtttttaatttactcttttgtaaactcttaaaaagagttttcaattactcttttttaaaagagtaattgaaattacaatatttgacttaaaaaaaacttaactatttggttcttgcagtgtaatcatgctcatgctaacaatctctaattgctcttttttttttttttttttttgtgacggagtctcgttctgtcagccaggctgaagtgcaatggctcactgcaacctccgcctcccgggttcaagtgattctcctgcctcagcctcccgatagctgggattacaggcacctgctaccacgcccagctaattgttgtatttttagtagagacggggtttcaccaggttggccaggcggggtttcaccgggttggccgggctggtctcaaactcctggcctcaggagatccacctgcctcggcctcccaaagtgctgggattacaggcacaagatgcccggcttgaattgctctttcatctgattgttctttcagtacaacctgtctagacttctattcgaactttcccttttcctgttacagtgagaaacatttccttgagctaatagtgttatgtgtggctttgtgaggttttcaggttccctgcctgaaacccagattgagacttcaggccttcccttcctacatgacattttacaatgatttgaccttaaaatgtttaaatccatataaactgcagaaatatttcttaccttatattcctcataaaggtgtttctatggagatttagaattttgaatttgttgaaattatataaaggtccttaaaactcctgtgtgctacttgcctgatttgcaaaatatctattagggtgtactgtgtgctcaggatggggctacatgccgacacggggttggtaaagaggagacatggagcttgagtaaactaggggagctgtgggtagaaaagagcccctcgtcatctaagtttacaacaaaagatttcctaggatgtagttttctagcatcaagataattttcacttatttattgggaattcgagaatgtatgaaattagaacccctactaattataccatcaactaattatattaatatttcatcttgaaatagatatattaataaaatgataaaatgtttaacatgtattgaatgtgcaatatgtgccaaagcctgtctaatttcatctgtacaaaaccttggcaaattggtatttttgtaccccttttacatgtaagggaactgaggtgcagaaagatctagtaaaactgcacaagattacctagctactcgtggtcaaagctgggattgaactccagtcaatcggacatcagagcctagattatcaactttaggtgatcctcccactttccccaaaaccttgacttttaggcctgaataaaaatctgaatgcagggaaacatgagaatagcactaaaactgatttctcatttttataatcaggtaacatcaaaaggaagaaaatattaaatgtgatgataaatgaaatggagtccagctgtacagacccaaaaagtgccttgccaaggctgaggggaggacatgtcttgagaagtttgcctgtgccagtccaaccaattccattcaagttctaaccagtccccataattgtatgaatcatccaattgactaaagcagccaagttaaccatcaaatgtttgagattctgctacttgcaagaatattactcaattttattttctctagttggtgattttaacatatatgtagttatacagtaagtccggactttttcaaaggagaggaaagaaagaatcagtggaggttggagaggtttttagagggtgtaggttggtagtgatggtggaggaattgagaaaagagcctcttactgaaagctgaaaattcttttcccatgcggagaagttttgtttgtatgcacacccatgcataataacgagggccttttaaaccagagactcctacaaacagcagccctgacagcaggaataggtacattttgttctttggaaaatatgctaatagatttctctattgaaagatttgcagcccttgattttgatagagaccctgagaggtaatgagacacagggagcatcaagacacgaaatgatcacgactatttcatttaggtcttactttttctctgaagggttgtgatggtggcctaataaatgtgccagctctgcacagttctagagaaagtgcccgtatggggatgtgggaaggagaggaggagcttgagacatgccaattctcaaacttaatgatctcaaactttagtgttttctaagttttcttctcataaaatgatgaatctaaaaggattgctaaattaaagaaaataatgatgtataatttataatataaaaatactaaatttctatagcctcttactaccacctcttccccccaccccccacattctatccctgactaaatcttgtaggggagcaaaagcagtaatcatattggaagactgggggactatggaaagcgtttcacatgtaaagattcacttaatgatcacatcaacccaaagaagtaaatactttactttcttcaattttcacatgaatctgaggctcatttaagaaccttttttgaggttgcagagatagtaaataagagtgcagagatagtaaatgagagggctaagactcaagcccacagtccttgattgaatcctaagccatattcttaagcttaatgctaccttcctcccattgtcctttccatttctatgggaaacaaagggatgagtgtggtgaaactgattctacacagatagagcagaagatgaaagctcaatcccccccaccttttcgttttgcttccaccccttccccaaaccatgcactcatatcactgcatggttactgatcattggcctattacttccttaacaagggatccccaactcctgagacataagaactgcctacaccagccattgtaaatattggcagtgtttctgggccatgctagggagggctgaacctcagaaattacatgccaacactccccaaaggaaattattgcatacagcaaaagatggcttagagttgtaataggaaatttgtcgagatagtgggccctctgaatgttccctggatttagcatacatcgtaggtcctgaaggtagctgttgaagaaatgggagtgtaatgaggatgtggaataggaagatgggggtagaatatagactgaagaaaatgaaatgaagggctctggaaatatatgagactgtcttttcaaggacacagcttgtgcctggatttccaaaacctgcttccagtgtcacccaatcccccaaaactgagctaacatttctatctgctatgcctatttaaatcctgggccttcaagtttaattttctgctccccctttctccttagtactccattctcataatgtggccaaggggtattctttctttgctggcccacaggaatcacagggtcttcttaaacatctggttaattccctgggttaactcagaggttttatccacagatacacatttccaagaaagcagaggtaattgaaagaaaaggccaagttattacatttgttttggcaaggcattatgattttcctttagaaagaagataataagtctgtaaatggttgactcagtttttcttcagacctagtttaataaggccagcctcatgaaagttggttggaggccagttaactgctgccttggtcctggctgaccccctccaaaagagagagcttctggtctcaaagcagcgtcatttagtggagagaaacttggctaggactctgcagacaacctgtggcctcaatgatcccaaaaaagtcataaaatctcattgactccctctctcaactgcgatgtgaaacagagccctccttcctcatggggattgctacaagcataaaatatcactggaatctactatcttgaggacttgacacttgttggagtgtctcattgagccaggcctatcagagatgtgatttccagaggactttgcactgaaaccatttgattaatcccaaatccatctctcctacatttctttgtccctctctgttcttagatctggggaaacttacacacgacactgtttattatccattcttttccttctttgagtcaccaccactttgcccaacacctacagatttgtagatctgttgaggcagaaggaatgggaatgacccaaaaccttacttggtttgggtttgaaagtttaaggaggtcatcctgctttctaacattagttcctgtgctataaccaagtatttcattatgaacctcccccaaatgataaatattaatgttattgcagaaaactaacaaataagaacacaagtccaaatcttctcctaaagcatgcacattttactcccaagagaatctctcatgcttttactcaatctattacttttactttatatacagtgttagtgaagcttgattatgccattttgtaagtctgtccttctgagttgggatgatttgccaaccctcactggcagcacagacttgtagaagtatggtaacatgaggacataggatgagacaagaaattgattaaaagtctctattcagaataagaatgcctgggattcaggggtctctgggatattaggcaagtcatttcacacatcagtggtacctcacccctgccccccacccccacccccacccccaccccacaccttggcagcatcaatacattctaggccaatatgatacttgattccaccctaaagctgtgggattttgtcactgtccatgagtgtggctacttgaatccattgtatccatacactttggtggtgtttgtcctgaatagaagctgaagagcttgtcagtattaaatcgtaaggatgaaagggccttcaagactatcttgttctaccttaatttagaaggaattcgagtcccaggaaagggaagccattcagttcatgcaattagaggtggagccatggcttggacgcagtttctaatgctactcagtgccccaaagatatatgtccttcagagtttcagtgtgaagatcatctgatttctgtctaaggctattaaagagttaatgtgcagaacattcccaactggtgcttcttatagctcgattgatttttctgtcacttgaaaataaaatagcaataactttgtcatctcccccttccctttgtatccttaatatacttagccaatcccttatggaacaacagaattatatagaatgttatgctatgctatgtggattttaaggaacactacagaatttaaaaaaaatcaactaaattccttccttgcttgctgagggtgtggtacattcccttcctcctgcttggggaaatgtaaatttaaaactctaaaaaacacacaccaaaaccacgcagtatagtcattacttatccaatccaaagcacagtccttgcgtctagttttaagactttatcagtctgaggcttccttgactaaaaaaatctatgactaattcttgtgctttcggaggatgtttgtggcaggcataattccgaagttctagtgagcttggggtaaagtcacatagcactatatattttggtcgaatttacatacaaaagcagcaacaaaattcctcattcttcgtctctgccatttcttcactttgaaggtaattgcaagcagaaaattcacattgccaaaataaggcttacaatgttatgggcccctcctttgtgactaacaagtgtatttttgtgatttgagtggtgcaagtattatactgtaaattcttcctcctctgtcttttcattttgttgaaactgagcagagtcacgaagcactatgtttttctgcaccatctaatttagctgaaataaatcttgacttttaagtctctgtttaacaagcttgccttcaggtgatcactaaaaaagttacgttccatgttttatgaattccagccttctttccaggcagagcagccctttttgaggttctatttcttttactcagttcccatatattttatctgttcttatttaggttgtaatttgccccagagcagaatgcctcagacatggaaaagatatagaaaagacattcctttcttttttcggttctgttgagctagttctggcttgtgtgaaccaggcttttaccttttagctcctgtgtgtctgggctaagtgaagtcatagataagatttttactgaggctttgaaaagactgcacattgggccttgctgtcacttatagaatatctcagaaaggttttgcttcttgaggatcatatgaggatgtgggtggggtggggcttggctgtgacaggcaactgtgggacctcagctatctttttattcatgcctccccctgaatttcagaatttgcaggtccatgagcatgccagtattaaatccctggcactattctttgaacatgcccaaacaggacagagctttgctctatgagaatgtggtatttctgggtaatagttgatgaaagagaaaaaaaagataatttgtaaatgctcaagatttttaaactgaaagggcactaaggtcatcttttaattagcatttgtttctgtttttacagatatcagaagaattcctccaataccttccttccctcccccacctacttcttgaaaaagagaaagtttaggagatcgatgagcagtatgtttgggattttaacaaagtcaagattaatgtatatatgaaacagtaatatttctatgttaaaacttcggctagttacataaagcagctctgtaaaggaaaggcattaactcttcccacttgacagaactgttacttttgtaattttgaaatttttgaaattttagtaattttgaaagttgcctcttgatgtgggcttcttacaggattcttgagaaatagtcacgctataaaaataagtgttggctcgaggttttccatttgatagttcatgttaaatgagaagcttaatccttgagaaacttgatctctccattcaaagtgatggatttctataataactgatggaatgtggttttatggttgataaatggcagtgatctgatttatctctttgttatcaaacttgctttgtaacctagactaaccatttaaattctgtgagcctcagtttcctgaaccaaaaatctctgagtcacgggggttgtgggatttaaatgagagaacgagttccatcttcttgggagcctgcacataggtgttagatcaattaatatatgtgagccatttctctgaaggagaggttgcccataattaacttttcaagtctgtttgtttgtttattctggagtcaacttgtgtctcgtaaggtcaatgggcaggttatttctgcctcttaattgattggataaaattagaaacccagccaccctgcttgatagccttcctattaggcaagatctatgctagccaatagtccaataagcaggtcattcatatattcggtaaattagagtaattaacttgggttgtttttcctctttttaaccaacatttaatttgaatctaaatgtttgtcttttaaaattctgggccagtattcatggctctttagagcatagataagcccaggtagcatgacttttttaaatggatatcactcattatgtggaagagatttattccctctttgcttgctgcgaagtgaatcccagttgtacttctgttttacattataaaattggagtcatcatccactgggaaatttttttgcttctagataataacgtgaatgacaaagacttcttaaagtcaaactttgaggaaaaatgatttttaaaaataaaatattaattacttctgaaacattagctagaattatagtttataagaaattttaaacaaaaaataatgattaaaatataacctctgtcaaactgtaagctgtatgagaataatgatggtctaatatactcacctttatggctgttactacagatcaatgcaatgtaggtacccaataatatctgttgaagaggtgaatagatgaatgccttgcattttggacctattgtggaggtaactaaaatgcttctactttaaggctttgaggtcctccctaagttttataacattatattccaggctattattatttaaatgggaggagggtttttattattcacttgaacataaaagattgtgttaccttcataatatacatgcttacatttctaaaatggtacaattttggagttggaaagggacgtttttccattatattgtggaaactaaggtccaaggaagacatagtgagaaataaggtttgaactgagctttctgaccactagcggagagtttcattacctatgcctactgttatgctgattgttattatgtctgggttatatattttggtccctacttggccataaagccagataattgactgtggctggttgtctatactagttgattaaagtttagtgggaagaagggaacacacagaagtatatatatttccaaattttgaatatccaaatggaactgttgaactgtaatgcaaattttgagatttactgtctttaagaagtaaatgtgtttcttctgttccgtgagggctattttgaaggggcttcttttagaagagccacatagtttgcttaattttctataaacttttaaagatgaaaaacaaatctttgaaagttatccttctaagaattttgtagatttatttacagttgtacttagagaccaataatgtatttatgatgtcagcttttataaatgcccttgacaggaaaatatagttcattcaagtaactacctctgcattccactgtcttcagcttatagatctggtgagtgggaatgaattcattcgcacattccttcaggattcctccaggttcctgcacacaagctgtgccaaatgtctgcctgcaggcaaagaggaacggaggcctgtgacttgcaagtagagccaggcagaggtgcgaggcgggaacagggattaaaggagcatatgtaaactgaaagggaaggaagcaagtatgacaaggcctcaaaacggcagtgcctggcaaagagtacacacctagaatgtgataggtatgattttatcattaatcttattcttttgatccagaaatgagttcttagaggtaaatcacccacccagggttctttggaggctggcataaaaggtctttgcctgctgtgaacctagttgtactggttcagagaaatatagatgattccagttccagacttggatgtacgatttcttgtttgaatttaaaagcctgtgactggaagtaggtatttttgtcccctctcaatatctatttatatttttgaacaagaataaaatgatgttaaagtaattaaaaacaaagaaaaaagaaaaaaaaatccaccattttgatacaaccattctatgttaatgttttattctttccccttatgtgactgaatatttccaattttctataaaagaaatgtataagcctacttagcagaggctcagaagtttattgtgtatgctgcttctaccagttgtatgtttactttggaatttcagcagtcagttcctcttctcttccttcaatactcttctctgatacttaactcaagattgtggttgagccattgaaccatgggaaattcattttcaaaatctgcttaattgctgtgagacttttaatttgttctggatgatggtgctaatgtctgggaactgggactgaagccctccaaagttgttaatttaatcaaccgctgtgtccttgccatgcctaatgaagcagggggcggtgggggaaccagacccctctcacaaaggggctgggttcctcctgaccaccttgtcaaagataaataagaggggccccacagttaagctgaacagttggagcaaattaccagagtgtcagcccacgttatccaaagcccagggttatgcttcccaaaataattactgagtaggttttatgtaggaccccggagttttaaggcatgggttttgtgtgcgtgtgttcacacctgccaatctgcagaattcttcagtcagtttggggttctgttatggctttgtccataatctgtaagatcataaacatcacccccagactattgatgttcccgttaaccactgaagttttccatggcgagactggtgaaagcttgctctgtcctcatgataaattagcttgtttattcctcttctgcttatttctatcctgctgttggttagtgtaatgaagcagaagtccattgtatgtgttcattgggtagcgatcctctggcaccaaagggggtaattgagtagaaaggcggaatgctgttggtgcatgggagaagttaacaccacatgaggtcaccaggcttcaagctttaatcaatgtggacacaatgcaattgagattgtgaaaagggtttgtttatagtgtgagagtaagggtcagtagttaatttgaaatgctgtaggtgtgttttccttgaaccaagaaggtacagagcatgtgtcatagaggactgtaaatatcctcaagggagggacgtaattggggtggggatttaaaaagaagggcatttaagaacttcagtgtacttcttattgctccatccatgttttattgaaattttttgccattttttaaaatgaggagactgtagaagaaaagtatttaagtccatggtataaacgcacagccctaccaacaaagaactttgtctttttcagcagtgatttcctttgggaagatatttggagtatataaaatattgctaataggacccctgtatactaattctgaaagaatgctcactctcagaagtttatatctttagaatctgtcattgttgcggcttgaattaaataatatgaaaaccattaaccctctacttgttcatgctgctgcctttttccatctcagggctccagtctgtaaagtgtgcctgtctgctttttggattaattttggcatctcccccattattgtctaagtttcaacagctagaaacacagcttcagccaatttgaatgtagagagggcctgcccttttgctgcagagaaactttgcaaacaaacatctggttttctgaaatgactgcagggaaaaggacatgagggtaatggaggagccagaggcttgccatgaactctcccatgctctgttgtgtgtttgtgaaatctgcgtaatgcactgatacacctgatacctcacatttgtatagtgcttttatccttcttgaaggtactttagtagaaatcatcttatttgatcttcccaacaacactctaagataggccagtccatcagggatatttacattttaaacttatgaaaactgagatggggagtaactgtttgtggtatggtttatttggcaaggcagtagctatgtttgtggaaggaataactcgggatttgaatattaattgctacattatgacaagttgaagaacaagaaaaaagagtagttttaaaaaatatgaactacttgtgatagaaatcactgtgtattggccaaacatttctttttgagctctcttccaggacaagtaaatgacagttgtggtccatcttcttcaccctcctctgtgtagcaagccattcccatgaacagttgttgattctctctttacatatttattcaacacattttagcctgctgagggtgtccagagtttttctctttccccgggtggaatctgggtctttagaaccccagggtaaatcttaaagaaggaaccagggagtgcctaggagatgagggtgaaactaatttactgggtttagttagtgaatgatgctattgttgcccactttattaattcttttgtatagtgcctttctacttatttaagccatgctaataaacatgcattgaaaggttatttttagtgtcagtatgataacccatagtatggataaaattaaattgctcaatctattgttggacatttagaataattccagtttaaggctattataaacaatactggagaaatcttctttgtatttaaattcttatgtacatcctttattatttccttagtaaattcacttttgtgaatttatcttaggtaaaatgaaatgcacatttttaaggattttgatggtcagtgataatcatcatatcacccattagccaaatctgggaatgtctatctctttgcatgttagccagtactggtgattacttttgtttaaaaaatgtttcccaatgtgctgataatatcttattcttttaatttacatttcgttgattgatagtaatggtaaacctcttttcatgtgcctactggctacatatatttttatatgacttgcgtggttgttcctttcttttaatatactattttcaaagttggatcatcccagtaatacaacttcttggagattaggaaaagaaggaagatttattggagaggatgattggtgttttttggctgcctagtgtttcgcctatttgttttggcagcaggatctgcctgaatctcctttgtggagcatttttttccccactctcagtccatgtgccttaagagaatcttcacttctgattccagtgatggacatgtgaccaagccaagcactagccacggtggatttatgcctcaagttagtctaattagagtgaattctgagacttgtgtggaggctaccaggaagagatgtcctctctttttcttactgaatttcaactcacagaatataagcctggaattgttggagtctttccaatgaagcctgagaatgaagctaataaaatacagggtggaattcaatgactgtagagaagtgagatctgttgacataatctgatttctcaaaacaaccactagaagactgctttatctctagatatttttcagtatcatcttactaatttagtttttgcttaagtatctttgagcaggctttcctgtctcttacaaccaaaagaaactgatacacttgttatgccttcttcagtttaaaaataagttggtggaaccagatgtggtggctcacacctgtggtcccagcactttgggaggcctgaggtcaggagtttgagactagcctggctaacatggtgaaaccccatctctattaaaaaatacaaaaattagccgaatgtggtttcacctgcctgtagtcccagctacttgggaggctgaggcaggagaatcacttgaaactgggaggcagaggttgcagtgagccaagatcacaacactgcactccagcctgggtgacagtgcgagactccatctcaaaaaaaaaaaaggagtaagttggtggaggccactgctgcattgcagagtgtatttggacagttagcttattttgatgaaataagtcctctgtaacaattaaagaataaaataagttatggaaccaacctctgttaggcagctcctctaactagagcagtattggaaatggggtgtgtgtgtgtgtgtgtgtgtgtgtgttcagagatcactgttgagcaccaagttgctggtgaagatcattagtgacaattcctggaacttggccaggctgctggctttgaagcaaagctcattgcaacacgggttcctgctgggctggatgtctgtgtgaaatggatggcaacaggatgtcccagcagctgaaatgaagatcctgaaggcagaagagaagctttaatgactgcccaagccgagcagtagtgctggggatggttgggaaattcagtagatgttatgatgactcgaggtttctttgggacatctagaaggctgtgaggccgaggaagcaatgagcagcacacgttgctacaagttctgaactaggttagccatgggctacagaaggagtaaacacatggattttgccctccagcaacttaaatttgggaagacaagatccataaaataagacagtttgttgttaagggctaagggatctaggcattttttagatcagataatttttttttttgatacatgggggtttggtatgggcctttaaagtatgggacagccatctgaaatacaacttgatgtgcataatccaaggcaagattcatctcactcaaggtgccaaattaataatgaacttaatacagaaagccatgagcagagtatcaagagttctggctctagccccatttatctctttggtatatcattgaatccctcatgcttcctcgtctttccttttttttttttttttttttggaatgaagtttcgctcttgttgcccagtctggagagcaatggcgcaatctcagctcactgcaacctctgcgtcccgggttcaagtgattctcctgcctcagcctcctgagtagctgggattacaggcgcctaccaccatgcctggctaatttttgtatatttagtagagacggggtttcaccatgttgaccaggctggtcttgaacttctgacctcaggtgatccacctgcctcggcctcccaaagtgctgggattacagacatgagccaccacgcccggctttacttcctcttgtctttctaaatggacctggtaatgctttcccttggcaaataaaaacagaggcatgtctttcctcaaagccaagtatggttgggcttttccacccatttcttttcttccttattaaaggcactaaaataaatcttcagacatgttaggttacctatcattagaaatttattttagatgatcattaaggtatatcttagcgcttagctaaattctgaagaatacaaagaggcacgagagatgataatctgttcatctgtggtgttattgaaataaagcactggatgttaaattagtgagttgagatctcagtatgggaatctaccacttgccagctatgagacctagtcttgcttttactgtctcatctgtaacctactatagatctgaaagcttaaataagataattatatgaaggcatttatcttttggattataccaaaaacagataaggtggaactatttagctgagtagacaggcaatgacatatataaaaacatcattaataaaatagagcagtgtaagatgaaaatattaggtaatattatttgagtacttagtatgtaccaggcaatgtattaagtattttatgtgcattatgtcaactcccgatctggtagtgttggaactaaaatcttcatctaacttgctatttttatgtttaaaggtctagagaaattgaaggatccttaaagcactgatttggacctccttaacttgttaattgtattttcttttaaaaccctttgttctaaaagtaatggaatttgggggataaaacctggaggtggctgtgaattgaccagaaggtttacaagtacccataagggctggcattgtgttagacattgtgggcaaattcattcagctctgggactccatctgtatttcccttcgtgaactcttttgctgaatgtcccatcatcctttgtcgagatgaggtcctgttcatcctgtctgctttcacaacataaatgttttaggaactctccacagactggctggattgtctgtttgggctgtgaacagattgtgtgggtgatgagacaagtaggaaaagactcagcgatcaaaaaagggggaaggaaagctctttctctttctcttagaatggagctcggatacaaagggtacttcgttaatcatgcctcctttgtaatcagaatgggggaggtatttttttaaaccaccactattttgtcctctgtctcatccaagttaagccaactgtgcaatggctaatcgaggggttaaaaatttcccagatgcagccaggcagaatcaacttcactagataaaggaatcatttgatggtgatttgaaagctgtcaggtgtagcaccaggcttcttgcagacatggcactggcctggtaggatacccatgtccaagatccacatggtggcagatttgtgattagatgatgaaaatctcatgagtggtgagaaatggggaagagatctgtaagacttaggggttttggtgagtttagaggattcagtcactttgcactatgtccctagaacaatcactgaatggaaaatccaagcatctcaatttactgaacgaccttgggcaacttgtttaaactttctgtagttgctttcttagaaatcaaagaagggtaataatctttggtgcccacttaatgggtgttgtataaaataatgagattgtaaatgctttgagtgccctggagatgaggcgatagggaaaattctcttaggtgttcttcatgctgaatatggaaagatgaataagattttgttgttttttaagaaaaacctgttgttttttaagaaaaacctgtcatttttttagcacctcttttttttttttttcttttacaaaggaggctgtgtgcctcagtagaggttgactttgtaacagttttactttcctggacaggtctgcaaatttacaatgtagtcggttttccaagaggaatgtttgggtttagacctgtcctctccattcactaaatctagtggtgagatgtttttaatgaattgttggtgtacagcaaataaagagcaatgaaacaaaagacagtgtttagaaaaggactaatcaactgttactctaactgtcccctagctggatggttgcctattttctttttaaaattaaatgcagtctttaggccaaagcagtgggaggtggcggtacattccaagaaagaggcatcagagtgtctgagggttggaagacagcagaaagctgcttgattcttggtgggtttttttctgtttgttttgtttttggttttgcccttactgccttaccccttgatcatctattcagaacagaggggaaaaatcctccacaaggtttctcctccccttggtttgtgtcacctaaacaacattttcttcccaggtgagattgtagtttacctctcctcttgtagtgatgagcggctggggctttccgcccagtggaccttccatttgtctgttttcaacagggaaccccaatttactaattctctggagaaacagagattttgcttggggagggggcctgagaatttgtttagcccagtctcacccacactgggtctcccaagagagatgaccttcctgttaggatctttctattttagcgacctattgctctctagacagcttgtttagtttttcaatccagttggaacattacgatggttaaatgttctttcttatcattcagtggaaaactggcttccatgactgcattgtaatttccactcatgaatgctggattttccatttagaataatcttgaatgtatgcttcacttcagttacacagtagcctttcaaataactaaagatgactatcatttctctcctttgactttctcttctccagttaaaatacccctggtctggtttagactcctgaccatacttgctgtccctttctggtgattgccttcccagtcaaggttaagtttacctctgctaccatggcaaccagctactgtttgttgtttctacttaaaggagagcaccattttcctattttctgcagaaaattcataattcaaaaatcagcttgttgatgtccctagaacaaagacatccatactgctgagtccacatagtgctgagatcaacaacctctacaatagtccatacagtggaattgccatttgaactcatgtaactttgggtaaatgtatttcttgtgtatccctgcattagtttttctcatcaggagaaacagtgtggcctgagacaaggagagactatggacctgggacagattaggttcaaaccccagttcagccacttattggctgtgaccttggatgagttattttaatttttcagggcctcattttactcatctctgaatggagataataatatctaccacttcttttttttttttgaaacggagtttcatttttgttgcccaggctggagcgcaattgtgcaatcttggctcaccgcaacctccgcttcccaggttcaagtgatttctcctgcctcagcctcctgagtagctgggattacaggcatgcgccaccacacccagctaattttttgtatttttagtagagacgggttttctccatgttggtcaggctggtctcaaactcccgacatcaggtgttccgcccacctcggcctcccaaagtgctgggattacaggcacgagccaacgtgcccggccacacttacttctgtataagaatgaaaatcaccctgttaagtccctagcacaatgcctagcacataaaaaatatccaacaagtggtagccattattataatttctaaatgacagcctgatgcagtcagtgtaacatgaggcaaactgtaatggttatgaattgctgagaacttggaatctctgtagttggaaactctgaaaatgaagtgttgtagaatggcttgatggagtatgaatttttcttgtaagcctggatgattggggtaaagcagaggttctccaccagaagcagttttgctccccagggaatatttggcaatgtttggagaagacttcccccacccacaccccccctgaacttgccagcagtggggatgaagatgctactggcagctagtgggtagaagccaaggatgttgctaaatatcctccagtgcacaagccaaacccccacaacagttattcaacccaaaatgccattagtgcaaagcttgagaaatctctgagtagagggatggggaccgggcagccaagaataataagaggaaattggtaggtatagctctctgattgtgagaagcccagaatttggaccaaatattaaaataagatgatggcccagtgcaggcatatctctaaccttatgcattctagacccacactcctaacacgcctttctaagacatcaatcctttcaatgttccccatgtcatgtatgaacacaataaattctgcctaacgtttgcatgatgtgtttgcacctctcttactttctcatgttgcctctatggaagacatagcctctttggtccagtctccaagtagggattctgtcaaagaaacaggcagtcaaccaaaggtgaatttaaagtgacctaacaacttctgttctttaactgtcaaagcatggtaaaggggatatataatctgtagcagtacttctagcaatccctattttctttcccatctactttgatgtttctaacgtctcttccaaaatctccccaacactcccgctggtaaaccgcccccctctccctgccgagctcaagcccatatcttctacctatcccctgtcttttgattgtgcatcatgaaaactcaaagaatccatctagcaatagttgaatcctcatcggggggcaggtgagggggttgtgacagaagaggcaaaaccagcattctctttatctgaagagaggaggggaaagggtagcaaatacccatgtcaatagtttttgctctgccataactattttataataatttgtgaagataattgtgaaaaaagatgttatcatcccatttttctaaggataaaaccaagggttaattctgtgttccctcaaataacaggctgcttaagatatgcctgggatatttctcagggttatcttagatgttccagttaaaatttgtatagaatcatctctggtattggggctgttcactgataggtgaggggagcccctgtttttaacatccaagatgcacaccttctagttccttaaatattgatgaacacacccctcagggcaagaagacagaacagagaacatggagtaggtcttcatctcccaccagattctaattcttctcatgtgttgacagcactattattatcagctaacattcattaaggcttcactattttcatggtactgtaatagggtttttatattaatcattttatcctcaaaataaatttaggaggcgagtaccttttagtacacttttacaaaagggaaactggcattctacaaggctaggtaagctgccccactaaattgctagtgagtaacagagttgggatttgaacccaagtttttctgagctctagctcttgcttttaatttttcttactctctttttgtaattgccttcagcaacataaagcaccgttcctgtgaaagtaagtcccttgctactctgtaatcattgttttctcttatgacatactttttgtagagggtaatcagtgtaaattttgaaatatattaggaacccagccgtttaaatgaaaatctgaaagaaagttatgaattgatttcattagcaaattttgtcaatgatctcttggcttagaagtgtatgctatgactttcatttcttctgaataataaatagacttagctctcttgagcttatttctatcatcctaaaaaatagaggctggacatgatccaaattatttcattgtattggaatgtctttgtgttgtattaggctgtgagtattcagaccactggctggaagctggaatggtgttttttgttgttttctcctaaaggtctttattattattggattagacctaccttctcatattataaattatgggggtataattcactgtgctaaatacatcagtatgaaagtttacatatgcagttggctgtagcttgtccttgcttttaggaacagttctttgatctctccagctgttggaagacagaaaacactcagaatacattcagatcccaaacagtaacagaacgagaataggaccattaagatctgttcttctaacagatgtgaaaatataaggacaaggagggggaggaggggcctgatagggacagccagaactcttggaatataaattgaccctaatttgtaggaactttttctttaaacttaaaagagtgactttcatcataacgtagaagtacatacattctttttagaatcctacaattgctgagttaaaagtgcttaacagtttaaatactgccttttacagttgagaaaactaaggcccaagattgattgaataatttgcctgattaatgcatatccattgctagaacccagcaatcatgagtcctgggataatttattctgccaagattcttatgctcaaatttgtagtagttcaggaatagcagatcaacttgtggcccagaatcgaagctctaaatattatatatgaagaatgcccatagaataataatgataacaaagaccctaaaagtcacctttccatccctacccggtgctcaaatgccctctgcattctttgcactcaccaagtgttaactgaggagcacctccactcacacaggtgccggcagctcattttcttcaactggtgtggtgaactgtgggccagtttgattttattgatctcagatttccttcctgagaacttgcaagattggaaccactcagggtaaatctaattcctcctccacatttagtcattcacatatttgaccttttatcttcaaccctccatactaaaccccccttttaaacaagctatacatctccagcttctacaaattctacgtgtgatatgacatgtcattcatttttctttgattcctgtcttagtgaatgacatcactcatctgctgcctatgcaagaaatttggggacatccttgacttctcttgtacttacatcctatgtgaatcaacagggacagtaaattgttcatcctacatcgctctttcctctagtaaaaactgcccctgcctgtcacccttctgaatctctgagtcacttcagaacttctgataccagctacactccactgttccttcaacaccaagaagattttcaccatttttctttactaattctttgagaactttcatatgtgattcactggggcagagagaaaaaaatcatttacatctctgggaaatagtacatacgtgcagcagaaggttcctttgcccaggtttctgtctgagcctgttttgtagttttgatctcagaagtagaatattgatgcttttagaagggagtgtttgctttttctctggtaggtactgtttaaagggtgttaaagaaatggccaaaatcttccctacatgtgttcttaagaagacacattttgtcataaaatcttcaaacattagttatatacactaaaggctgagatgtgaacattttatttcattttgtcccccatttgctttctattcatttaggccttaaaaccctcagggcagtgctggaagaaggtaaataactgtaagtcctggctttgagaacctgtttccaggaactatgctgaacagcagttatctaaacatgttcctgcaatattaatgttggccacaaaccctttgggagcagttttttttaaaaaaattaccattgttttgtttgcctactatctaatttcttttgatgtgtaaattacttgtgtggattgggttatagtttaggaaaagttcattttgatcttcaaaattcagtatttcatttaatatattgcttgacacggatctggaagaaccgtcataagtatttgtaggaagtgagtctctgatgagcacatgtgtgaccttgggagactgacctcacggaaggcagctctggcttcttcccaaactgtcactgagtgccagtctaagtgtactttgatacaggcgggacaaggattaatccactatggcatttaaaaaatgatgcttagtaggcatttgataaaattttgttagttacattgagcataacttacattaatatgtttattatgacacaaaagccatataataaatagttcagttcaggtctggaggacttgcatgtttaagtttctgtgcttagtggcacaaggcagaataagatgtagtccttccccttaggagcttataattttgtagggttcagaagtgatgcctgcaaataaagtagaatgctataataaagacatagaccaggtgatactggcaccaaaggaagtaaggatcttttgtcaactgaaggaaaatcagaggaggcctccagctggcacactataggcatttaacaaattgaatgaaggagagacggcccttgagctagaacctaaaactgatgaaatttaaaatactaaataattgcatagactatttaattttgtgatttcaatgttttttaaaaaaatatttccggccgggcgcggtggctcaagcctgtaatcccagcactttgggaggcccaggcgggcggatcaccaggtcaggagatggagaccatcctggctaatacggtgaagccccgtctctactaaaaatacaaaaaattagccgggcgcctgtggtcccagctactctggaggctgaggcaggacaatggcgtgaacccgggaggcggagcttgcagtgagccgagaccgcgccactgcactccagcctggacgacagagcgagactccgtctaaaaaaaaaaattaataataataataattcctaagaatgtgaatgttaaaactgcaagttacccttaaaatgtacctctaccctcaattctaggaaatttgcaaattataagggcctgtgttttctttgaataatcaatcaaggaaggaaatatgattattcttggcatttgtgaaattccagataaagacattaacaggtcttacttgcccttagccttaacttacaatgtacaatactaaatttttgaccattcagaatgccctgtactttaattgcttttatctgtttatctggaactggtcagaaaatagaaaacaaatcaataaactatatgcagctctttgttggaccttaatttctccattccctgacataccatatgcatggataggagacttattttggtgtgactgagaggaacttatatttagttcaggctcttgctcttatctatccatttacttcccaaatgtttccatggttgaggaacccaccctttcctgagtcaaactgtgccattgtttgcctacctgaattataagtaattcttccataggttgctctggagtcagattttctctaacttgaattcctgtctctcactatgcctgcaagtgctgtcatagacttccatggcagcgctgtgttcctgagtcagatcttctctaggctaacatcctaaacactgcctacctgcaatatgaagtcataaccaagacccggtaaaaactgggagggtatcagattcaagggagtttagtgcattttcatgagcctattactccatcatttctttatggaagtcttagaggtactctgtccctgactgtaagtctcccagaaaagctatcttgctggctccctttgagtgacacccagcccagtgctggtagtgccttgcctgtggagcttcagcaagctacttatggccacagtcgtcttcattcatccctcagctctgcaactatctcaggtaatctgagagtgctaataaatagtaaccgttaataaataaacagatagttgtattggaaaggagcattagatatgaaatcagacctgggttccagtcctaactctatttactgatgagacaaaaaccactgatcttctgaatatgcaatggtgctaattatgttacttgttaactaggtggattcgataatctatgtatgtgaaagttctttgcaattcacttactagttgttcatgtttattattaacaataatattgataaaagaatatatgtaatttatgaataataaatgtctgattattttaaataacaaatgttggaaacttgtagagtgtaataggcactttagagcaaagccactgactgtgtttcttctagaagatttaattttggtattttctgaccctaaaattccaatataaatgtgtgcccatggtgagctgatttaagaaggagagccaggtgtccccttttttgttacctccacccctacagctttgccagagccactttgggggcctccatgggggctctgagagatttcccacacaagaactggtgcgccctccatgctgggtttctgacatcatagcccaaggtagtaaattaaagatgctataattcactttccacaggtggtcttggctgcattccacagtcttttggctgaaaggttgctgattttgaagcactggcccaaagtcaaaacttagcccagatgactggccagccgagcaatgagcaatagcgtcaacagatgagccactgatttttctgtggaggtcttttgtgttcacttcatatgtatttaatttttgctgttttgagtatttctggagtgatggagaaacagaaattgcaggcatttttcagggatagagaaattcgtaatttgatatacttccatcagtcttttcgatttaggctgtctttgctgcaggacaccaagggtggtaagggtcagtttttgagtcctaatccaggccaccactggattgctacaccaattagcacatccaatgattggcagattttatgagctaaacctctggcagggccctttatgtgcattttactattttttcaaaaagagggtaaaaaactagcaccaatcttgagcctaaaataatttcatgtttgccacaccatttcaaatactatgtaagagtttggctcgctgtcccaaagcactttaatttttttcctcttggttccaatgctcctccattccatgggatccaagccaggcaagtaatgtaagccaagtggcgcttgtttgccacgtagatcctgacaaatatagagtaattcttctattcttcaaagctgttgcatctttggctccacaacaattgaggttgtaggcgaagcatttaaaatcctcatctgcctaaaatgtaaacatatgatattttcaatatttttgagtcggaatgtatttacaagtgtttgctacaatttttggaaaattgctgtcaaaatgtccataatttcataagtttatattgtaaagaactatttttaaataagtgcttgacttttgtgtgtacggtacaaattattttgcattcaactctgctatgtagtatgtatgtttgtgttttggtggtagtggttcagtgtaaaggaatgttctgctgtattaaaaaaaattagctttcctagaacagatgttagcataactaactgactgaaagtggctggcaagaatgaatttcatttcacttagcgtaccccatttcatgcacaagggcatagctttgataattgtaaaaatcacttctggtctagtctctgtagacacactttcagctctccagtaattgagattgaattgtgaaataatacttcatttagtaagctagtaagatttaatgggtatggttgaaatataggagaatcttctcttcaaagtaggtggtggagaaagcataagtgtctactataacttcagagcaatttcagtaaaagaattaacacactgaatcatttaagtactaagtcaatttaatgcaaatatttgcactttctttagctgaactttttgaagagctcattctaattagccacccaaaacttagataagtggtatggcagatattaagaaatctttttaggaactgactttcagtgaatggtaagcaggtttggctcataagacctcacagctcagccagttaatatgatctggccactgaagttgtgcagtatatttcacatgtttccttttaaccagaattaaggcttttgagctggcgaaaggcatgtggaatgtctaaggaaaatcaattgagcatatttaaagctaatttctaaacttagctaaagattttcttaggttaaataagtactttgggggcatttgaaaaagtagttacataacaggaattcatctagtcttttctgacacctgtgttccctttctccctcttttcgaccctccccaccttgatactcaaaaaatccaaagcacactctgcaattgcccaagggtttaagtgctcaatatgttttatataagttctcataaggcaagcagagatatttagataggcagagcttagaaccaacttgggcatatgccttttagttcttataaataccattcatagtgcaatggaggttttctctacatttcaaagtaaaatggatattgagccattcaacttcatagatcaggtaaaagttttgggagcttatattcattcttcagctattgcttcaaaagtttgaggagcttatatttcccagctgttgtttcaaaagcaatagctggaaaaaaaaaaaaaaagcaatagctggagaatataagctccccaaacttttgaagatatagacatagaccaagtaatttgtagtctctgcccacccccgccccaacattaattctatccgttgaaatcagtcccaattatttttaaaaaataaaggctaataaccagttctagtaccccaaaatgttttatggaacaagatagagaataaataaaatgaaattataaaatataaataaatattcacatttttacaggtggagagatggtgctggcagctttttaactgagattagttttcaggtgttaaatcaatgtctcaagtcagtaggagaaagtatctgctaccaactttttgtatgtttttaaatcaatgtgtattgttcctatcatttttgttagataaattctattgtaaacataaaattctctaaaacatttctgaaatctttgaccatttttactttaagtcattactttttaaaatggtgctgttctgattattaattcttataaacaggaattaccttttcaactggtctattctctgcattccttccccttgtaccccaaagcagattattctttaaatatcatctttgttgcaaggcagacattcttcctctaatttagaggaaggctattattacctgatgactgagacttcaaaggctctttggggccatttgtgggaataggacggggagcttcttcattcccacctgactaccctctcactccgcctccttccagcagatctctggtctggccttgtggctacttacagggcagagataggtgtcataaaaggaaacattcctgccaaataaaagttctttgttatgtgtggctctgtttattattccttctttatggtgctctatagagtacagcagggatgattgggagcagaggccaaggcactctagtagaattataccactgattagaaaaggcaagggtggacacagagataagagtagtactacagttttcaccgttaaatgatctctttttaatttttaatattcaagcacagatatctgcagaaaatatgattgttttagatattctatgacccagcacatgttctatctctacctcagcaccttccctccttggccatcccccattctcccttggctattacctgctctcttccaaggctaagccctgccgaaagctaccctcagctctttttacaactggagcatcctgtgcaaacctctgtcaaagaaatttccaatcagggtgtaattctttgtgaacttctcagcctcccacactagcctgtgagcaaatgggggtctgggaggccattcgtctctgtctttagttagtacggtacctgcataatagtaatgctcctaggtgattgctaaagaaatgttcattactcataataaagcaaagaaataaatagtctatgttggcttaaatggagacaatgtgtcatgtcagcctgttgttttagttttattttaacttttctaagaggcaaccaagtcttgtctctctctaactcttaaattacaggttctggaaggaataggggctaatgatttaatgttgactcaattttaagcatgataaatgctagcggttggctagatagtaatttgtaaactggatagccatttgaagtgaaataacaggaagctgactggagtcaatgaatattcttccaaaagaagtactacaggtttagtcattgttcacttacatttttattcaaggttatgttgtaacgatgactggatttttctgtcattctggtgtattcatttctcccacctcccaaatatctgactgttgccctttctcagggaatgtcaggttacatataacattcatcaaaattattttttcctgaaattgtttatttattgtctgcttcctccgttatttgtacgttccatatggttggtgcctatcaggtttactccagaaccggcagtgtctagtgcatggtagatactcaagacaaatttggacaatatactgtgagccatagtaatgtgtgtaactgagggaccactgaattttcatagagacttcaggttgtgtttgtacatttcttcacaccttgaatttgttagaagtcttattgatttcatatcactttaacattaaatgttatatagaatcacatttcacaattcatgtgctgtagtggaaaagtggaggccaaaaatactgtattgaaatacagacaaaataaaatggtcatgtttgataaagtaaaaagaactgaattcataatggactgcattttcaatgaatagctcatggttttataacttctgtgcatattcccaaggctatcttaaccaaccatgagttaaccagtttacagtgactaggcatatttagttttggccaaattattctgtcattgaattggtctggtgtagaagtagtttttggcctacttgttttcagttaaaccttatactatgggtgggtggaggagacatttataatgtgtgctgaggcagctgggtaatattgcattactctcctaggaatactggggagtggttatttttagctttcacctgagcaaacatgactcagtttgttgacctgaatctatccagccccctcttgaatacacaaactctattaatccctagaaccacgcaagtgactaagtaaggccttcattacaaatacctgttattgtggcttgttcaaaggttgaagatgatttaaacttcctccatttagctcttttctcttaatcccacacactttaaaaaaatttacagacagatcaaactttttttgattctagacacaatttgtgacccatgtagctaaaattttgactatagctaatgaaaacacattctatggtaggtgaccagctaccagctgtaagctttgcttttggtttacgtgataatgctgtctatataaagaaacacttgggaattcacttttagctggagtaggacattgcactgagctgtaaatatattattgggggaacattaactgtccatgtttgaatatcaggatgtctgtttactttctcaagcaatacttgtgttttctcttttgaacactattagaaaaacggaaaatgttgaattatcttcaggttttgaagttatggaaagcatttttgagactcaaggactaatttattcaagtgaaaaaaattgtgattctcacagtatagcttgagatgcacttgaggcttctccaagttcactgccatgatatttatgaaaatattagtatttctgggattttttttctttatagaagaaacactagactaatgagaggatgaaaataatgcaggcccctaaaaaggcaggcgttcactgcattcattaaaaatgcggactttgtgaccataaagtgttcagcttctctgttattaagtttggaatgtggttttggagcttagctgaggaactcagctagttatttttcgttttggcctgagaagtgagagacttgtttttcaagaaggtaaaaaataaagaaaaaaaggttaggttcattttggaagaatagaagttttaaaatgtagtaactattttctgcagcaaatagtcagtttgagtatgttagccgaaaatagaattcatgacttttgtctcactgtttatttctccaaccacattaaaaagggttcagttaaatgtgccatttggcttttctaatgtcagtgggctatttagctgagtcaggataaccaaagtttgattgactcatatttctaagaataagtcagatgtctgattttagatggattagatgtgaggtcttcgtgatacagttttgagttttaaagaaaaacgtctgtagcaggggttagtggcaacttgtattgcagtgttcagccttctacatgaaggatgttcagctagagcttagtagtgttgagttttctggtaagtattaataggcattgtcctaacttcttacaaacataacattttactaaaaatgtatcattaaaatagatgtttaatagaatagaaaaataatgtggattcgaacattagaagtagggcagaatattaataatacacatttttcccgttatataactttctttttgcttttcatgtttctccattgctatctgatctctattaaataagagagaatttctgcaaacataatataccaagtatcagatgcacagaaatacacatatttaaaccacacacataaaccataattgatgacactttcttttaactactaactttcaaaggtttatagatgtatctattttaaaatatactagtaggacccacataaagaaaacaatgaaagttttccaagaaatttaaaaacagattgtagacaatggagaaacaagtactgttcttggatgggaaaactaaacgctggggaaggatgctaattctgtccacattaatttattattatatatttattatttataaatttaatttaatcttcaatatcctagcaaaaagatgtaaatttgaaatggattggggaagagagttactctagcagatattgataaaaataataaatttataaaattcaaagcaatgttgtgctgacccgtgaattgacagtttaatgcatggaaaagaacagatgttcagaaacatgcttacatacataaagattaacagtgatatgataaatcaacaaaagggagggtctgttcaatcaactataatttaaatatttaagaaataaaactagaacctcactgcatctcttatagcaattttcagatggatcaactgtttaaatattagaaaaaatgaaattgcaaaaaataaatagaagtcaatatagatgactattgaattttgagatgaagaaggtcagtttctctaaacacaaaagcatggggggaaaaacataaaagagggattccatataagatctggaacttctctatttaaatgtgcataaacaaatttagatagcagatggaaagtttaggagaaatttccaacaaaacatattaggcaaaggattattcttatagatagcctttacaaactgatgaaggagaagttgattttggtgtattgtgtgattgactattttgcaactactaactgaaagattttaattataaagaaaatatgatataatggctaatattttatactttgtgtgtgcccaagcactactctgagtgctttcatatgttaacttgtttaaaatatgcagtgacttggaaagatcagtactattattattgccatctaagagatgataaaaccgatacagagataggcttagtaatttgcccaaaactttcctagtgtggatttgtggtgacacaactaaaaatgagagagccaggatttgacaccagacaggtcgcctccagagctggtgttatcacacaatactctgcttttctaagtgaataaaaagaaaagactacaaaactatgcatgatataactattttataaatatgtgttaatatttgcgtatattttaaagttacacaatttaattcatgtgtaaactttttatctaattacacagtcatagaaaagacagatggcattttgacattttccaacagtggttacttccctctagtgggattttgggtaaatgttgttttgaacttaaaatttctgtattttccaagttattaatattataatcatataaccattatataatcacaaaatagtgtttttaaagttacacatttcaaagttgctttgctgtcttgaagtgcatcgtttatattttagtacacttttgaagtatcagtcagtgtttgagttcccattctctgctaggtaccaagctaactggtgtcccctagttctttatcttaagcaaaagcaatgttgtacaattttagagccaaaaggaatcttagaaactcttccgtttctcagatgagggtcctgaagctattacagatttaactgacttacccaagattcactgacagtaggtttttaaccaggcttcgaatccaggtttgaagactaaggtcttctgactttagatactgttctctatgaagcaccagagctctccaagacctcaatcaggtgggaactgtagcacagttgattttttgtgacattgttttgaagtggggaagtataactagactggttacaaatgtattctttcacagcaattgaaaacataatgggaaggttctcagagatactgttatgacacctctggaggtcagtgaaagatcctcacccagatttggaagatccctaagtattgctgagccccacttgtagaaggcgatacaaaagctggagggaacacagcagtggaaagaatattaaccagaaacagtagtttcaatagatggcttttctaaaacagacaaactttctcttttcagctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagttaagtgtactctcctctcatccctttcttccctttgagcattgccctctttgggttctttttgagccaattctaataaaagtaaaaatggtaatagtaatagcaaacaattattgactacttcccaggcactttctgtgtactttacctgtattaacccatttaatcttcccaccaggttccttgaggtagtcttattatttcattttacagatggaacacttgggcaccagtgaggttactcatgatctgaagactagagagtggaaaagctgagatttctgactcagaaaactgccctaaccaccaagcttcaccacctctctagtgtcacaggggagttcaccccaatggagtgacttgagggttcctgaaaggtttttatttttttttaaatgtctttttccactgggctttgagtaaagctatggccttagaaaaagatgcctaccaaaatggaaatgccaacccatgagcacccatttccccaccaaaccaggtttttttttcgttttttttttttttttttttttttttttttttttttttttttttagcttatttgcagttaaaaactctgagggcatgagacatataaacttttcatggggagaaaatcactgggtgatttctgggaggccaatacatgtatggcatctggggacagtatcaggaatcttaggctgagaagtaagaaaactttttgttttttcctttttgactgagatgggatcaaggatgtgagggaaagggaaaaagatgtgttaaaggcagctctgtctagggcctgtccatagattgaaacattatttctttttcttttcttttcttttcttttttttttgaaacagagtttcgctcttgttgcccaggctggagtgcagtggctcaatctcggcttactgcaatctccgcctcccgcgttcaagtgattctcctgcctcagcctcccacgtagctgggattacaggcacccaccaccacgcccagcaaaattttttttttttttttttgtatttttagtggagatggggttttaccatgttggccaggctgctcttgaactcctgatctcaggtgatccacccaccttggcctcccaaagtgctgggattacaggtgtgagccactgtgcctggcctgaaaactatttctttcttcttctgtttttttttttttttttttaagagacagagtctcctatgttccccaggctgatctcgaatgctggcccaggctggagttcagtagcataatcatagctcactgcatcctcgaactcctgggttcaagctatcctcccacctcagcctcatgaatagctaggactacaggcacgctaattttgtaattttttattcttttttttttgtgtgtgtgacaggttctttctcttttgcctgggctggagtgcagtggtgtcatcacagctcactgcagcctcaacctcccaggctcaagcgatcttcccacctcagcctcttgagtagctggcatgagccactgcacctggccttaaattttaaaattttatgggggtctctcctgagctcaagcaatcttcccactttagcctccccaaatttttggtttacagctgtgagccaccatgcctgatctgaagtactatttctaaatatgattttcatgtatctgtaataatcttgatgtacaattatttttactctgtttaggagttggagcactatgtatacctgactgatagcttacctgaaataaatagattgtgctgagataattttctagatacagttttctttttctcattcattcattctcttgcccattattttaaactgtttttgagtgcctaccactgctaggcattctgctgttagctgaatatgctgtcctttaaggaacttacggctaagtggaaatgacaggcaaataactaatcattacagtgtggtatgctgggtgctgtgaccaagttatgcccaggaggatatggaaacttaaagaaaaggcttcacagcagagaaaaggaagacttccctggtagggtgtgtgggtgtgtgttggcggggagagttgtagagaggcaatcagacagctctttgaggtgaatgttaaagagagaaaagcctggtgaggaggtgaggatgagcaaaagaaagagcattctatatagaaggaaatggcttatatgaaggtccaaatttgcacaacagcctcaagcttttaagtggtggttcccatgtccctaaactcttgcttattgactcacttgttcactcactcactcattggttgtgcaacacatttattcatgagttcatttaaactttattaagtcccagccatacgaacactcagtactggggatataagatcacacgagacatgattcttgtaacgggttagggaagagggtgcctggaaaacagacacttaaacctacaaataagaaaaaacatgttatgtgctataataagaatacacaatgtaatgtgaggagccttgggaaggaaagagtttgctatgagattcaaaactgtatgtctaaaaatttttttttgaaacctgcaggtttgggttttagcatttctattcctaagaatgcattcaagcaaaggagaataaggacaacaagaagagccatgggaggatgagataggtagattacctgatttatgtatgtttgggtggaaaggtaaaggacgtggtattctgttatttgggctggttgtggttatttcaggtataatctctcctagacagatccctacttctagctccaagtataaagaaaaagatttaccctgtaataataaataattactgtctactgactgtattaataatgctgggtaacaaattaccctaaaagttaggagctttcaactataaacattttttttttttttttttgagtctgagtttcacccttgttgcccaggctggagtgcaatggtacgatcttggctcaccacaacctccacctcccgtgatcaagagattctcctgcctcagcctcccgagtagctgggattataggcatgtgccaccacgcctggctaatttttgtatttttagtagagacggggtttctccatgttggccaggatggtctagaactcccgacctcaggtgatccactcacttcggcctcccaaagtgctgggattacaggcgtgagccaccgtgcctggccacctataaacatttcttagctcctcatttctgtgggtcaagaatctagtttgggagtctctggctcaaactctctcaaggttgcaattaagctgttggcctggtctgcagtctcatcaggcatgagggctccaccggggaagggggatctgcttccaagctctctcacatggttgttggcaggcttccatccctcccacatgggtctctccataagactgcctcgcaacatggcagcgggcttcccccagggatagtgagccaagagagagcctgagcagtgctggagagggaaaccgctgaatcttgcaaacgacattccatcacttctgctgtattctgttggttagaagtgaactagtaagttcaacccacactcaagggaggtgattacagaagagcatgaatgccaggagatggggatcattaaggaccatcttagaggctgactacctgctggcatacttttcaatggagtcacagtttcatttgaaatgtgatccctgatttatatctagattagggggtaagatagaaagttttttaagagcatggacttaggagtcctacagcaatgggtttaaatccttgtgccactttttaaaagctctgcagtattggggaagttacagaaccgctcttagccagtttcctcccttgtaaaatatggataataatgcctaattaaccaactcactctaaggaataaattagtttatgtaaaacttttaggacatagtaagtacttattttttatttattttttttgagacggagtctcgctctgtcacccaggctggagtacggtggcatgatcttggttcacggcaatctctgcctcctgggttcaagagattctcctgcctcagcctcctgagtagctgggactaaatttttgtatttttagtagagacggggtttcgccatgttggccagactggtctcgaactcctgaccttaggtgatccacccacctcggcctcccaaagtgctgggattacaggtgtgagccactgcacccagcctggacatagtaagtactattaaaacagttaaaaattaaaagtagctattacaattatccaattatatttatccttattgctgaaattcagccatttttccaattcttacttctacaccttggttagtgagattagtctttataaaagaagcacgtggtagaggtaagtcttccttatccacaggggatatgttctaagaccacccagtgcctaaaatcacggtactgaaccctatatacatacatgatgtgtcttcctatacatatatacatacttagaataaagtttaaattataaattaggtgcagtaaaagataacaacaataattaataatgaaagaaaaaatatactgttcacaattttaaggacagaagattcattcttattgtagatcttagcaacctcagcataagatttttttttcttttaagttgagaactttcatcttcttaaaggaagcacttgacttatctctttagcacatctgaaatgccagcatccctactcttgcaccttggggcaatgagagaaaataaggatgacttgcacacaagtactgtaatacatagcagttgatctagtaacctagatggctgctaagtgactaacaggcaggagcagggagatgctggacagaggggtgattcttatcaggggacagcacaagatttcatgatgctactcagaacagtgcacaatttataacttaagaattatttctggaatttttcatctaatatttttacactgtgattgacctctgctaactgaaaccactgaaggtgaaacctctgataaggaggagactcttttagctttaatttatcatttccttgctcaaaacatcttcagtgactaacaaataagactcggtgttcagagtcctctcgcttcctggctcaaggcttctttctagcctccttcctcactgctggccagtaaccattctctgcatcctcaaaaggagtagtttcctgccctgtaaacacatccagagagtttctccctttgcgtcttcgctgatattgatcctgcctgcctcttcctctcttgtgattcctcttctcacaaatgaagggctcctcccagataaacctactcattcttcacaacatcccaaattttacattcccctggagccttcctaggtattttctatattatctcccgtcctcattccttcctggatataatctgtctttccttacgcattcttcattactggccttgtgatgtttactttatcagccttgtgttctgcacagtgaaattgtcttctctgagtccttactaaactatgaactcccagtgggcagattacgcagtatatttacatttatgaaatccacagctttgtgtttagggagctgtggatgaaaatactggattgtatcattcttctgccactaaaaggaacataaagcaactgattgaggtgcttcctcccctcccacacttcaaaataagagttctgttgtttaacatttcagtatatgtaagtctggtccccactgctcctatattttttacactgatgaaattgtggttaagaagttaagaattgactataggagtagtatgttgctgctttcgagcagcctgttacatgacaggcagttgtttagagcatagtctgacacttgggcaggtacttgccacaggttccgttttcaggttgtgaggaaagtgctggattatcttgtggttctaccttttacatcactgaaggtgactggcctataatttgatttcaaaacttggcatcagaatcattgagtaacataatgcagagcctcaggtaagtttaggtgaaattttaaaagtcaacgataaatttctaaaattataccaccaaaattgaaaaaaggataaatatgtttagtgaatgttatttataactgaactttttaaaagaaactttcccagtaatgtgaaataactcgaatacttttagctacttttttttttgccagtttctaatgatgttttgtattcattataaatggattgaatattttagaattctccaaactcatttgaaatgtattgaaagctccctgtttacatttttcagctttagcagtgtgaataaaatgattttaagctcaactcttgagcatttctcccaaaccagaaactaagaaataattctacatgttaaataatttcacagatgaattacttcccagcaaatactaatcctaaacaacaaaaatgcccatgttggcaaagctttaaaacatttctatatataaatattaatgtcttatttttttctcatgtacatcttcatgctttaaaatattttatcttcatctacaaaaatactgtactcaagctttctgacttaaaaataatccttaattttcttataacatgagaactagcacttaatagggggcatactaaaaagttaacaagatggaccactaattattcatttgataaatgtataaaataactttcttaatagagctatcaagaaaaccacaccaaaaaatacttttcatgagtagcagcaacacattttggctgctaattttttttttttttttttttttggagatggagtcttgctctgtcccccaggctggagtgcagtggcacgatcccgggttcatgccattctcctgcctcagcctcccctagcagctgggactacaggcgcctgccaccacgcccggctaatttttttgtatttttagtagagatgaggtttcaccgtgttagccaggatggtctcgatctcctgaccttgtgatccgcccgcctcggcctcccaaaatgcggggattacaggcgtgagctaccatgcctggccagctgctaactattatatgagaagttacatgttgtgtttgtgggaatattcatttccttaaatttatcctctctacctttgcttatggacactgagcaaggcattgattatacagattatatatattatgttatatatattcagcaatatacatatacacacatgttttagtataacaggcacatcaggtctagatttctctctgattttggtattaagaatgcatgagactctctactttttatattgtttatcattactttggattcctttctgacagcaatgaacaggacttcagagaagagtttgggagtgtggcaaacaagatcctattacacatgatggcttcctgcttatcagagattcacctgtaacaatattacttcatatgtaaggaaaagtcaagaccaatccatttttttttttttaacttttcgtggcagtctttgaaatgagtttcagatttcaaacaatgagaagagatttcatgtttgggctctgaaattaaagcttgggtttataatatatatctggttagtgttttcatctacttttgaagagtctttgagtagataaaataatctaagtactacatattttaaatgacttctagtcacttggggttaaatgtttattccctttaaatttttcaatttaaaagtgatacaggttttagctaggatttgagtttccaaaccctcagaaaactagaaaagcattgacttacactatagaagctggccattgttttaatttctgaatttaatcaagccagtgcctttgggagaaaaatgatggcattataaggtactttatagtaataaatttcctgatacacagcttctaaaattcttggaatctcctgagtgataggaatgcctctttgcatgctaatgagtcaactgatggctggggactcccagatagcttcagaatggtcacctgaaagaccaaggcatgattagaagggtggggaactaatttcagccccacccaccaacagccaggagggaagaggcctaaagattgagtcactcgcttatggccaataatgtaatcagtcatgcctaggtaatgaagcctccataaaaactcaaaaggactgggttctgggagcttccagacagctgaacttgcagaggttcccggagcatggcaccctagagaggacagggatgctctgtgccttatcatagccatcctcaactttttgggcaccagggaccggtttcatggaagacactttttccacagatgaggggatgggggatggtttgggtatgaaatggttccgcttcagatcatcaggcattagattctcataaggagcatgcagcctagatcccttgcatgaatacttcacaatagggttcccactcctatgagaatataatgccagctgatctgacaggaggcagaactcaggctataatacttgctcacccacctcttaccccctactatatggctcagttcctaacaggccactgactggtacctgtctgctgccagagggtcagggatccctgccataccacatgccttaccctatcaatcttttatctggttgttcatgtgtatcctttgtcatatcctttataacgtgcataagttaagtgtttccctgagttctgtgagcctctgtagcaaatcaatcaatcctaaggaggagggtcatgggaacgcgtatttataacaggccacaacctgttttttcgatgggcatctgaagtggggagcagtcttatgggactgagctttcaacctatgagacttgatgctatttccaggtaagtggtgtcaaaattgaatttttggacacccagctgatgtctgctgtggaagtgattgattgcttgcttggtgtgtggagaaacctcccccgactctgtgccccgctccttccatcacacctgggtcagaagtagtctgtgttatgttgattatgagtggagtgggaatcaaaaagtgttttttttgtttgcttgtttgtttgtttttcccctcactcggagttcaacttctaaatggtggtagttttaaaacaatagtctgtaagagctgaggaaaagaggccaattaagaaaatctagagactcatagatacttgggaacaggagtcattgacctttcagtgaataccaattacaaatatgaacagacctgtctgtggaaatctatgattgagtcagtgctggctttttgctaaatatttcagaggtacagaattaatgaatttgtcaggatgtaaacatgatgcttctgtctagttgttagggatatgggatttcaatttttactctaaaggagttaggaaatggagtatgaataggcagagaagagtgtcagaaaaaagtcagccttaacatttagagtctggatgtattatgaatcactgataaaaatgattatttacctgatggtattagacctcttggtaaggccaagttctgttatttgaaaatatattctagagtgtttttgttttgttaacatgccattctaaaatactttcccaaatataccattttttaaaaagtcactctatgcattaggaaaagaaaggtttgggttggctaaaacggtacccactggaaatgggttgtcactctaatgattacaactgcaagtcatacacttagtataccccagactctccaagggcttcttttgagaaacctgggtgcatagatcaaagttagagaatttgtttacatatctctctttccagctttcaaatctataagctgttgaaatagaagcactagagccattggcagaaagcctcaagatggatagctgtgtcttgagtagtaaatctaggagtttcaggggttgaaaaattcctgagactgaaaaaatattggtaaatgatgaagggtaggggaaagccagaataatgtcagtcctattcttacgtaatgaaagcattatgtttcgccttgatccttgtgctgtacactggaacccagtgttgtcttacttgtttcattattgcaaatggtcacatgaagcagaattctttctataagtggcaagtgatttttctttccccacactgaaagcatttctgtataacaaatttctagttaaagtaattagaatgatattattaccagtcagttttcaagttagatggctgagtgtcctgggagaatgttgactgacttttggcagagtaattgtgcttttccatttgtccatttattatggaatgttaagtggacatcaagggaagacaactggaataaagggaacaatctattgatcataaacaattctctgaatttcatccttctacaaattcacccctcacattatctacaatggtgatgggtgaatttgtagaaggatgaaagtcaaagaatccttctgggaactaatttttggccttcaacaagaattgtgatatttaattctgtgttttctgatgcttctgaggaaagctccataaagagagctgaatggggcagaggattttatacactataagaactatccctgctatgatggaacaggccattggtagtatgatattcacataattgtatttctgtgcttcagcagatagtccttattaataaaatatgttgaagcaactgctaagaagaaatgtataactctactctcccacccctactactactcccaccaaaaagaggtcttctttcatttacgaccatgtcttctttaatttatgactatgttatagcctgtgttaaaactatctaacattttggctgggcacagtggttcacacctgtaatcccagcacattgggaggctgaggtgggtggatcacctgaggtcaggagttcaagaccagcctgaccaatatggtgaaaccctgtctatacaaaaattagcccagcatggtggcgtgtgcctgtaatcccagctacttgggaggctgaggcaggagaatcacttgaacctgggaggtggaggttgcagcaagccgagatcgcaccactgcactccagcctgggcaacagagcaactctgtctcaaacaaaaaaaacctctaacattctaattagatagttttcattgttggctagtgtcactagaattttaaagttaccttttaagtttctttaccacaatttgagtcaatgcaagcagaaataaaaacttcaaattctccctttgttctcctcctccctcctctcccaccaaaaaaggcaagttgaaaagctcaaaatacatcaaaaagatctcagagacttaaatggagtagggtttgtagtgttaggtaaatggtacggaagttgtcagtattcaagatgggcttacatggccagtcttctttactcttattgaattgtgtgccccttcaaaccaaggctggaacctggaagttaccagtatgaatcagttttacttactgacttggtatagaaagcaactgaaatcatgggagaaaactatattttgtttaccccaggatagagaagattagggacatgatgtttgtttgctcatgaattatctctccctttgaggaaatcttcaggcacttcttgacagctcttcctttggaattgaccgttgtgagcatgttatattggcaggagcatgggaacctttggctttgagtgtgattattgttaagcacattacttggacaacatcattataaggctcctccataggcatcgctatagagctctatctggcttggtgggttttgttaagtatttgcaaatgaaaaattccaattcagaaacagtagggctcctccaaaacctttccaagattttaaaattagtatctatagtttggtatatctagttacatacactttcttctagtcatctattggttactggtcaatttaacattgttgagtagattgtgttagattagtctctagtcttaacaaaacactcttctatggtgttgaataatttgcagaaattgttactaaacatcagctgttttattttagcttggagtgctgaaaggaatactagagggctgctggtctaacaatcatcaaccaagcagtttagactggagtgtaagggctaagagaaccccttgatactctacataaaatttcagtggtatttgcttatatgcatttttgaagtaagagtgtttgtggttcttgtcaggtttgcaaatgggtggttgacccaagttaaagcactaatcctttaatttagcagctggagaaagcttgaactctgtggtactcgcccacggtggcacagctggctggagccagggcaggatctcctcgttgtacatcagtggtgtagataggtagatggtacctaacaacacgtgcaccaccccatacaggtgagtcagccttctaccaaacagcggactctaagatccttgcacagaagatgcactggtctttctaaaatgatatattttcaattttttaaaatctcccaatcagtatttcagggaatgaagtgcagtctagaatctagactaggtggtaggctggccctgtttatagtgccacagctgcagatcacccacgtgtctcatttcctgctctgagtttagaatataaatgaggatattctctttgcatccatacaagtatatcctgattactaaaataaaaacctggtgacatcattgactaatgtgaagagcagagaagccagaagcagcacatcccttaatggtgcccccaatgtatagaaggtatttttttgttttcacctcctcttctaactttgggtctttcagtatttaaatgccagctggtcataacatagctattatgaggttcttttatggggaattcacaactttatcttggttaacttaaaaaaatgaagttaagattattttctggattatatttttctaagcaaaaggaagttaaatgagagcaaggcagaattctgcttgcaaaagtgctagggactctacattggaaaaaaccattttccccaaccctacctattgtctacacactgatgctagaaacagttccagatcctcttttgctttagtgagtcattagtaatggtgttagtagagagatagtagtaattctttataggaagaagaggttctggctttgttctggtccaggttgtttgctaaaataattgcatagtgaatctatctctcttgtgttggggtgatcagacccaacaccaggttgtgggggtgacaaagtccagcagagtcaaaggattgagaaaaagacagtttgagagagaaagttgggacaccagggggccatcactagtgtacagaggctgtgaaggccctgagctctgggagcccatgctatttattggtaatccaacaaagaaacaggtggtgaaaatgtggaggtcaaaagagcaggcacatgatctacagctgtgatggtttagcatttatatggaacatgttctgctacttgagataatgggaataggagcctaggagcctatgagggctagaagtaaggaaccagcaagtctagacacattcccaaagacattatgcaagccctgcctcagtttccctcccaacactcagcttttcctcaacatcttgctttgcccattattcatattttgactagaaagaaaagcccaggcttgacctaacaagcaagattatgccttcattaaagttaaggcttgggagaagattacaaatatttcagtttagtatcttaagttgctgtcacatggaaaagagttctaatagctgaagttgtttgctgatgaaaaggttgcctctaccagtagtgagcagcctgttactggtagtggtcaagcagaagatggttggtgaggatcataaggatggccacagtgatagctggcatggggcagtgctttctttgcaaagtaccatcgcactagagatgctgttgcttgtctttgttgtcagtcatttgcttggcctgaacttggccttaacttccccctccctcagcatgttccaccacctctactgaatgggcaactggccatatgatcagtccccaagccataactgatcagactagcagtggtcccttggccaaaggggaagcaatcaaattctctcttataagaaattgtgtttcagtaattcgagatctacctttattagcacttaaactgaaaagccatgagagccacctgggcagtcatcattctacacgtgcacagagaagccgtgattgttgactggcagagtgggaagaccagatgcaaagaggaaatggagatgaagactattagtgtaattacaatagactataagagttgactttcctcctgacagctttctattcctggtttcagaccctccagcttctcagcattttctgcccttgattttcctaaagcactcctgtatccctccagctgatttctggttaagttagtgggggtgaagtcctgttacttgcaaacaaatgttcgctaattaagacaacgtttatttcatctgatcatcggaacaattatatctggcagagtgaggacactgaggatgacagagtttacatgatttgccagtctcccagctgggaagtcgagaggctatgagtgtacatgatgttaggactccagtgccttgatcccaccatgagtctattgacagggctatggagtgcttcctgttctgagtgggaaattatactagacgacccctaaggtcccatctactctaactctctgaagttgagagtccatgactcacttaagattctctgactttataaaaaatctcattggtatcctttggttttgtaaatagatgacttcagagaccctcaagtgaaaaccattctagaagatagtgctcagtcaagacagatgctcttgttagagggtgagcttagtgttgaaatgagtgaattttcttttcttttgttacatgcgaccttgtgttcatttctactccttaggtaggcagacagggttggtgtactggaagtgtatttttagtctgacattaaaaaatgtatcatagacaccaacacaggaagcagtttttaggtgagtcagtgtataaataacctcaaagagtttcatgatgggatggtagatctttcagtttagcagttcagtatctgaaaaccctttcccaatttcattcattcattcgataggcattattgggacttgtactacatgctagcattttgctcaggatttaagaaataaagataagtccttattcttcataatacaatttcagaaaccatcataaccctcttttgtttagttttctcttttcttttcttttttttttttttgaaatgtagtctcgatctgttgcttaggctggagtgcagtggcgtgatcttggctcaccgcaacctccccctcctgggttcaagtgattctcccgtctcagcctcctgagtagctgggattacaggcgtgtgccaccatgcccagctaattttgtatttttagtatagacggggtttcacaatgttagtcaggctggtctcaaactcctgaccttgtgatctgcccacctcggcttcccaaagtcccaaagtgctgggattacaggcgtaagccaccactcctggcctaagagtgaattatttaaaggcagggacactgtgttgttcattgttatatccttagcacaattccaggcacagtaaatattccatgtgtactcaaaataattaggagctcacagtctaattcatggagagagaattaaaaaattacaccagtgtgttcagtgcattaagtacccaaaggagtccataaacatagaaggggaaatgattaactcacggaaaaggaaatgttttgattgagtcaaaggtggagttttaaaggcgttggaatctgtgatcacttacaatgtgaaggcaaagaaacagtccaagggcagtcttatttttttctggaaagtgaaagagcttggagagacaactccagcactgggttaagtactttcaagccagagtgtttgggctgaatcataaattatgaatgtttggcctgctgcttataaattatgagacccttggcaaggaagtttttgaaacttccttgtacttcattttcctcacttataaaatagaatagtagtactacctttatagggttgttgtaaggattaaactagaatagtgtatgtgaggcttttacatagtaagtgctggatacatatagtaaatgctcaatataagtgaatagttggctgggcgcagtggctcacacctgtaatcccagcactttgggaggcccaggagggcagatctcttgatcccaggagttcgagaccagcctgagcaacatggtgaaaccctgtctctacaaaaaatacaaaaattatcaggatgtggtggtgtgcccctgtagtcccagctgcttgggaggctgaggtaggaggactgcttgggcccagaaggttgcgccactgccctcctgcctggttgagattctgtctctaaataaataaataagagtgagtagttattattctcggacttgaatagaaaggaggaattgtgttccagagagagcatagaagcccagaaacataggtggcagggctgagtgttcagaaaaaggaccccgtccatggatgttagccacaggcctttcattacttccggacagtggttattaacttcaggtcaaggactttaaccttgggagacaaatatgcatagaccccatttgcacatttagtattcatatttcaatggaagccctgaagctcacccatggaattcagaggtttatgaatcccgatgagggtatgccccatgagtaccaaaatgcatgctgatcagcactgaagcaattggataaagtcctaaaatagaagatgtggaaaattcttagcatccttaggagaatgtgcccacaggcatgatttaattatatttgactataaacatagcagcatgtaaattaaaatattttgaaatggaagaatattaagatgggagcagaggtgtatgggagacaacctcttggagtggaagagtggtaagaaaagatcaggacaagagttagcaatgggaacattcttttggatgaaggtaactcagcaaaggcattaggtatagagaaggaaacgttgattatgcatctcctctgcaggctcaatgctagatgttcaaggttaaatctctactgtcctctgtgaggctgttactggagaaaaagttttaaatttaaacaagtatgaaattatggaagttaagtgacttcttcaaagtgatttctaggtgagaaagtgaggactaagaccatatttttctatcatgaaatgctctgaaataacatatgtgcaaaggacggtaagcccatttgttgggctgtagaaaagtgtccatattagagaaaaaagatgagctgctgaaagacagagggcctggtaggtgagttgccttgatgaccagctaagaaatttggagtttgtttcttaagaaaaggaattgaacatcacatctctagtgctgaaataaaatgtggaattcaggatttgagactcgtagcttgtcctttgaattatacagcagctgaaaatcgtgtttctttttttcccatctggacttctcacttggtggttttcccaacgggagggcatctgtgaaccttttaatgggagaagtcatcaagctgggttagggctgtgctcccagggctggcttcggaggcaggtaaaatctgactcccttttgcttttcagctacagacacagccattgctgccaccaccagctgggtgactcggaatctaggggttgccagtaattgtgggtttaagtcacagaggaaaaagataagaggagagccaggctggtttttccacaattaaatgttgcctctcaggcttctctgttggcaggaatccaagaggtcaggaaccaccagccatattatttttgtccctggctgcctgctctcatttgtatcccctcctcattcatgggaacgaagaaaaggtgggttggaaataaaaaagcttgttctagcctactttttcctttacgaaacttgtcagaaacaaagctttcctgtgaaacagacgggatcccttctagtagctggcttttcctgcaagcgttttctgtctcttcttttctttctgctggcagcacaaatgtattttccgggttaggggtgttaccattgttgaaatctacttttctccttgtatagtcatgctggtatgcggtgttatttctcaagcactgccctgtagtctggttctctggtatttttgtatttgttaattgtttaactcttccattagtcaaactcaacttgttatcctttgtcactcaaactccattataagtgccctgaggacaggcatggttttatagctctttgttttggcctcagtgccttaagtatagaaggcagtcaacagctggaggtgttttagatttctacattcatgaaatattagaactagaaaggatcttagtaagcctatgatccaactgtagtatttcatgaaataatacattatgtaaagtgacttactcaaattgtttggctaaatagtggcctttttagagcaagaagcgggtgtcctaactttcctaccccatgactgagagacataaggggaaagtacttgagctgctgagtcaggcaaacctgggttctcattttgcctccctctcacattggtagcatggccatgggcctcagtttcctcactttgaaattgcctgtgatggtttccatctggctggcatctgcatgggtgaaaatgtctacacatagtaggcagtaaaaaatgtgagctcttaggaatcattgttttatttcttttaaaaatacttcatttataagaaaacatatttctgagatcttttcagcatcagaaaatggtgcccgattgctcttggtgagaacaactttggagggagaacaggccagtaggcctctttgatggagattcagcctagaatgagctagaaatagaaattagtcccacctacaggacataaagctcatggatgtaatgccttttccttttcccagttgtccctccatataagggagtttgggttgattaactcagcagttagtaacacagcccttatcttactcacactcagaagaggatgtggagtagtggaggaggtcaccaggccaacaggcccaacttgcttcctacatgataggaacatcaatggtcataaaccatttgatgagataggagaagccaagggctgagggaggagatggcattcggggcaggtgtgtggagtgatgcatgtagagaccaacgcaacagtgctagcgtgacccgaaaggaaagagcaatgattttaagggaaaggctgagggtgatggctggagaagaagagcagaaagggagtccagcttaacactcttgtgttgtgggtggcttttattgagggaggagcagcagagttcttccgcagctccaccaagggtcatggttttccattatgcttcccattctctcacacacacatatgcttcatccaccttctttatagtattatgaatctgtccattatctggaaccccgggtggcagtagaatattgtcccactgtctcctggagcccaactcgaggaatgtcctggctgattgatcaagggaaggaccttatctttaaatagaaccccaaagctgagtgcaataattccccacataagccgtatgaaacaaatacttcgtgtgaataacactggcctgactccagcaataacacagctgttgaaacagcttagtcaccagggcgatggaggtatgcagtgagggaatgttggggtgccgtgatctgacatttagctggctggcagcagcgctgagagccaacatggagctgcgggagagctgcagagagaatctgctacccgtccacaggcattattcccttgtttcttttgaagcccaaccgtaatcccttccctgggcaaggcagactgaggaggaaaacagaaaacattttaggactgaagggagggaaagaaatggtttgcttcttttagacacctggtttctgccccttaatgatgcatgtttatttcctggataacttttttttaaatgccccaggctaggcagagtataatttagatatggcaaagggggaaaaaactcatttatttatcttgcctagaaaaacgtcatgactcttcttagcttacttgtgtccaggggatgtatgaagaagtcagcagggaaagtcctggccctgctgcctaatattgcctgaatctctgtagcggttcatctgccagagctcttgtctgaaggactctgggtagatctgggcaaaatacttagctggtttcgtcaggattttgggaggactaataaactgccatggagcgaccccatccctctgccagctctttgaagaactgacctgtgtgttttttctttatcctggactccctctgcactgtttgttttggaagttgttaagttaaattagccatccctttcctttcctggttactgtatgacaatgcagctgtcagtctgtgaactctgccatcatctatttttagacacagtgtgaatgaagctgtcttctctaattgcattcagagagagagagagagagagaggggcacgcaggtagattttcacaacgatcaaatcagctattctaaatgctctgtgtactgacagtgtcctggagagaaagcaaagaaacccactgtgtgttttcctcacttgctttcaggtttgttttctttccacattgatgttgattatggtcaaataggaaagtgctgttgccacatttgctttccagtgttttaacacttgctaacttagatggttctgagttctctagctttgttagcgaaagattggttcatcattgggttcagattctttggtaaacaaattccttagaaaatatcctcctggcagtattttccacaaggttaaatcgtcttaagcacactgagaactgtgttagcagtgggcctcagtttccttaggatgtctctttgtctacctggccccccatcccagtccgtcttccgcacagctgccagaatctcctcctttgctttaacatcctctaagcaaaatgctgcagcactcagggcaagcttcttccctttgtcattagacccttcctgttctctagccttccctgttccctccagtccctctcacattccctgccatattgaattagttgctttccctgctattttgtgcttatgtgactttttatacatggggcttcctctgcctgtaatgccttttcctatctcgctgcctagtgaactcctattctgcaattcattggtaaatatcacctcttctcagtagggtgagccagaagattgtgtcttctgtgctacaattcttgaccttctactcagaactcttgatctttttgtgctgactgtatacttcatatatacttctaatgcagtacaaactacatggaattatacttatttatatacctgccttcaccactttactgtaaacaatttgagggcaatgactttgccttatatgcctttttatccctactcttttttttatagaagaagtttaattgtttcactctttatagacatatataaacatacatttttatgtttatatacatgtatatagttccaaatcctatttctatataagatttgtatttatttatatacagcatttggaacttctctgagtattttttttttttaattatactttaagttctgggatacatgtgcagaatgtgcaggtttgttacataggtatacatgtgccatggtggtttgctgtacccatcaacccgtcatctacattaggtatttctcctaatactatccctcccccatccccccacccctcaacaggcccaggtgtgatgttcccctccctgtgtccatgtgttctcattgttcaactcccacttatgagtgagaacatgtggtgtttggttttctgttcctgtgttagtttgctgagaatgatggtttccagcttcatccatgtccctacaaaggacatgaactcatcctttgttatggctgcatagtattccatggtgtatatgtggcacattttctttatccagtctatcattgctgggcatttgagttggttccaagtctttgctattgtgaatagtgccacaataaacatacgtgtgcatgtgtctttatagtagaatgatttataatcctttgggtatatacccagtaatgggattactagttcaaatggtatttctggttctagatccttgaggaatcgccacactgtcttccacaatggttgaactaatttacactcttaccaacagtgtaaaagtgttcctatttctccacatcctctccagcatctgttgtctcctgacttttcaatgatcgccattctaactggcatgagatggtatctcattgtggttttgatttgcatttctctgatgaccagtgatgatgagctttttttcacgtttgttggctgcattagaatcttcttttgcgaagtggctgttcatatccttcacccactttttgatggggttttttgtttttttttcttgtaaatttaaattccttgtagattctggatattagccctttgccagatggatagactgcaaaaattttctcccattctgtagttgcctatttactctgatgatagtttcttttgctgtgcagaagctgtttagtttaattagatcccatttgtcaattttggcttttgttgccattgcttttggtgttttagtcatgaagtctttgcccatgcctatgtcctgaatggtattgcctaggttgtcttctagggtttttatggttttaggctttacatccaatcttgtgcgaggacaccagtaggtgctcaaaaatatttggtggaaacaaaaatagagttggatggtccatctagcacagggatttcaggggtgtgtgtgcaggggtttggggggagtagaagtaaaaaggcaggtgatggagaaagaaagtatgaatgtcaccaaaatatagagcaaaccacttgtttgatggtagagtgacaggaaatttaggtttgtaagagttatttggagaaagaaggatgataatcattaatttggtaaatattcaatgaatatctattgtgcaaagacatgagtgatataactgtgaacaagactgagtcagtccctggcttttaggaacccagcctaaataggagatgggtagggagagagatggggataagtagtcaggagaagcaacatggagaataagtgtcataagtgtcatattgctgggtgaacaaggtactgtgggagcaaggggggggtgccatattgagtttgggtgagtaaaagaaggcaagagtaaatctggggggaattccagaagatgagtaggagtctggcacgagcggggatgccaagcactgtctgcagcccagataaagaagccttttgtaatttaccctctcaaaggaggcatctcttcataaaatttggtgtgattatggggaccctgagtacagcaggtgtagataaccttgagtactagccttgaaatagcagccagcggccgagcgcggtggctcacacctgtaatcccaacactttgggagtccgaggcgggtggatcacctgaggttgggagttcaagaccagcctgaccaacatggagaaaccccgtctctactaaaaatacaaaaaaattagccaggcatggtggcccatgcatgtaatcccagttactcaggaggctgaggcaggagaatcgcttgaacccaggaggcgaaggttgcagtgagcggagatcgtgccattgcactccagcctgggcaagaagagcgaaactccatctcaaaaaaaaaaaaaaaaaaaaaagaaatagtagccagcattgactgagtgcttactatatgccaggcctgtgctgagtgcttggcacccattatctcatttactcctcacagtgataggagaagggcattaccattaccattatcctcatcttacagatagagacatttagtgactcccaacattgcataggcaccaagtagctaaggtgggctgtggtcccagcctgtctgtctccaaagctgagctcttactcatcttccaaggctggagaggagaggggctgtatttgaagtggccaacctaggtagaaggggtagtgaacgttcatagaactagaacctaggctgctacataacaccttagccaattatgccatttaaggagtcttaatatcacactgaagacaatataaaggcattgaaagtgttttagaaatcatttctgtagcaggaagtgtgaaaattagacaggaacagggcaggtgttttagtcatggaggctggagataatggtggcctgaacaagcggcatatcagtgaggagaggaggctaaatctgaaagacacctagtagagttgaccaaatttggtggtttgcatttctaaaccatgaaagaggagagactggtgaaaagtgagcatgcaaattcaaatatcaagagggaaatctggactggagagggtgacttgcatcccaggagcagatgaaatccttcagggtgaacgtgttgagttagatgaggaaagagctactctccaacctggtgaacaatagatatggtttttttctatattcggtggtacttcagattcatttatttaaaaaaattgatgtctccacttactttttcagtggtatagcatttaagtactagtagccttggctacaataggggtaagtggatgttttctaactgcatgtcactttgaagagaacctaatgtgagcaccgttctcccttgtccttgtcatgttccatagacagatatgtgacttcaaccagatgataatgcatcagaatacagcaaggaaccagttttgcaatgcttagaaatatgttttcttacatgtggaagataattctctgcaattcaaatgcttgatttgatgaggaaagacgagaagcaatgtgaactaaactgttaggctggtttgcaaaataattgtactcattcatttttataaccactcacacccaggcctgtagggcatcttaagaaaaccgccagggccaaatttgtaattagctgagtccatttttgccagacctaaccatgtataagacagggttggttttgttatttccttaattgaaagcgtcaagaaaaattcaagccaggtcagagagttttttattggggaaggaatgctggcataaataactccagattatatgtctgccagaggctgggaggagatttgtctctgtggcctctttctgaggttacccaaacaaactctggtgactggcagctcccctatgtaatgtgggaatgcacacgagcattgaaacctctttaatttttttcccagggcaaaggcccaggaaagtcaaagtgtctctaggaacctaaaagcttttgacaaccataaaatcattcctgatttcctctaatatatcttgtcctctcctttttccccttttattccagttaataggtcaacaatataacccagccaccctgggactagatggagaaggaactggtattggttaacagacttagggagtagttcccactgtttccatactgcaaaggtggaaactgagacttattcaaggttgttcaggtgggaagtcataaaaggagaattcaaaatcacatccatttggtgcccaatttatacactttgtactatcctggctgggaaatacctgtttcaaatatagaaggtgtagagcttaggtgacaagcattctgatgtcttcctcaattaaggctctagtggccttttcattgcttttccttctccccacattcccaccccagggaccattcttacattaagcagctgccctagatttcttggggacactagacctctttcctagcgatttctagcacccccctcccaccatttctggcttatagaaggtacttgccctcctctctgactttccacttgcctgcagaaaaactgattggctttgcttttctcaagcagggcagggcagtataactggtatagagacagacttcctaaggatacaattagttgatgcttcccaacatggaaaggcatggatctttctgtctgtaaccacactttgcagtctaggtctgctcctatggaaccctggagcataggggaaactgcccccataacaggatggaaatagtaagtgtaacgaacgacagtgcctttccacacttcccttcctcctctgaatgaattctccacccaactaaaatatgtctccaaagctatttgagaaatgtgaagcttggctagcccataggacctatgggcttctataccaaagctgctggtatagtataggtatggaaaaccatggatttcaaatctataaatgccctatgctgataccttacaactgtacccccatgaaactgatataaccagtgtccttgttttatagggaaagttctaatatagtgccaaatgtagcttagccttcctgccattctcccagggagttcaaattggattcctcgccttcattatctctggagggtggaggggaagtattgcccacacagtatcccaggagtcatgaaaccagtgttttattaaatgcaacatcatcattaatgctgaactttatttccaagtccactggaggcagaagagaaaacaattcaggtaaccagcttcgcagttttactgtattcctctgtccagtgctttcccgtttctgggttttgtgatctaggtttggattagggattcatagtgggaagctccatgttcctgaaacctggtaattattttgaattaaggataagagtttcacttccctaataaaatgtcaacaacaataccttacccttcatgctttctgctctgtcttgagcatttttcatgcagtaactagtgtaataatcatgaaattctaggcgttaagtcttatcctaacaggtaaggaaccaggtctgctaagattgacctgtgctacctcatgtgtgctatctgtctgggggtgaggagtgatatcacagtctagtaaaggtcacttgaacaggccattctccctgtgatttctatttttttatgtacatcataaaagatggcaggatgctatgagactattggctatgaagctctagggtcctgagtctggtatttctagggtagggctttctgagttatggcgtcttcacctcataaacaggaataacacctctgcttcagattgcacgggaagtaaggagatggtaacgtgaagagacggcagaacatgctataattttaacagccaacaatagatggctttagaaagcttagattagataattccagacattcttatgagccatacttgcagcctcccaggaacattgcctgtttctctcctgtagaaagctggaaaggtatttagtttgtgttgagtggctctttgaccaagtatgcttgattcagctgttagcttcttttgaattctactgtgtttgtttgttttcaccagcaaaggtagtagagtgcagtggggcccttacgtgatccagacttgagctctgctgtttactagccatatgttcttgggcaatttatataacgtcttcctcccaggatggatgtgaggcctgaagaaggctggtgcatgttagcctctgatgaaggagagctgttgctattattaaagacttagcatattcatattgtgtgactgctttgaggggcttcttctatcacaagttagccagttttctttaagcaataccaaaaaagtgattttattttaaggcaatttcaatgactttatacaagttccttaagatctgagggcatcactttactcattaattaaaataaaatattctgtccacttcatggaattgttgggaacattaaatgaggtaatttaaagcacagaaaccacaggagcttaacatggagtaattgtacattaaaatactgtgcacaattttcattttaaaccgcatattttaaaatagtttttcctttgaggatcctcaacagattagaataacttttgaagctgggaccaggcaaggaagcaatcctatctagccttgtctctgtgaggcacctgctctgaaccaggcccactacaaacatttgtctggcttggggaaacagtatgaatgaaggcatgcctatcatgtgtctaaatatttagaagtgataaatcaggccagcaaactgttaagccaagtacgttgcatcctctgatgatgagttacttgcataatgaacaggatggccaggttcgaattgaggactcatggacgacttggaattctgtgccaaaatgtgactggtcaggaagtgtgggcccctacaccccttttctccccaccgctggctccatcccataaagagaggggccttgcgtgcttctacatggacaccctaacctccgagctcaagctctgttcatatcttccaacaaatagcagccttttcactcccacccccaccgaacatccaagagtatacaggtggttgtctagttcttcttgggaagccagacctggaaagaggccacacagaccttggaagtaagataagagttcagagctgtctaggcagaatgttctggagtctgacatctcggagcgtggtctagaagtgagggggtctgtaggctctgggtatatatatccccttcacttgggagtcttcttgtcctataaagaagggaacagttgacagagtgggaccctttaaaagtgtgggaccctttaaaagtgtggggcccaaacttcaaaggcccctcttgcctgtgtctaaggctagtgttgctctgaaccctatggctccaaggagaacaacctgtgagtaatttgtaacctgtgtgtgagctgatgacattttttacagcttttcatatttatactcttgtgtttctccaagcacccttttcaacacagtttaaagtcccaattcctactcccagcgttataagtaggatgtactttattgcctaagatttgactccatgggagctctgactgattctttctgttgaccactgaggctactaagtggggagaagttgtagccagcttggtccctgaccaaggggagataccaactctgaacattgtttctgccaagctgggagtggcacagtttcttctacagactcttgctcttctccacctccagccctgggtctacatattcccctggtgtcctcaagtccagagtctctccttggatcttgcacagatgggaagatgtgggagaactgaggtccagcagttttgtgtgcagactttgacccagtcaccccattgtcagtgccatgctttgttctgccttctgcaacccctggtactttcaaattctgagtggcttcaggttcctgcagatatgttggctcacttttctagaatatcccctctataggagtgtaggctgtggctgccaggaaaccctacttcatgtattttttatgttttaaaaaaattttgaggccaggcacagtggttcacgcctgtgatcccaacactttgggaagctgaggcaggcggatcacctgaggtcaggagttcaagaccagcctgaccaccatggataaaccctgactctgctaaaaatacaaaattagccaggcatggtggtgcacgcctgtaatcccagctactcaggaggctgaggcaggagaattgcttgaacccgggaggcagaggttgcagtgagccgagatcatgccattgcactccagcctgggtaacaagagcaaaactctgtcttaaaaaaaaaaaaatgaaatctcttgtctgctcatgtgtctacagttagttttttccccttgtgatttaatatcttttgcttttctttttactgtctttgtctttattttgtggaatttcaggaggaaaacacagtggctaattcactatgtttaactgaggataaaaataggaataatagaatagtgggtactgatgttcatcgagggtttcctctatatcagaatggcctcaaattccttcttccatggatcatctcttccttttccgagatttcttctgagaaccagggatctgccatgctgccatgtcagctttaagccaccgtagaaaagccctgcttttcagagggcagttattcctatctgtttcccttgtgatttgtatgtgttcaggtttagtaaacatttattaagcacctactgcatatgaggcagcatgcagtgctttcactaacttgacttttaatccttgtcgcagccctggaggaggtgggtatggagcaaactcaggtgcctggatactgagacttcttcaaggctgaatagccagagcctaaaattgtgcccattttcataaccctagtggtggcaggatctccagtcattttggaaatgtgatttgtgctttttttttttttttcctcattaagacttctctggaggggtagggtggggagagcggggtagcggagggagggagggggagtggtggggagctggagagattaagtttttgtgttgtgtgtccctgtgtgcgagcgtcattttaaggtggctcgggagcggcccggaggagcgagggaccgaaaagggagccatgctgcgctgaggggaggctgcacagctgcagccaccgccaccgccaccgccgcagggtggggtgggaggggcgggagccaccgccaccgcggcctccagagtgggcgccttttgccgtggacgctgaccgtccgggacgagggtttcatcaccttaaatggttttgaaccaatgaagctgtattcccttaaaaagacggacagcccatcgtgtgaactatagatttatagtgtacagatttatagtgtgtacagatttatagtgggttcatagtggcgtcatgcacggagactcctgcgagttcccctaagttcttagaggactgctttgccttttgatctgagagttgcaaagttccataaagtatggcccttgtggataagcacaaagtcaagagacagcaattggacagaatttgtgaaggtatccgcccccagatcatgaacggccccctgcactcctgccccctggtggcgctgctggacggccgcgactgcactgtggagatgcccatcctgaaagacctggccactgtggccttctgtgacgcgcagtccacgcaggaaatccacgagaaggttctaacgaagccatgggtaccatgatgtaccacaccatcatcctcaccagggaggacctagaaaagtttaaggccccgagagtgatcgtgcagataggcagtggctacgataacgtggacatcaaggctgccagcgagctcggaattgctgtgtgcaatatcccgtctgcagccgtggaagagacaccggactctaccatctgccacatcctcaatctgtaccagaggaacacatggctgtaccaagcactgcggtaaggcacacgggttcagagcatggagcagaaccgcgagttggcctcgggatcggccagcatccgtggggaaatgctgggcctcatcggctttgatcgcagggggtaggcggttgcagttcgagccaaggcctttggattcagcgtcatattttatgacccctacttgcaggatgggatcgagcgatccctgggcgtgcagagggtctacactctgtaggatttgctgtatcagagcgactgcgtctccttgcactgcaatctcaacgaacataaccaccacctcatcaatgactttaccataaagcagatgaggcagggagcattccttgtgaacgcaccccgtggtggcctggtggacgagaaagccttagcacaagctctcaaggagggcaggatacgaggggcagccctctatgtgcgtgagtcggagccctttagctttgctcagggtccgttgaaagatgcaccgaatcttatctgcactcctcacactgcctggtacagcaagcaggcgtcactggagatgagggaggcagctgccactgagatccgccgagccatcacaggtcacatcccagaaagcttaagaaactgtgtgaacaaggaattctctgtcacatcagcgccttggtcagtaatagaccagcaagcaattcatcctgagctcaatggtgccacatacagatatccgccaggcatcgtgggcgtggctccaggaggacttcctgcagccgtggaagggatcatccctggaggcatcccagtgactcacaacctcccaacagtggcacatccttcccaggcgccctctcccaaccagcccacaaaacacggggacaatcgagagcactccaacgagcaatagcagagaatgccggaaggtaatcattcagatacatttgggaccaagagatagtgaaaaatgatgaactaagagaaaaagaatatgatggtctttgtaactgattctggacttatgcatcattgatgctgcagtgttaaaactacaagagctagaaaactgaagatgtcgtctgcttacggaagcgctgaaagactaggatgtgatttattaacgaccaacttctgttattgtgtgttaagtttttcatctgtgcatcaaatcacaaagaataaatagagctttttcctttatcagtcccttgggcacagcaggtcctgaacaccctgctctacaatgttgcatcaagagttcaaacaacaaaataaaaaatattaagaggatatccccatcctgtgacttgagtcccttaagtctacaggggctggtgacctccttttgctaataggaaaattacattactacaaaatggggagaaaactgtttgcctgtggtagacacttgctcgcataggattgaagacagtacaggctcctgtacagagaagcatctctcacatctgaactgcatactgagtgggcaagttggttgtaagttcagtaaaaaccctctgatgcaaaaaaaaagtattaactttcacaagctgtttgtactcaaatacattttctcagtttcagatcctctgctgttttattgagtggaaagttgagctaaaacggttcaagaagaataatgttgcatttccttatgtctcaggaaacactttttatggtaacttgtcagattgtctatgaacaaacccacttttttagacattgataaagtcttcttttcttcacgtgatattttatacaagagcacttcagatgtattagatgtgactgattttaacaaatcctattagatttgtatcaactagttacatgttctattcacagtcttttgtgaatcattgcctttttgtttgaaaagatggcctcttttgagcctttgtttggatacattcctgtttttgtgacaaaagaaaaactttaaaattgtcccaagcagaaaaataatggctatcagaagtatgttttgtttcagtgtgagttactgttactgtatttgtttattgtaaacgtagacatttagcattcactgcagttttcagtaaaaagtaattaaaatttgttgagttctgaaattcaagtacatctcactaatgtaaaagttctctacttgagatgtttaaggcaagtgcgttgtcaattagccaatttccaactcttgttactacagggttctatctgcctattccataaccagactcaagaatgctgacaattacctcatgtgatacaaagtttaattgaaaactcaaaacctcacacaagtccatcattatcaagtcatgccgtccttaagttgtaatggtgggttagagctaagtcaattaaaaaaaaacaaagttgctcaacttttagaattctgattttaatttaccccaaagcaaaatgacctggacctggttcaagggagggaagtgaaccttgaaactgttttgccaataacctaacaaaatgatatttacaaagaagtgttccaaaatagtcccatgagttaagaacttgaagttgatttaatggactttctttttaaatagaattaaacctttatactcaaaaaaaaaaaaaaaaaaaaaagacttctctgctcttgaacttgctcatcatagtataaaacagacaaaattaataggtgcaatgttttattaatctcatctccttaatgagttctgtggtgagtttaactcattcgtggtccagtccacacatatggaagtatgtgtgaacattcatttgtgcaattatgtattattcctatctgtgtataagtctttaattttggaaaaacactttgccttttacattaacttcatccacaatatgaagggattttgacttttggaaaagtagcaaatcctatatttgagaactttcgggaataagtttgagaaggatgttttcagacagagtgtgaccagagaagagccccagagggacgtgtctgagaggtggttgaaaaacttggtcatgtttatcagagaggaaagagaatgcaggcagatgtggtatggttttcaagaacataaggcactttttatggaagaaggaaggacatcaccttccacgtggcttctacaggcagacctaggacccatggtacaagttatgggaggatgaggtctgaccatttgtgctccctcagagagagtgaggcccctgtctctggaagagtttaaatggaggctcttgactctggcagagtggacatgagaggggacccagcatttggcttagactttcatcctatgacttctaagtcttcaggtttggagtttgatagaaattaatatttcccttttgtctcgttggtttccaagtcaaagcctataagaattttttgagctgtttctaaaatatctttccaaaagtcatttctgaaacgtgcatcctttctcttgcaggagaaaatgcagaagtctccatggacgtttccctggcttaccgtgatgacgcgtttgctgagtggactgaaatggcccatgaaagagtaccacggaaactcaaatgcaccttcacatctcccaaggtatgaccccttgctgtctaagctgacagtttttatttggttctcaggtatgtggaaagatttgcttacttttcataggtgtgtcccttcttcgcatgaggacagctttggtaatacctgctctgcggagcattttatttcctcttctctcctgccacgggcctttcctaactttgcttttgcctattactgttaagatttcctgcaaaatagtaaaaacatgaggttgaagcctctgagtaccttgccccagctttagccatttttttcctaaagaggagaaagattaggtggttttatcactgacggtgtgacctcaggtaagcttacataatctgtctgagcttcagtttttcttctgcaagatgagataagagtacctaccttgggagtctgtttaagggctagatcaagcttgtccaactctgcctgcgggccgcatgcagcccaggacggctttgaatgtggcccaatgtaaattcattactttcttaaaacattataatttctttttgtgattttttttttttttagctcatcagctattattagtgtattttatgtgtggctcaagacaattctcctccttccggtttggcccagagaagccaaaagattggacacccctggactagatgatacaatgacgtaggcaggatgaccttctaatttaacatcttgtctgggacatatttgagagtcaaagcggatattaaccagatgggccactaggagaaaacatataaactaaggccctccatgggtaaacctaagtacccattgcagtgttttttgaaacactaggggagtctccctcccgcaggtttcctagaacaaagctacagaaaatgtgttctgagaaccaacagtggcagcatcacctgagaggttttaggaaaggcagattcccagggcacacccagaacctattaagtcaatgtctcagggtgtaggagcaaggaatctgtgttttaacaggccttcagtttattaaactctatgaagtttgagagccactgccctagaccctctgctgagtgctaaatatagggctgtcctccagagaaagccatttgtaggtagaaatgaatgatagacaaactagaggaagcaggagagaggaacagctaacattttcagatctttgcatgcaaccaagaaaattaaaaacctttctagctatctctgcaagttgactgcatctttgaaatactggttgaacatctaagctagatggctttcggatacagaattttatccatagaaaagggaaaagtcatttctcatttatacacatggagggcactgagtagcgagggggaagggtgtttgcctgcaactgcttcttaatgcttaattatctttaggatgtgttgatcccttgcaagaaagatattaaatcttgaaaagtgcgaaggaaatgaatcatcaagtctctgctttttgattgcagtgaaatttagtcttgagtctcaagattaaatgagaaattgctttaaagcttttgagtccctggtggattgtgaagttaaaaaaaaaaaagtcaagttgccacctgctgtaatttgtcctaatgagctagtctcatgctggagttgggggagaactgggggtggggcaaaggaaggagagagaggaatcttcttaaatgccctaaatactggcagaggcaggactttagtgcatgaagaaaagtctctaacaggatacaacgaacttgtctctgagacaggaaggttgagccagtgtcccagatgccaatgtgtctcttttaatttgaacttaggtaaatttgtgtcaagggtgtccatgttactcactcagtagtgacagggaagtgtggggcacccagagacccatcgtgggggattagaagtgaccctggagatcatcttacttaactttctcacttaggaggaaactgaggccaaatgaggcagggtgacccaaggtacccagcaaggaacatggtcaggactagaatcagcctcctggcctggagttcaggagtctttatcacagcacaatgcctgcctttgggcagggcccatgtccttctcccaattctgctactacttttgggaccctgggcgagacacacaccagatggaattagactaagtaggttttgttcccttccgccctcaagttctcaatttccatcaataaaataaggccctaactggaaacaaatcagaaaataccctcttgctgttaccacagaggataatcagcctcctcactgcagcttaatctgagggagaattagagcctgcagtgaacttttagtagtacctgcagagcccccatcctccctgatttgaaagtataagagagaaaggagtggaggggagagaaagatgatctatataggaagaatcatctgacctgcagctgaggtttgaaaaagcagcattctttctacagaagaatttttaaaaatctcacatgccaactctaatcaactggtgtgtctgacaagagctgctcacaccttagggataaaaactgttgacgactgattggttatgtgtgccgtggtgggcaagaggaggtagaagcacctccccacctctaccttgccgtgtgtgtctctgtctctgtacaaaggtctgtttactgcattctaagctctgactgttcagtaaggaaccctccccaccagccaagatctcagaaggggcagagccccttcctagccccttcctacatactcttagactatggactctttgttatcttctttcttctcacttcttcagtggatctttgctctgaagatttatgacaaattatggaggtcttgcaaattcaggcttaggaacgacaaattagatctcccctatcacttgatcaggaggtgccaaggaaacattgaagctgacatagaaacccaacattgatggtagactctcatcttctatatcagggaaaagtcccggcctgctgaagctcatgcctctttatgctcatctttacccctggcccccacccctcagcaggtacacagccgggagtcctggtgaggtggagcagaatttagttttcaaaaaaaaggtgtctccctactgtccaatttcccaccaccgtgctctgggcagtatctcttaaattgtttggcacgaagtccaagaggctttcctagacactgggctaaattcttatttcattaaaacttctattcccttctgccatcttggactgttaggaagcaccggaggcagaaaattcttagtgggtatctctggccactaatcttattatctttctttcttctgtttcgaccttccctaaataccaacggctccttgtgtctttttttttcctggcaagtgaataaaaagaagatattttcagcttcttctagcttctccctcaggccaaaatcaggagaataattagccgtcattaaagagtgtaatgattcagcaagagcttccacctgaacgtttaagaagctgactgttccacagagccttagaggaccctgacaacacactgcagataaaaactcttgtagccctggcagacaagattcgtaagatgcgaggttctaatgaagattaaacagcctagaaaggtgttaggagatagaaggaaggtatctctgctttctacctaaaatttctggttctaccttgaatacagctgttttttgttgttgttgttgttgatgtttgttttaggttgggatagctgggtagacgccatgcctccagtatgcattgttactctgtacgtctaaagtgtacctttaagcattagctgcttacaattgatgttatggatccagggtaacagaattcagagccagtctattggaaatagtgaccctgcctcaaaccctctgctctttttccagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggtaagtgaatgtaattgatcttgacatgtgtattggaggggaactccatctcactcttggcacctctatgcctcacctgtctcatctgagaaatgggaataataacatactcatgatggctgagatcataaagtgaactaatttgtgtgagagattacagaaatgggaaacaatgcaattattgtgcccacttaagattttaaatgggcttaagatcacttaagatcattacaatgatgataagatcatgaaatagtcatgattgcataatgaataacactgagataaaagtaaattttcttttttatgtgtttcaccttgcaagcacaaatgttaaaaggaataggggtggtttaggttctttccatcatatttgtttaattggggaaaagttagaacttgctgcaaggaggccatttcttttcaatctcaacaaagtcccacaagaattgtgtagagacacagaaaagcataataattacctgtaatgtcctactatttagagaaataatcactgttcaggttttgatatatctccttccaggcttttttttatacgtagtaattcccttacaaaaagtaggatcatattgaactgactgttttccttgctttctttatttaatggtatatgtaatataaattggtgaatgtaatataaatatactttccaatattgattagcattttatagaatagatttaccttaacacttaccaatctcaacatattgaccatctaggatatctgcaactttctaatgaaaagcttacaaaaaaaattgatcatgtacttaatcgtaatcttagcatagggaaaaagctcttgtagccttagtagaccagattagtaagatgtgagggtagaatgaggattaaacggccaagagaggtgttaagagatagaggatatctctgctttttacctgaaatttctggttctacctcaaatgtggcttttttggggggtacactgtgggggtggtagctgggtagatatcatacaccctgtatgccctattaatccatacctgccctattaatccgtacctctaaagtgtatctttaggtattagcattttaatatcagtgggatgagtccaaggtaagataattcgaagtctcttggaaatagtgaccctgccccaaagccccatgttcttctttcagaccccagaacatgaaagccgttattgtgaatgggatgccctctttatttctctggtctcaggtccatagcacagggctcttttaatatgtatttctattatctctgaggagagtccaagggtgtatgagggcagtacctgctatgaatgtgaaagctcttgatcgtgaacattcgcagacgaggtctccacttacctctcccacaaaagcatttgctagtagaaggaaatgctaagataatattcaccttcaaaattatcactggtctctgcctaggggatccaccaaaatggaggcttcaccaaggtgtggtttgccatgaagaccttccttacgcccagcatcttcatcattatggtgtggtattggaggaggatcaccatgatgtcccgacccccagtgcttctggaaaagtaagagctggttttggagcgctcttcaggaatactggcttctcatgatctgccaagctcttgcttttgctggtgtccagttcaagcagccagtgtgtgacttaggccagtgatttgaccaggagtcatcctggactcctttttctcctgcagttttcctatgcaagttgttattaagtaaatcctcggggttctacctctctcacctttctggctctttttaattaattaatttattttttggagacaaggtctcactctgttgtccaggctggagtgcagtgctgggatctcagcttgctgcagccttgactttccaggctccagtggtcatcccacctcagcctcccggtagctagaaccacaggtgtatgcttcccagctagttttttgtattttttgtagagacagggtttccctatgttgcccaggctgatctcgaaatcctgagctcaagtgatttgcccgcttcagcttcccaaagtgctgggattacaggtgtgagccaccacacccagctgacctttctggttctttaacctgtctttgctcttcgggatattccgtggtcagaatcagatacttgtctgtgttgtagtgaagaaactcccctaagcccagctcctctcacttacagaaagacagtgctcctgtagatgtacctactttctctccacatcattgacttctccctttctgctggattctattaatatacaaacatgtcctgccatctcccattcttagacaaaattctcccatttcccacttccccctgaagccacataccctttttctgctcctctttacagcaatgcttctcaaaaaccttgtgcatatgtcttctcctctgttctctcttgagtcctttccagtctggattcatctccaccactctactaaaactgcttttcacgggatcaccaacaaccttcatagtccaaatccaaaggtcattttttgttcctcactttttttttattcatcccagcatctgacataattgatcagtttttcttcccagagtctcctctacccttctgttggtcattcttctttgctgaccagcatttagattccattcctgtctccttccatctttccagactcttagactttgggactggggcacctgctttggacctcttctctttattagctgtgctttccctaggggggttgatttcacctacctttgtggtctgaaaaatcatctattctctgatgactcttaatctgtatctttagcctcagcctctcccaactctggacccaaatattccagctctttacttaatgtcttcatttgcattgaaaatgtcacatgtaccaagaacaacacttgattgtgtcccatttccaacctattccctcccaggatccccatttcagtaaaaggcaactccatcctttcagttgttcagactggaaatgtagcagtgagtcatcctgtatgtctctgtttttcacacttctcatcaacctcaccaggaaatctcaccaattccactgctgccaccctaatctaactaaccaaccatcgcttctcacctggatcagtgggaacagcctcgcaacccctttccttgcttccatcacgtgcctccctgcagcctattcacaggatagccaggagtgccccctttcaagtgttaatcagatcctgtcacccctctgctcaaagctctccactggcttttcatctcctttgccctgacctataagccccttgatgattgggtgccttccacctctgatcttgtcacttgtcctctccaccacccaccagccccctttattgtgctcaaacccacaccccagggccttcacacctgctgatctcttcgtctgtccaccttacgtaaaatcacatccccattgctctccactctcttgcctagctttttttttcatgatgctcattcttcatttattatctttttcttgtactccctctctcattccatctctatgcaagcatcacaagagcacaatccttgcttttcttgttcacagttatattcccagcatcttagaatagtgactgacacatagtaggagtttaataaatattttttgaatgaatcatgtcactccattgtttaaactttttattggattccaataaaaagtctcttcaagataaatttcagttctccagtggggtatgcaagtttcttcatgagcacagccctctttgtttctctggtctcatgtcctgtcatttcctgatgtgccacatgcagatccccaaatgcagcaggttcttccaggcctctatgcctccatccaggctctgccctctcctccaaacaccctttccacttccctcactttgactcacaagtcagctccattcctgtctgtgtcaaagtcagaagtcctggtagcagccctctatgctttaaaactctatgatgttcctgatcctaatctattcagttgtctctttatctggctcctctactaactgtatctcccgtgagtgaaaaaacaggtcctgttcatttaggattccatagtgctaacacaatacctggtacatgatctgtgcttaattaacatatgtgtttcaaggggatggaaaaaagtatgaataaatcagtgacttaagaattatattttagtagagaattggcagttcttagtgtgacaggggaagagtaaaataaaagctaaacaagcagtcaagagaatttacatttcaaatgtgtttggagtcatgtattattgaaacaaatatgcttatataattcatagttgctgaggatatcacaataataatgagtgttcttaatgatcagatgaatgataacctgaataggtgaaagaggacaattgtactcactgaggcctgggtgagaaggcaaggggacacaaacattataggaagactgccatctgcagtggtaccaaagtaaagtgtgaggcattaaggaggtcaggttcacttccatagaaaggttggtatagcactccctcattctgcagcagtgccaactacataggacgttttgcatctctgtgcagaagaaattgatcatatggcttcagacccaataagtaacatctcatgtctcaaaactgaattcggggaattgtttgaaaatctgccttccagatgaataaagtggctgtcctgatattttctcaccatcagagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggtaagagccgccgggagggacagacgtctgtaccagctgctctgtgcaggctgccaagctgacacctgcccccctttgcctctagtcagcagtgggtgagacagaataaactagtagttacaagtgggaactctggaggcagaccctctggttcacattcctgcttcaccacctgctgaccagctgagtggctttaggcaaatgacattatcactctgaatctcgggtccctcatctataaaatgggatgtaaagacctactgcatggggttttcatgagaattaaatgacagaatgtgagtaacttaagataaacacacacattctaatgattagtattatttcttgcccttgagcttgagtttcttgtctgctggcttctgccctgcttgtcctgtccccaggaatacaggttaaccatcagagaatgtgggcctggctctttccagctggcaatgtgtccaggtggcctagtaacccctattactctgaaatacagaccttcccggtctcctcagtttgcacagacaccaaatcatatttcaagagggattgaaggtaccatggttaaaaataagaatggtgtcatcatcacattgtggctaagatgatatgccagctggaacttggtcttcacgtcaggcacatgggcttcacagcagagtggactgtttttaaattccattatggctcaatcatgaaaaccagacctctcaagtcctgctgcccttccaggagagcagtgtgagagcagagagagagacttcttcctactgctaaactgtctacattaaggggtctttctccatgaggtgtcctccagcagagatgcgctgagaatgaggcctcagcagcagggcgggggagtggatggaacttggtccagcaccaggaagccagccaaggattgtccgcagggagctggtgtggactgacccacctggggccccacctggaggctaagatcatctttgctttcccttttttctcattctacattccttccttttctttctcttggtgtctttgtttatcaaggggactcattcctggttttaataaggatggggagaaaatatgcctattttcctcaccataatagacacactttacatatttaaatgctttaatgtctttactttgtcttctgaggatcagtcacttttataaacacaagttacaagtcacgtagaaatttaattcagaatgagttattttgtggaccacaaaatgtcccctgcctgggagccgaggcctttctttgtgttcccatggcatcctgttcttattactctcagagcccttatggctgggctttgtcatgttctacgtatgtgccagactcccccacagagatgagctcctgaagaagagattttcatcttctttgttctcatacctagaatctagcatagtgcttgatacacaataggtggtcggcaagtgtccttcgaatgctgactcccccatagaattgcttggtcttcctctcccctctatctcccttctcaatttggttttcctcaggatcagcacgagcggaaccacatcgcagggtattggaagcaagtcggacccattgccgttggctccttctgcctcttcatatttgacatgtgtgagaggtgagcaagtgtttgtgggacactgagccaaactgtgcatcaccacgcccactcctgtcattttaggaggagtgtttgaaaaggagaatggtggtcgggaacctttggtttggaagcactggacgtggtcacatcctcagacaaggtctgggatcaaatcaaaggcacagctctttacagttgaaaaatatttgggccgatgtattctacaagcttcatttctctttaggatttctgtaatgttttttagcctaaatacagccctcacccctgcagctgaaaagctaagaatatgtgaaaaggaaagttcccgttgcctttgtattaattgtgtcttgcctttccatctcattttctttgtagaggggtacaactcacgaatcccttctacagtatctggactacagacattggaacagagctggccgtatccttccttgatgggctcagggttttatttcttcccctggccacccagtccccaagatcattttctaaggctctgctgatgctccccatatgtactcagccagggctttgattctcaggccaatcataacagcacaattaaggctaataataagaagaattactgcttgctttcaagcctgggtgagagcaggcaaaatgagaaggtcacagcctatcctcacagcagagggatccgagttgctaggcttactgcagcctgtctgaattatctgttatacactgtttcctgcagactgaagcatgactagcttttccctggagccatggaggttcatctctgggcccctgtggaagagcctgtttctgaaaccacctatgtgtgagacttcttaagtgaccttggtgtgctggcaaatcacactgctgctatttattcctgagaccaagtggagataaggctaaggtgattagttccagagaagtcgccaaggcttctggttggttggcataaactctaagtcatcttcatgaagcagaagtgacagtcttagcttatcccttttaggatgctggatttaaatattttatcttccggaatagtatgtgaaatgatcttgggagaaaaagactctgctctggagtggagagaaaggcttgggttgtattcttccttgatggctcatatcttgccacgtgctagggaatatcctttgtcttgccatgatgtttatattggtttctcagtgtcacaagaacattgtgagcaaactaaatcagtagtatcatttcctcaaagatgagagagaagctctacccttcctctgttatgcccccaccaaatgttagctgcacaacaagaagaatgtttctaatgttaaatctagttcaacttttttaattttgtagataggatggagtgagtaaaatttcaagtcctgcagaaaataactatattcccttcattccaggatgatgttcattataggaaagaaggagaaactgcattagatattatattatttaatgaaatatgcacgccaagttcatacttattaaatgcttttaaaaatagacaatttgggccaggtgtggtggcttatccctgtaatcccagctactcgggaggctgaggcaggagaatcgcttgaacctgggaggaggaggttgtggtgagccaagattgtgccatcgcacttcagcccgggcaacaaaagcaaaactctgtctcaaaaaaaaaaaggcaatttgggcaaagttgtagcagaaaggggttggaatcaggtcatctgccttccaaggcagctcacgctatcctaagacttggtggttctcagactggctctaattggcaggtcagtctccctagtgggtctcaagtatactggcagcaacccagactcccacctgtgccatgtgtccttgaatccccattctgttggacaagattttctgtggtgacagaagattgcaaatagtccttcatccctggtttcactttaagactttcaagcccatgcccaggtcccctgcactgagcccccacgtatctcctcttcaattatgccagagtatctcaatcgcattcttataaaactccaaggactagcccagtggttcccaaacatagtcatacttgatgtcctagccctggaatatctgattccatatatctagggagggacctggggatctacatttgaacccttctggtgattttactgtggtttttcatctgatccatagtgacgaatatatggtttattagtgcttctcaaatttattgtgtatacggatctcctggggacctggttaaaaggtagattctgattcattaggtctagggtagggcctagattcttcatttctaacaagcaagacaccatttcttttcttacttggtttagaaagcaatattgaacacctccctctgtggtactaatgtgtcaagaaacctatcattggcattagaatatcaggttttaatattttatccccttgaaaattttctacatatttggagacaaaacaagtattgccaacagacctggggagaagggcctggacccggctcaacttggccttggctagcccgttgtttcctttactggacacgaccagatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggtgggcagatttcttggctcgttctggaactggtgcttgcttgatctttccacttgatgtgtaaacacacacaccctggagatagaaagcctttactttgaaatacaaattgagagattctcatgtaggatctctgggcaaaattagaggccaaatcttactctgagaagcatctagctggcctaaatcttggtgttttctgtggtacaaatgtgtttccattttcagtaatgaataaacttgttcagccggttcttcagcttggtgatggaatgtaggttacatactagctgggagattggactatggcataattgggattttgttgggatgaggctttagtcaaagttctgtcccagaatcaaccctgtcctgtaattaaacagggtttagcccacgtgatctgatttccagactcttaacaggccacattcccctaaaatatccagcagatgctcagacagagttcagtaatctctgtttatagattatgttcctcattcaagagaaacacttaacatcctcaaatccccaatgcaagcaacacatccttgatttatcagggatcccctgggttcatgcctaagtggctgtccttggagaaacaagcctaattcctgtatgaaaagagaagcagaaactacagaacctcagagtttttatatgcagtagatctgcacagaagagcccctgaataataggcctccctctctgaaacacaggttctcttaaatcctgctcttaggaaaccacaggcactttctaaggcttgcctgtctccagagctggagtgacatgagaaaattcaaccaaatccacttcatgttgattaatatgcacatttctttttgttcactggagcagaattttattacaaccacagaaaacttggatttggtaactttgaacccttgcagagaagcataaccagcttagcagggaaattagcagcctcacgacgtgttgtgaatataatttcccaggctctcgtatcgctgctttatgagtgataagaacataggaaatacttggcccaagaaattttcagccacactcacctctgcagaagaaatattactatgggaaactattttactgtcattcttagggatttggttttacagatttctttaaaattaagctttttatagatttacatagtgagaaaaggattggtagctgatggagtattaaactactctttcttttctaataggggctaatttttaggttcaagttcctcatgcttatcaccttggcctgcgctgccatgactgtcatcttcttcatcgttagtcaggtaagtggaccctgagatgtcaaggtgagaatgtctctgcagagatccctctaccctgcacagaaattcaatagagccactgaggaaaggaggagagaggccataattctggacagctggtcaagccatatttttctgggtcttgatatcacctggccaaatggactaaattttctctttccgtaaaaccttgtaggagataaaagtttccaaataaattaaaagcctacagccagattgaagggcacatattttatttacttatgagaaaaacttatcaagccgtgtagcacaacactaacaagcataaatttgattccatttttatctagcattaacatagatccttatacagtccatcagctattccttgtaataattatattgccacttaaatatgaaatgtaattcaaaagtctctttgatagcatcttgtcttttcactggttatttccaaaactcaacattttgctatacttgaaaatctcaataacaatcattttaaaatattcataacttgttttgaagggtgggaagtactgtttaaatctaatgtatctattattcatttgagcatcacaaaaatcctacgaggtaagtagggcaggaattgttatcctagcttgctagactatgatatctaatagctttggagaaagttttcatttatgttgcttcctagctggataggactgtggatggattacttaacagttctaaggtttaattttcttatctgcaaaataaatattacaatagaaccacagaaggttgctgtaatgactacaggaagtaatatttacaaagagggatgcattctgagaaacgcatcattatgtgagttcctcattaagggaacatcatagagtgtacttacacaaacctagatggtatagcttactacatacctaggccatatggtgtaacctattgctcctaggctacaaacctgtacagcatgttcctctactgactactgtaggcaattgtaacacaatggtaagtatttgtgtatttcaaacatatctaaacatagaaaaatacagtaaaaatatgatattataatcttacaggaccactgtcatacatgtggtctgttgttgactgaaccatcattgtggcaaccaaatgtagttagcagagcacctggcacattgtaagcatgagtagctgtgttcttatgaatagcaagaagcttgaatgtctttcttgccaaaggacatgcaataagttagagatcagaacgcagtccttctgactcttttgccagtgctttgtcatttagccaaaatggaggatttcagtagtgtagatagtgtcttaggacacgacttgctccattctgctgggaagtttccctagtacagggactcctaaccatttttgtatatggacccctttagcaacctgaagaaggctacgagtctcctcttagaatggtttcaaataagtaaaataaaatacttcgaatttcaaggggaatcatctctatatattatatgtaatatatatttacagtgaaacagatgctacaggtatattacagatttatatctacaactgtaattgatgtgaaaatatcatgatttctattgagaaaatcacagtagtactaacactatagggatttttctacatccataattgaagtaaacattatctttcagctagagactagtgaaaatatataattttttctattctagtttatggaccccttgaattctatccaaggacacccaagaggaccccaagtttggagcctctagagccctgttgttggctctgccactggggagtgttagtgttgctagctctgctgaggttgaaatgaacgtggaaaaaataaactgatacacatatatgtctttgtaagttctgttcaccacatctgctttgacctacaacactgctgtgtttatatcaggttgtttataaaaccttggaaacttcgctttccactccatttgcagtaaaactatttcaaactctgaaagagtgttttattctaccagctaaggctcaaacatccatattcaaacaagagtgtctgaggcctgacttctcccgtggctattccctcctatgaccaaaatgcttttcagttcctccagtccctcagtagtgcacagtggcacttgacacagccagacctgcaaggctgagagggcacagagcacttccttggagaaacggcatctcaaggaagatgggttgaggcataaaaggcaatttcaagatatgtttttaggaaagcagaaagaaggacgcttttgatcctaaggccacacacaggtccttgtgccagtttgggaggctgacgtcattctccccacactgcctcatgtatatcttgcctctgcggggaatgcctcccacctgaagtcaagaaggactgatccctgaagcagctgcatgttgccaggatttaaccttgtacatgtttaattagtgtacttcttatagcaaaggaagccatcttccaaggagcatagtccgtggcttttctttggagaaaaagattaatattctattgcctcagtattttctaatacagcttcagcctgtggctggctttttatatctgctgcgacagtcggcccggagtggatttcaactctaagggggtagcaatgaggccttttgaattccattagctcctcacattcctcctgctgggttttttttctaagatttatttatagacatctaagacgttttccggcataactctcagtgtcccaggtactgtattaatatagtcatcagaggatttattttttaatgtcattttggaatgtcagagcaatgagctcacctgaaaggaaacctattgggtaactttttgaaatggatcccagccttaggtaaaaggaatgtattaaaacccccattatactctcgggcttgctgtgggagagcttgcatttaagcctcatgaaatataatgcgaggggatctcgccaggatattgaagctctgaggccaggaatgaaaggcgacgggaagctgtggaatgcagtgaccttgaggctttgtagctgggtactgaggtgcagtcttttaatgcctgccattttaatggcctcagtcatagcaaccaagagatggtacatcgcagtctggtatttcagccccttccctctggaaaagaaagaggcgttccatttagaggtggcggcagtagggaacagaagtgcagtgcaggggagaaggtcaccgaccttcattaaggggacccccaggtgcctgacattcaggtcaagccacatgcagcaaactcccagagagcctgtccccagctcttttgtgtgtgtgtgatcacttcattctgttacttacagaggaaatgtttccggtaagagagcctgtgtctgggatttggaaatcttgttgttaagtggaatgttggttgtcaagactactgggtgtaaagagatttgaccttcacttggctccaggggtataattgggtggtttcacacaaaagtaaattgttcaaatgtaaaatcaggaaaaacagggacttttagaaataagacttatgcagagggtgagatttggggattttgaggaggggggagggtttggcggaggggggctggggctacctgatttttctctcaaagttaaaaggggggagactgttacctccgccttggcattagtaagattttggatttacaaggcctgctctgttgaggctgctcattgtggtacatattggtgggaatgtgctcagagctgaggatgtcttaggcatgaataattgggagaggagagggaaaaacaagccagccaccaaagagcagagttacactatctataccgtttatttctgcagttcaactctttgcccacagcaggaaacaccacatttacagattgcacattcagtagggtgtgtaattctgcaactccactctaaacaatgtgcatgtgtcccagagcaagtacgagacgggagcatgagtctgatatttcctgtcaggcttggtgtgtgcctctcatactatgggcatctcattccagtggttctactgtaagtttttattttgtttatatatccagtttataccatatgttactatgtccaggatatatagtgcatactatacagatttgaatagacaaatgtgtgcatgtatgttgtatttgtaatgtacattatgggcaatgaagtgaatttcaaaaggaaatttgaccttacatagtcgttgcctcatgtgctaccttcagagcatgtgctaccttcagagatcaacccctgtttaagatagcattcctacccttgtgttgtataatggttaagaataccttcttttggagtcagagccatggctttctggctgagcaatcttgggcaagatactccatctttctgtgccacagtttacccatgtgttgaatggaaatattacctacctacctcacagcgtcattaataagactaaataatgtgtttcatgtaaaaggatttagtattgtatctggcacatcattagcattgaataaatatgcttatccttgttatgaatacaaaagaatcttagctttgctaatatttgtgttaaccacttattttaaataagtataacggaaagcaatgttttaaatgaataacacttgtcacacattggcatctcctctcacttttaaattcaattattatgacttgtggactgcaatactttgtctttacttttcaatcaagtacttttaagagtggttctttccatctccactttctacctccatgtatttgtcctggagtccctacacatacctgtactttacctctgttcattcaacatatgtctatcgagcaccactgtgtgcaaggcacataggttggtgtttccttagatgggtcagtcatgtcaatcctagcaagaatcaatgtcactaaaattgtcaatattgagtatttccagcttctgtcgcaggaatagggtctcttactggcccttccctgagctgaagggtccactgccttaacagagtagaagagctgccatattgccatattctctcttgcagctaggatgcgtgacagcctagcctcccctccttaatcacatacagaagagttctctgtgttatgacagcaggtacctgtatttctggaaactatcttaatgctttcttttcctttccattatatgcaataaaaatcatcataagatgctctaagtaatatagtttttataaagttagtatattctgcacttaaagaagagcgacatttggagacatttctaagaagtcctaagtagcttgaatgctggtacattgtcctaaaattagtaatggttatgaaatccatctttgccagaaaacacttctgggcattttatataaaatgcattattttccaaaataaataagagttcataatagtggtttgtttatgagtcacaaaaagtgaagaattatgtatcaccaaggccaaactaaaactgctaagtctataattggctaatgtggttaactgacactcctggtctttcagaaaaaaatacctatacttagaccttaatttggcctagggccccaagtgggttatggattatacagaagataatgaacacagacccactgtatcataaacaggcaatgaaatccacctgcttgttaaagttcttaacatttcaatctagcctgccatcttacaatttaaaagtgattcctagagaaagtttatacaacgcagcctcattcagctgtcaaaggaatatttacccaatactttcttctatttccattttaagtgtcccgtagtaagcagaagtggtcaaaatcatttcatttgtctcagagctggcacaaattagtcacttagctcagcagctctgttgacagttcttagtgtaatccatatatctttaggcagcccttaagacaattaccaaatcattaacacagacaaaagcagcttcaaaacatctcttgcagaattttgaagcatatgaaagcttcataattattttcatgagtggcttacttcaagggatgttatagaaataactaatatttactgagtacctgccaggcaggttctagaaatatttttacttaattctcttcgataacctgcaagcttttatgttacacttacggacactgaagttctgaagtctggagtcttcatcttgtcttacattaagccgagtgagtggtagacactggatttgaattaatctatggtgcatcaggccttaaagacatggcagcagagaactggtctctgcctgcagggaattgacatctagctgggaagacagacagcagaggaggaattataattgtgaataagtgatgggctcaaacacagtttgtttaacttagggatagcaatgaattgctgtttttaggaagagacactccccaggtgatactaatctgtgggcaaggtaaggaccactgactgtgcctgacagaaagctagagaaccttcagttgaccttaatttacaccgaaatgattcagattaaaagatggagtcttacatggcccttcatgtttcccacatgtagaagagacttggttttcatgttggttggttcctttattggtgttatgtttcttctgtttcttctctgtttcaattgaatatcaccatcctttctccgcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggtgagtttctgtctctttagaacagcttaagtcaggataaataggcttctgtctttacaagatttaaatggctaaagctctgagatgcccagtgaaactttccctccaagtatactcctcacactgggagacggtgaatgagcacccaggggactcacccataagacaaaaagcccacacaagccagatctttctttaagtcctcatttttaaatctctaaaatacattgagaatattgcatgctaagtctaaaatatgtcttgattttagaacaagagtcaaattttcttctttacatttttgagcacaattgactgttggaaactatgccatgtttattcttcccatttgagaagcagaatcctaagatatcaggtggagggagtctgggccctgagagctgaagatggaataggcttcatttttcttctgctcatttttcttcaaggtgatttttcgatgtatgtctaaaccaatagctattctcctgtccccagttcttcctgtcctttagtgctggtatgtgctgctgcctttttatatcttataatcacagaacactgagacatggatgctgcaagtagccttagagaatccagtcattttatagataaagaaactgaggcctagagaagggaagatcttgctcagggtttcttcactagccacagcagacagaaatgattaacactgtctaggccagtgctgttaacaggtaacaggtggcctgataaacaactgatctaatagatgctttttctgtttggttcagccttattcctcattctgtctctttttacacctgctttactctagccatgcatttgctattccccaaacataggaagccctttctcaaatcagtgctctagtgcctttcactctgccttgcagtggaaaccagggtagcagccccccagagccaagggttggcctcacctttaggaagtactcagtgagtgtgtgttgcatgagtggattgcacattctgcctccatctgggactaatgaaactctactcatcttttgggcccagtcaaaatgcagcatcttctttaacacctattcccaatcaccccaattagaatccagcaaatgacattcaatggaatattgtctccatgaaatgttgataaatttaggtagtcaaacatgcttgagaatgattgagttgatcagcactaataaggcttttcactgcaatacatgttaatgcctttagtacattaatttgtactgtcagtctttacaaagcggggggtggtaacagcattttccagaattattagatcatttggccctggcaccctttctttaggcagtgtatctcttgaaactgttgtcctaaggaatatgcctaggggatcatgagtctactttccacatgacatttattgtgtagaggtggaagatgagtcatctgtgcctttatgctcctgctggatcatcgactccttcagggcaaggaccagttctttaggatacttttaaaatattgagtgaattaatgcttagaagtaagagttctagattagccttcagtgatcttgtggggagaagggaggggggtagttacttgagagatgagatgaagtggagcaggagaggaaggcatctgtgctgggggtcaagggacgtggagtggtctcagccactgtctgtcttcatcctgtatttgccatgtccatgcgagagcatgctggacatgagtttccctcaccccttgacctctttggagtagacatgttacaatcagtttcaagcccatctctggtctgaggtgagaatacagaatatttacttacctaccccctgcccaactttggtttgactgactgttttgctagaaggcttgtgagctaggcagccttcttcctttccatttctagtaaaaacaccactcggtgtttttactgtacatgtggaaaatgggagcattcagcctgtcaagcagtgggcttccacaacacgagcagcaagcactgctgggcttgtggacaagaatcttgatttcattccatggtcatcctgtgggggacactgaaggaaaccatgtggccttgtccttgatgtgagtaggtagagtttctaccttccagagaaataccacttaaagcaatggctggacttcctggatgatggaatgataataccggtgggaaataattatcaagtactgactgtgtgctacagcactttatgtacataaattcttttggttgtttttactgtgtgactgttggcaaaacacttaaccctctgtgcaccactgctcccaaatgtaagtgatctcctaaaagtccttttgaactacgaatttctgtggttagcctgggtgcaatggctcacacctatagtcctagcactttgggaggccaaggctggaggattgcttgagcccagaagtttgagaccagcctaggcaacatagtgaaaccccatctctacaaaaaaaaaaaaaaaaaaaaaaaaagccaggcatggtggtgtgcacctgtagtcccagatattcaggaggctgaggcagaaggatcccttgagcccaaggagtttgaggctgcagtaagccatgattgtaccactgtactctaacctgggtgatagatagaggaggccctgtctcaaaagaaaagaaaagaaaagaaaagaaagtccatggttgtctttcttcctattagcagggaaggggcagaagaacacttcttgccactaagtggcagcccagagagtgatatctgtcataggtaagggatttccaaacactggtgagaacgtgtccaactttaacactgttcagcaagtgggagcccagagctgtggccaaccctgcagaggcaggatgactacagaccaccatgttggacagattcttgagatttgagccatatattaggcagctcccatcaggacttcccaccctacacagtagccagtctcctaggcttgaaatgttgcaattgagaaaagcacttcactcttcctcaacagagtttttcatcaaagacagcttgatctgtaatttcatggaaaacttgcaaataattctcaacaagaggtcatatcccctgaatcctctgctaagtgggtgtttttaaatgttcacagttgttttggtttgtgactataactgggacatgcctttggcatttagtgtccagattctaggggtgctactaaatgttgttcaataggcaaaacaaggctcatgtcataaagaaatgtcctgcctgtgaaatgccaagtagaccctctgtgaaaaaacattcttcaggcaatttagtgggcaaactatttggggaccatatgctgatcctaaacacaaaagtcataagatttagcagttctcctttggtaacatgatctgtgatttcccagcacccccgggaacccctggcagcttgtgggcccttccctttcctgcatggtgctgtgaccttgtgcatttggaaggggtctcttccatgttgggcattctgcttatttttcttctctattttgtttcacttttcatctcttcatctgccaccagatcacacgatgtatcctaggaattacggagcatttgccaagatttcgaagttccttggaaagacctagtttggaatattatgtggaaacctcaaagaagaactcttgcaaggaaggatacatgtgtctttacattctctgagtctctggatggcattctctctccacctccagcattcccatgctccttttccattctcatgggaagtctttaagttggctttggcctttccctccctatttctttctctcctttgctttgaagcttcagagctaggaattcagatatcttgctacagagagtgaatcccaggtgtgtggggcttcagcctttgttagatggatcctggacggagcacagacaagcagtttctgatgccaaaggcaataagaaaagggaaagaatctttgatggaggttgtttggtatgtgagttggagggacatgccaagtgtcaggaggaagtagaagtgggtaggaaggaaatggaatcattgagcatttcacgatagactttttcttctctcttttggtcatagaatggacagagaagaacaaagtgggccacaggttcaagacaaggtcactttccaaagagcattttctcatatatttctgtttctctttcatagtatggatcagaaagtgaccctttacaaatgaaccacggagcacctcagtacttagctcatacctcataccttagttccttagtacttagccttgtgccatcttgaatgagatggagtgaagtgaagctcgaaggagtgacagagacatagtccttgctctcaaggggtctttagcctggtctgggggacaagatttcctcatctacctcttgaaaggtggcaggacaactccacactggagtgttctcaccagcagataggtgctgcgggagtgtggcgccacattctttatagccacaggctttcgtggacttcccctgggttccttcctattggctggtggaccatagcggcagtgaatgtgcaaactcattcacattaatcattttatttttatgtacatagaattatatgtgtaatcattttatgcatatgtgtctgagtgtacacacacacacgtgcacatatagatttttaaatttagcaaagatattttagttacctttccttcaaggaacacttatattttctgccctgctgctgctgctgctgctgttgctgttgctgctgctgccttttcatgacagttgttctttttacctgttgccataaccaatttgtgaatcattctggatgtcttcccaggcagatatgaattgcagcaggctaaagtgaatcctcttctcagagcaaaaataccacctcccggggctccagcagcaaagccctgcacacatgaaaaactgtgcaaacccactcaaccacaattcaggtgggaataagaagttggagctgcttatgaagtcagacaattcttgataatagctttgatttttgtgttcttttgattataaaattcttgtcagaatgttttaaaaaaagaagtgagacacagaattcccaactagatgactgtggcagagggaacacaagatgccctcactgccaccattccctcctatttctgttcacgctaagcattttctgtctaatgcacccactctgcggggagcaaaagcggcaacactggttccgcgtcttggcagctagctacagtgtgatgtcagttttactcctggaggtttctgaggtctcctgccccttgtttcataggaaagatggctttggctttgttgcctcggtaaagcgttggattaagtcctgaggccctgacattggttgcccccttttattgacgccatctccctgattgtacattagatgatctgcccatggccagctgagcttcttgatgtctgtgagcactgatgggattggtcttgtcacacgggctggacccagaccctaaagcaggtcttaaaagcgttttcccattccccagtgaaggtgggaaccaactgatggaccgtcaccagcctggcaccccttgctcagctgtttgtaatcaggtgtcttctgccccctgcctctcccagggctattgctgtgccagtgacctgacctttcctggcccagtcaattaaaatcattttttctgagtcttagaattcttgtcaccccaccatgatagggacatctcagttaccttcttgggaagaaccttcggcttcctaaatgtttgctagagttgctatacgaatactacagacagggtgtcctaaacaacagaagcttgttttctcacagtctgatattaaggtatcaccaacgtgggtttcttccgagacctctctgtctggcttgtagatggatactttctccctgtgtcttcacgtggtcttccctttgtgtatatctatattctaatctccttttctttcaaaggacaccagtctgttggagtagggcccatccccaattgacctcattgttaacttaattacttctttaagaaggccctatctctaaacacagtcacattctgaggttctaggggttagaacttcaatatatgaatttgagagtttgggggagatacaattcagcctgtaacaccaagattttacccccaaactaataagttctattgtgttcttctcccacttgcagttactgcctggcagtaagtgtcaggaggtgctttggaggtccatgggcaatggctcgctccaagcctggaataaatgacctctggggttgacaggcaccgagagacaactggacccagggctcttaaccctgtccaccaaagccactctgccccatctcccagaagggatcctcaaagctgagctatcccaaggcacacttgttttctaactgagggtgttttcctaaatgccagtggggaagaacaccagtgccgatatgctaggctagacccagccatgcagagtacagaggaactgcccttgcctgcaccaggcaaatctttcatgggtgttttgagcacttactatataccacatactgtcctgggtatttactttctttggaaaaaaaaaaaaggccaggtgcggtggctcacgcctgtaatcccagcactttgggagtccaaggcaggtggatcacaaggtcaggagatcgagaccatcctggctaatgcggtgaaaccctgtctctacttaaaaacacacacacacacacacacacacaaaattagctgggcatggtggcatgcgcctgtagtcccagctgctcaggaaactgaggcaggagaatctctttgaaccctggaggcggaggttgcagtgctgagatcgctccactccactccagcctgggtgacagagcaagactccatctaaaaaaaaaaaaaaaaaaaaaaagaagaagaaacctaccattcaccattttattattattttttcttttggttaagatctttctatgttgcccaggctggtctccagctcctgggctcaagtggtcctcctgcctctgtctcccaaagtgctgggattacagatgtaagccactgcaccagcgacactattttgttctttaacataacaatcatattaacaccaaaaatgtaaggcagacatattcttaagcagttctttgcatgaaaataatttggctttaaaatactacacttttctgtttttctcattctgctgtgaaccagagacttcgttacaaaaagttatcatttgaacttagctttgaaggtgaataggagagaggttggtgtgggcctagggaaaattctacaaaaaaggataggtcatgaatgttctggaaagaacataagctttggaggtagacacagatggtttggaatcttggctccggcacacattgtgtatgaccttgagaacaaatatgaactcatggtatgggagctccctggctttcacacttgggcagtggggtgttaatttgcattggtagtggtgaggatggaagtacgtaggccttattaatattagaagacctctagtggtacctccgatctctcccggaatctgtaatacatcctcagaatgagagtagctgttgtcatttttattgaagtgggcacagatacacaaacaattgtcattaaaatgctgccggtcctaagaagctgtctccagtgcatatggctttcttcatcctcattaggcattccaggcagttacaaccaagcagccgcttacacacctgtggatgtgactccacacatatggatgcattgccgtagtcctttgggatgaaatctgtgccagagattggtctcatttcacaaggttaggaagaaatagaccgtcatctaattgttaatgagctgtgatgaatttgacatcataaccagggagagaaatttactgcaaactaaagcattcttttcttttttctttctcactctttttcaccccaagacacatatcacattttcagaagggttttttcttgtctgagatgggaagagacttttgagcatgtttgtgcactgaacagcaggagccaagagagggggaaactaacagatggagcaagaccttggcagaagtaggaggtgatggaattaggaggcaagtggagggatctccactcgtgctatgttactgccacgttcacacacccattccccaagggggaacagttggccttcaaggtacaataaaatcacatgtgaaacatagattttggtgcatggagtcccattatctgggtcctcatccagcacagtagagaaattaattatgccacagtagcttcacatcgtacaaggaaatacagggcatgctaaacccctaacagtgcatatggccaatactcataaatttataacagctctcctgtcagtgcactgatttatatgctataaatttatcagatacaaaagcaaagtaaatatgctaaacaatttattcaaattattttatgtgtagttttttgttttgtttagtttttgagacactctctcacccaggctggagtgcaagggcacgatcttgacttaatgcaacctccgccttccgggttcaaaccattcttctgcctgagcctactgagtagctgggacttacaggcatgcgccaccacacccggttaatttttttaattttagtagagacagggttttgccatgttgaccaggctggttcaaactcctgacctcaagtgatccgccgccgtcagcctcccaaagtgccgggattacagatgtgagccaccgcacccggctgtatgcggatatttttagctgtaatgctgtgtgtgtggacttcatacctcactggcagtctcactggctgctggaaacttgaatatttaagaagaggcagcagaacccaaaagttgagagcctgcatcctggcacctatttatttgaatcccacacactatttagcagcttgggccttgggcaagttacttagcctctctgtgcctcagtttcttcatcggcagaatgggagtgatgataatagtgcctctgaggactgctatgagaattaagtgcattaatatttgtacagtatttagaactgtgtcaggcacgtgttaagcattatgacataggtatccatttaaataaagaagccaaggcaattttggctgttttttcaagtgatctgtaggatcatatgcatattctaagatctgctaattggagtcatattttaagtttaaagaattaacatctttggttcaaagcctgagtagaattactctctagcatctatttctaagaagtcctcagggaaagggattccttaggtaaacggttatgagtgctaatgggtccactggggtggtcaggactctttgaaattttgatgactcacacagacatgcagatcatgaaactggctttgaagttctgatggctagcccagatatgcaaatccagaaatagctttgactgagaaatgtgaagcttagactgcttgtgcttgactgaggtgtggactagatgttgcagcagtgagaatacaagttattggcctgggagtagttgctcactgtacaagtggtggttcagcttggcccaaagtagcccagctaaagcctctcaccagccttacttggcatctatgctctggcttgagggcagatgaatgtggatgtgctggaggctggactgatgcccctttaatgccttctctacccatagtcctgtggattagacccttgccaaaacagccccaaatgtcttcagcagtcctctgcagcagccaatgagtctgcttctgaggccagggaatctcctgggtagagagcttacagggtggcatttaataataggactgattttgctgtgcagccacagagaaatgggtctacgatgagaaactaatactgcgtggcacacgtgaagggaaccagccaagcagcctgctgggccagtgggtgggagtgacatctggggttctaaggccaccagattcattgatgcctagcagttcttaaattagtgataagattactagtcctaagggtagggccaaggctgcttctaagttatggtatggcatttcaatggaaaacagcatttagttacttaattctatgctttaaattagaaaaacttcagttccagaaaacttatcatatgatatgtgcacaatataaaaatcactgacacaagtttaactttctattccccagcacccctctccacaaacatgtgtgcacacgtgcacccccacacacagtcagactgagcgtggttgcgttttccattttccctttgttgtttatacattcacttgtcttatggcaggtagcagagttttcgaggtttaacttagagaaaatttttttctcctactaatttagaaaagttcaaattattccattttagcagaacactgtccactgataatgagttcagaacacttaggacaatcctgagggcagaaggaaatgcacagcacgtttctggcacttcttttttcctggagaataaagcccctcattgttcctagatgtgttagacatggctccttccccaatctatggatagatataagcaggtcttatttgctttcacgtgacatagatgctttgtagtttatttttttatttttttagagtcaaagtcttactctgtcacccaggctggagtgagtggtgcaatcatagctcactgcagcctagaattcctgtgctccagtgatcctcctgcctcagcctcctgagtagctgaggttacaagtgtgagttactgcacgcaggtaattaaaacaaattttttttttagagtcagggtctcgctctgttgccaaggctgatcttaaactcctggccacaagcagtcctcctacccctgcttctcgagtagctgagattgcaggcctgagccactgcacctggctcctattttgtaaattattcatagcaaatgtgttggtgcctgactgacccatccgttgggaggggtgttatgctggtttagcccatcacattggtcttggcatcagatgttcctttgccagctctcttgtgggcctgctcctccacccaggacaattaccttgcctacctcccagcttcctcatctgtaaggctggcacgttcatactgcctacttcagagggcttctgcgaggattaaagaagatcacttacaaagtgattagaatagcgtcaggcacaaagtaaatgctcattaaatgttaatgattactatgaataatatcagcagtgagctgactcacgtatcttaatgactgtcatctaggagccaaaaatggtattttaaaaagttctgcaaagtccaagtgaacaggtttggagttagtccttgttctgaatgttgtgtgccctaggtgtctctgtgtgctcagaatgtcaaagagggctagcatcagggcagttgtccatgagatgaaccccagcttgcttctccttcctccttgaatgcatctaacaccgaaaaccctgtttcaggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagcttttttaacttcttgcttaaaatgcgttttattttgataagatacttcaaatagcctccaaaagtgtagatccaatcatttaaataaacctgtatgtatatgcatatgtgtacatgcatatcccctcctgctaaaactcatacacatgcgtgcagattattttccaggttgaacctagaggtggggagttgatgggggaaataggtttctgaaaaactgatatactttatcatcaaatcaaagtgtttggggataatacctattcctggagaaagagtgacattttctgtcctgtgtggttagcctccctaggctggcaagggatgctcatatgcgtgacaacaaaggtggggagaacatcacgtgctttagaagcagagccgtcctctgccctattcagactttccccaatagcctttttcgttgtattttaacacttgcactggagatagccgagagaaggaacactgtttcctgttgaaggtctgtgatttacatctgacctggctatttcctcacttatatcgataaactttaactgcttactggggtcacagtgaaaatttcaatcagttcatatatatggaagtgttttatgaacagcaagccacataaatgtgtttttcctggagtctaaaaccagtttcatgagtaacttgtttttcagacactgaggtctggaggtctggggcacagtccatgtaattcaccactcagcacccctagcctgccttttcctgactttggcttaaagcgtggtaagcagtgacagtagaaaatgctttgactttggctattctctctaggccttttcctaacctggtggacattgggatggtgtacgatcctgtgcactcaatatccacttaccaatcaaccactgcagtgccaggaatcaaagggagccgtgcctcccagtccagcagggaactcctgtcccagaagatagagggaacgtttctctatcccctgggttaggaaaaggactttagatagaccttaaaggagaaagattttaccagagccaacgggcaaagggatcagcagtacaaaaatcatagaagaaagatgcaaagcatggacaatgtttggataaggtcggcgatcaggcctggctggcacataggaatggaaatagcagatgatgagccctgtgcacctgtgagccagatggagaagggtttttaatgctgtggtaagagttacaagacttagcctcagatattaggcagaaaagtgatacgatcagaatgatcactggagcctggagaggctggacaagcccagaaaagagatcacagagactggaaccaggacagtagcagaggacttggaggagaggattattttggagataaaatgcacaaggtttgaatgttctggatgtgggttgcacagaaagatcgatcagagtcaaatttcaagccctcgctggggaagggaatgggtggggtttcggacagagagagagattcttggatgacaaatgtcagtggattcactacttaaagttttctaagtaggagccaactctagcaagcttagctaagagacagactgtactagaactttcctagcatatatgagagatccatggaagagttgaattaaccaggaagatgggaagtggggcagctctaagggcccctagcaccaggaatccatgcacctttctctcagagcagtaccattcactactgagtctttatccagttcttgtttctctcacttaaaaacaggagtcttaggcaggtggctgtccctgtgccagtcacctgtgaccaggaagtcaggtcaaatggctgcttggggcctaccttatagatcggtgtccatctccaaagaatggagaatccattttgaattgggcaaacaatcagaaaagatctagcacagtgggcaagatgatgagtttgggtttgcctgggctaggttttaaaagccatctctttgaggaaatgagctaacaattagaactgaggggtccagcagattgggcagccaccaccattgagaggaagaaggacaactgggcagagcagtaaaacatcaagcagatgaccaccaagagtggtgagccagacatggccatattctataggaaaggggaagaagataaggtggataaatcagagaaatgtggggtttcaaagaaagaaccagattcataaggaaaaaagacgaaagaaacaacgttagatgtcctcagaggttcagcagcatttaaggatccaagtctcttggatttggtggtttggatgtgtgtaaccttcttaagtggcaagggcagaaggtagacagagaagtgtagcagagtcagtgggcaattgtggtgggaaggaaggaggtaaaatggttgctccgagaagagccagagtaaaatggagacttgtgttttttagtccgcagggaagtgaactaagtttgtaaacctgaagggtgagatccagccatgaaggaaagatgttgaggagctaatgtaagccacaagccaaatcagagttttgggaccaagagtacaagttgatgagttagcatcgaaggagtgaaaagacactttcatcctgagacaggagagaaataacaaatagacagtggaggagaaacttgaggtccagaggagaggggttgcagtatgtcccctggctgttctgccttctccaccgatgtgtagtgggtgttggagtttcactaaagaagtctccatttcaagaatgcaggttggatgcaacccatttcaatcagtggaaagagaagtggaaactcaagaggtgagaaaatgcttttagtaaggaccatcaacctagagaaaaaatttattattggccatgtataccagttttatacattgtcataataaacatttttcaagcagctttaaaggatattataggaaaaaagtatataattttacagatgtctgtttttaaaaaataagaaagtttaccaatacttacaacaaacaaataaaatgcaattgctatatcaaactgaaaacaaaatcagttttatgttggttatcccagtggattttcactatgtattgttcctacaagaaaatgtccatagtaatgaaataagtgattccacgtgtgactgcccaagggtggttttaaccatttctcagaactgagataaagctctaacaattctgatgcctgagttcagcctataatctcatagctgatcgggcccttggaactcatacccctggggtccaagcaggtaactttgagaagttcaagagaaatgtcaggggaggttggaggacctcccagtgttcacatggtagtggccacaccctggtcttgggtctcatcctcaccttgtcagttctagaaactatattttatctactctttcaaattgaatcaggcttccaaaggctgaatggtaacattggggaatctataaactagaatttctgtgtgatcttttacagtaaagaatgcatatatcttatggctccatcatcgtagacttccttccttcctattttcaggtaaccatggaggctaaaagaggaaatagaaggtttttggtggacaaggaataaattcacagagaaactgctgtccttggaagagataatggcctaaccctgtgcctccaaagaaaatatacacagctccctaaaaagtgcctagcatagtgtgggaattcaatcaggaagagtcggtgagagagtgaacacacttgactaatccccatctctctctgctgcgtgaccctgagttatttgggacccatcttcttgattcaagctgactcatcaggatgtcagtgcagttggtcaggctcaatttgctggtgtgtccagacattcatgagcctgtactttgtcttctgtatttcaaggtcctttttatcctgtagtgctccgggaaccatctgacttctgcaggctgtctctccatcatgttttgatacgtgattgattttgttgcatggggataacttggtttctgagatgacattagcagccccttttctgctgacatcggggggccttctaagcatgtcttgaagtgttcagagcttcctgtctcctgtgacaacacactgatctctcagggaacaatgcccttcactattgagaccagacctttcctttgtgacttttccttatttggattgatggaacccctttttgtagggcctgccccactcaagtcttccctaccccaggctcagcatctcagctcctgaacccctcctccagacatggtttctagaaagttctcccattactacttacctgttaactgcatcctagcttctcagggttccaaaatatgatgttcagatggcaggactgctccagctggcacagattagtgtgaaaatgtcccttcctgtactagggcttgatgtcctaggaaaatggtacaggatttttaaaaatactcacttcttacttttttgcttctcatgaccaagcaaccactaaatacttagttttaaaaatttgtattaccaataccttctctgtattcagcaatatttttgacttaatggtagaactttacatatatccctgttatgtatattttttcccatacaccagttaggttaagggacatctttagcttttaaaaaagtacagttcgaaatataaagtaaaagcagttaagtcttttccaagtacaaagtgaattggttccaattgctagagaatttacaaatatatattcacctgaggccagaaaaagctcctttggcctaggcctctctcctttatcaagctctctccatcacgagtgtgcacatgtgcgcgcgcgcacacacacacacacacacacacagaacttaacagcagtgatgtgtgttgtaatatgcaactttgtaagttacatatcactccccaataccaccttctcagtcacggagtagagatcttacttcacaagaagtgagactcagagaggtgaagtgacctgtgcaaggtcacctattacagtgccagagttggaactaaaggaacttcagtctgtgaacttcagtgtctttccagtagcatatttgcagcagaagagtcaagaatgttgtgagctgcaactctcactagaaccaaatgaccttattgggagatgttagtccagccttaaaaacaagctcttcacctccatgaatggcaagtgtctgccctcttcaggccaaatcgagaatgacatctataactgagcaaatcctcagaacccaagtcagaccttggattattgcttttcagtaagttctggtcctggctgtgtctctaactcttgctgtgggaccctcagggaagctacccacccccttcaccccacctgaatgagatgatttctgaagtcctcagcagccctgattctaagcctcataaggaagagtaggtgttaatggcatcctagggcaatggtaggcgcctgatgcagatctgctgtgagccatgtgctggcatcacaggggtggtttattaatttcatttatcatctggacagccccttcttataacgtacatccttgcctcttctgaggctctaagatccccaaggtggctcctgtatccagaaaccccttggccttccctcccagttaagcaagatctctcttcaactcagggatgctgagagattgaaagtgaactacacacaggaacagccaagataggagttatttctatagcaccatgcttggctgatgttctttacacggagtgggcaggatttttaaaacagcgtttgtgccttttagcctgggctcctcctaaaagcagactctgggacaaggatttgtgtgcaagtagctggcttgaaaggtgattccaggaagcactgaggtggcatggagaagcaaggctgagaagaagggaatgcaaagaacagccaccaaggtgcacggccagggcctctgtcaagctgtgaggaacatgctgcagagttgtcccctggggctgaggaagctgtgagagagagccactccactcccatcctttgtaggtagagggccaccgccaggctcttagctacttggaactagggccagcttgaggaatatgggtgaggcacccatggcctctgctacattgtttttaatccagtctcaaaaacaaaatggtcctatcacagaaactctgcaaaaatacatgaaagagtaaagaaaaacatgtaaacattttacaattactctatccaaagataaatactgttaaaatgtcagtatgttcttacacaagtttttccatgcatatatgtgtagatttatatacattaagattgtattatacatagaaaataaatttctggacagttatataacctgcccttttcaaaatatatctaggaaatctttctatgttattgtgttgtcttctataacatgattttcatgactttactattatagtctctaaaaaggatggttcataatttttactggacatttcagtggtttgcaaagtttgactattacaatatatgttgaaatgagcatccttggatataaatcttttttgtacatcactgattgttgccttagtatcaattcctaagaactactgggttaaagatcaattattcattcaataagcatatgttgaacatctaatattgggccaggtgctttttttttttttttttttttttttttgagacagagtcttgctcgtcacccaggctggaatgcagtggcgtgatctcggctcactacaatctccacctcctgggttcaaagtgattctcctgccttagcctcctgagtagcctgggattacaggcatctgccaccacgcccagctaattttttgtatttttagtagagatggggtttcaccatgttggccaggctggtctcgaactcctgaccttgtgatttgcccgtcttggcttcccaaagtgttgggattacaggcgtgagccaccacaaccagccgggccaggtgctattgtaagcatttggggcagatcagtaaacaatatccctatcattgtgaagtatattggtgtggtaaaggaaggcgggagggaggaggcaatagatagtaaggtgatagcgatgaaggctacacagaaaagcatttatcatggacacctgtaagcatacagagccctccagaactgtgccaacagcagaatgagagaggctgtggcccgcatcctcactgacactacgtagttttgaaatttgcaacttcaagatgcagaaattgaattttgcatttacttcattaccagtaacactgagcatgtttcatgttcctatgacttgatatttttaggttgtcagttcagattctttatccattttcttgagagtctgatttagtatatttatcttttgtctgttacacgggtagctcaacttttctccatttgtcactagcttttattttgatttggatgtttaccaggatatagagcttttttctatgtagtcaacctgtacattttttcttttatagtttctagttttgctttcatgcttaaagaaatatcccctaagataataggtcacccacattttttctagttttaaaaattctgttttttttttctcatcaattcatatagaatttgtttcccagctggaagaccaattaaatattttttccagacagttatcctagcatgattttttggatcataattgggaaggacaggatctagcaagctggggagatcatgtcattgggttacccccggagcagtggtgaggcttgggtgtcagagccatcccatccacaagtggtgccagaaggcaccaacaagacccagaagctccccgggaactcacctccgactgccagtgagggtcctgtctgtgacaaagaaatgtgccatcgggggaagataagcgtccactgcagcacagaggaaacacgagagctgcaggcacgggctcagtgagccgaggaagtcagtggcagtggccgcctggccagggtccctggagctcccaggaagctgccctccaaagcagtctgctcctctgtgccacagtgcagaggaaaggtgtctggggccagaagctgatggccgtattgactggatgacaaacagggaccacacgagcctcctgttggcaaaagagaacatgtgtgatgaggctgtataatggacagcagaaggccttggctagggctctaacgttacccctaattgctgtgtgttcttggccaagctatagtacctctctgggtctagttatcaaattacatgttgtttaaaaaattatactaggtttagcagcattcattggttgggaagaatactgtataaggatccactctagatgtcatggtttgcagtacaagctgcaattgtacagataaagtttgggagtgtgtacagtatactagcttgatgcagaggagtgagtgtgggggcagggggaaatatgattagagaaaacggagaaaggaggaaaagcagggatagagggagggagggaggaaggaaattgaaagtaagttgagaagaaatggaaccaagattttttgtgagttgaatgcctgacaatcattctaacctgcacaaaggtgagtgggaggggtcggggccagtcgtacaggttcatggcaaccttttatttccctaactggctcaggagggacagttctgttagccttcaaaattaaaaccacccttgtccacaattaatcagtccacagctatttgctgccctctgctggccaagataaacaatggctgcattgcaaaagagtttttatcttgaaagaaatagattcattcacccaacaactgtttatagagcccctattaagtaccaggcactgttctaacacagaccaataaccaacatagacaaagactcctgccttcatgaggcttaacaacaattaaaatatctagcatgtagaatccctgctatggatgtgccaggtaggattttaatcacttgatatttatcaacttctttaatccttaaatgaatcctatgaggtaggcacaattgttggcacagagagcttgggtgatttccctaaggtcacacagctaggaagtaacagcctggttcaactcagccaatttagctcctgctgcgcctgtcaccaatgagttctgatagatgcattgcccttcctgcccaaaattttgtatagacggagccattattagatggaaaagcaaaaacactgatcttctggctcagccactgtgtgaccgtgagcctggccttaccccgtgtggttgtcagaggagtcatccataagaagtgtatgcttacacgggccctgctgattgttgtccctgtcctcttcctccctccctgatgctggccctgggtacaggagggtcaaggaagccaaaggcggcctgaatctccgagctgctgctcctggtccctattgtaaggtcctgtgaaccctgcttctccagctcagcattaatggggagggagcaacctggaagttaatgaagaaatgagggacttccctgttagggtgagtgctctgggacaaagggacaacctacagcaagaggaattcaggacagctgcaggggagagctggaagctcccgaccaggaggtgcagagcttgccagcctccagggtgagacatacaaaaatgccaacgactgctgccaggagggagagggtggaagactagtggaatagagcagcaagggggtccttggaattgcttagaagcccttgattgctatttgttaatttaaaacaaaaaaaaattatgcctaacctcatacaaaaattttaactttataagaagagaaaaacatattttaaagtctcatttgaaaatgccttcagaaatttgttgatgtttttaaaaagcaaattttaaaaagtattcccccctcataacaaatgtccaagcaacaacaagagtaatagcggctctttacaaagcactgataatgtgctggcacctcacagtagtcccatgatataggtactttcatttataccaattaccaatgagcatgctggagctcagagaggttgagtgacttgccctgtgtcacacagccagcactcaaggctgtgcccgactgacttcattatcaccaccctatactttgtctcaaagggagggaatgttaaactgaatgaattggctctaggccccagggactgcctcgtgaagaatggcgaattcctagtgtcatcccaagaagcaggggcaatttatccttgggtttgtctgaccacacagcagaggttccagcttcattactggggttctaggcatgtgtgttggtgcaatctggaagcaacagatcttcttcgtgtccctgagagggagagggttaagccacctcttgcatgatctggatttgccagcctggagcagccataaccctaaggagccccagagggacctcctgaaaagcagtcattgagttgaaacccaaggtgcaacccatgaccgggtgtggtggggggtgtatcattattttcaaagactgagacccagggaaaggcctgtcacaggccacacagtggctgcagaccagcattatgagaagatcccaggccttataatccaagcttagtcctacctgcagtccagcactgtgctgagccttctacgactgccccagagcaaaccaggtgtcccctcccaggcctaccactgaggtcactccagcctatacctgcccaattagggctgcttcacacctaagtggcacccccagagggggttctctgttcttgctttaccctattccagaaggaataagcccatagtatgataactggcagttttgctaaggcacaaatatgaatcttgcccacttctgggacggggctctgagcaagtctctcagccttcaggggctggctcgagggataaaggggaccagtggtcactccatcatctggccagtttagtctgcaccagtcagatgcctgtcacctaggtctcagaagtcacatttagcatgaaacggattaaaacgaggagccagctctgtgcctcaatttcttcatctgcagaaatgaggattataccacttagcattgctgttgggaacatatgaattaggacagtgcttggcatatagtaagttttaaaaaggtatctatcattgtctttgccatcatcatcatcattatagattcttgacacctgtggaatatatatagcccatgaaatgacaaataaggaatgcttatattggctcctaaatttctccaaatgacatatttcagctatagaatccagtgttttctgtatatatcctccttatgccacaagttaaccagtagctggcagtctccgagtccctctatctttccagccttctgatcctcaccctatcccaagctgagaccttggcccagagcctcagcctggcagtaggcatgattcagatttgttcctcagcaaaactgccagttatcaccccatgggctcactccatctgcagtcattgaagccaagaaagttgaatccgggaatgccagaaggtccactactggtttctcaaggtgtgtttcacaggatgctggttctgttgagtgattacagtcggtgatttgttgttgagccatcaaatacagttgagtagcattggatttttaagcatgtttctttctgaggagatctcagtcttgaacacgccacctttctaaatctgaggcatgggatgtactctttctcaaatgcacattatcgttctgctccctttcactgtaggacagcttgtgggatttgctgtcctgtagcaaggcttttcaagcctttccctgcggacagttcacctgggagcatattgtaaagtgcagtttcttactcagaagggcttgggaagggcctgagacgatgcatttctaacatgctccctggaggtgctgatgcagctgctccacacaccagacttgaacagtgaggcttgcggcaatatttctaagagatgtgtctgccacgtcccctacccaagggggtcccatgccatcccttttacagccctaacacctgccaaagtgcttggatcatatgaaaaacagacttggccaggagctgaagtggaggctcataagggcagaatttctgtctgttttgttctcaggtatatttccagaaactagaactgtgcctggaacacagagtggctcagtaattacctggggaatgagtagattactagggtcattcagcaaagagatgcccttttccaggaattttctggcattcactgttctgagtggtggtagatttgagtccagggcttctgcaaactcaccaaaggtcctttgcatccaaagcatctctttctcaaactcataaatctgactcaacaacctatctataaggcctccacctataaggatacggatatttttacggacatgcgaggttggatgactcaggatatgagtaagcccagagcttcagccaatatggtctcagagtgacagatggagagagaaggcttcctgtggtgggactaaggagcatgggcctcaggctgaccagcgtccccagaatgaagggctttctttaagatggggccaaggcgttccaagccaagttcgtgggcagctaactaaatgaggttcatggatttggcctcaaccttgttctgacgctctcactgccaacctaggcagggagccaaattccttgctctttaacagtttgtctgtttgttttggtccaagaggccaggaagagaagatatttgtttccatggtaattgcttggaatgattcttaagtagaggagcctgaagggcaagtcttctcattaggtttccaccttcaaggaacttaaaatcttcttaacaatcaaggttcccaatacatgaaccgtgcagtcggtgaccaatgggaggtacaaggacacttttcagtaactcctgattgggggcaattgagagggcttcccagaagactgaaaatgagccgagccttgaaagagttggataaaaggtgagggtaagggaagagtatgagagtgtggagatgcaacttcacaagcattatttgggtggcaatgactaaagtagcctgtttagcagagagtctggggtgcagtgagtagaaaagcaacttggaaccggagtgtacacagcattgaatgtcaggccgtggaggctggacacctgggcccattctttagaactagagcgtgagaagtaggtgggacccacacattttgcttttgggttcaggcaaccatggggagacagcctcctgaatgaagccaagaggagactgctgaattggtagagaatgagagggtccagccagtaggtactgttgtacagctagtgcactgcataagagcacctggccaggagagcaagtaaggacagaaatacagttgtcactcctctcatcaatctatgcaccctagcatgggctgccttctcccagagggacttcttctctgtccacaaagacatctgcacaggctggcgctgacccagttggctcaagccacagccagcgaatgttttctccttgtggccaaggcattttcttagagcaatgaatactgtacattcccagagtgtcccaaggagggcactgcttagctttgaacagaacgataaagcactgcatgcacggttctgagaatgcagttagtaccagagcaagccagttttctgctcctgctggctgtcagaacaagggagcaaatggttggtaatagtacacttcaattgaattcaactaaatcttcttctggcaaggaggggcagccccccaagcaggacatacaccagaacagagcatctcatctgcagccctaaagatcctaaagtttggacagcagccatctgacctgtgggtttgggtggagacctgcatgcttcataaagtatccaaatgtttcccgacccaccagcaaacatcatgtatgtgtagagagatgtaaagggctcgttcaaaggactgttatagagaggatgtttctcaataggggcacactggcatttagggtgcaactgtctcacacattggaggatatttagccagcagggtcccccagtccttgtgacaaccaaaaaaatccctcctccgtgtttaaatgctgcattggaaaggttgaatccaaatgagaaccgagcagcccttctctctacagaaaagacagcaggcccggtgatttggccaagaccacaaggctggggaagaaaaaacaagaattagtacccaggttgcccactccttaccacttgtcaccagcttctcccaccagtgtggtccttctttctcccagccttagttattctctaggtttctgcattgaaaccacagaacatgctagaaccaagtgatgtagttcatctatggtccccaaaggcttatataaagctgtcttagctcaggctactataacaaaaatactatagatggagtggcttaaacaacagacatttacttcctactattcaggaggctggaagtcttaagaccacggtcaagattaatctagatatgaattccttatgttttcatttatggtatctttgatgatttgtgtagttgatttaccaatgttttcttttttaatgggtacttgtgtctttcaaaaaaattctttaaataaatttcaagattataaaaatattctaaatttcttcaaaaagttttaagactttgccttccatatttaagattctgttccatcaaaaattaatttttgtatgtaagagaataaggagcctctttaatttttttcctatatggataactaatgctctcagcaccatttattgaataagccactcatgatctacaacacaatatcctttatcgagcaaatatatatatatatacacacatatatatacaaacatatatatacatacacatacacacacatatatatatggagagagagagagagagagagagagagagagagacagagatttttgggggcttcttagtctgttccactggctaatttgattatccttacctcaaaaccatactgttttaattactttagctttttaataaggcttgcaatctagaaaagcacattccttcatcctgtttgtcctcagaatgtcttggctcttcttggacatttggttttttatttaatgcaataataatatgtcactgaaattattgagacttttattttctttgcagaaaaattttagactaccattttaatttatttaatgattataaggctatttaggttttccatttcttcaattggtttcacaagttatatttttctgggcattttaaattgtttccaatgtatagacataaagtagtgtagattattcttgctatctcttttggcacttaaaatattttttcaacttaattttaaattaaattttttaaaaatctttttaaaatttaattttgcctatctgtagatatattcctttgttcatacatatttataccttcacttttctcaatcttactaaagattaatctaatagtctttttaaagaatttttgatttggtagttcttctattttatctttaattcctactaatttatgcctcttactgtattttttttttttttttttttttttttttactttttgtgttgtgttccagtgcaaattcagttgattcaatgatttccccaccatcagtttaggatttggttttcttagctctggtaacattgttatcaattcttcatttatattccattttccagaagtttgttgctggtatctcatctcatattttgcccattcttgtgggtttatatgattgtttaaaatccctttgctgtagttttaataagtttggagaaggtagtaaaatgagctgtatgtgttcaatatattatctttacttggaacctataatgattattgatccttctttcttatttataatctttttttcctgtgctatattctgtttaatttcttcaactctattttccacttcactaattctttcctctgctgttttaataacatttttcatttctaaaagttatgtttaagtctttttcaaatctaccatttcactttttatagtctagcattgcatgcctatttctgtgacttcatattttttgaatgaattttgtaattattatacatttcaaatattctcattccaacatttaaagttcttagaagtagaagtctggcatacctcatctcttctacctcttgcttatagtggtttgctttcttgtgtgtttgattatatttcattgatcatattttattgagtgctcatatattgttgcttaatccacggaaatctaaggacccaaattgaggaagcttttctccagagagatttgtttttgttgagagccagagggttacccacctatagaaactttagcccactgctgggaccctaggcttaatctctctatcttgttagctggcttttgattgcagttttaacatcagcatttgccagcagggcaaccctgcctttcacctatgcttagcacttattgctgtgtgttcaggtctttgttgggggtgaaggtggtagtgcataagtggtacataacttcttgcaagcccaggaataaaattaaaagtatactttgtcaggttgtctttattttatagcactaagcatttcataatatttcattccttatagtaccagaagtgctctttaatactttcatattgaattctactaacacgggcccctccaggcattaccatttctttccctcatatatatattttttggcctttctctgggtccgtggtatctttagtgtgccaattttccccataagaaaagctctcaattttttaatgttctttgacttctgttttactttccccagataataaacttatagccttgagctgtacattatggtcaccattagctccatgtggctattaaattaaaattaattaaaactaagtagaattaaaaattcaattatcagtgaaaaaaaatctcaaaagaatcaaggtgattcagttcagtatttgatgaattcctttaaggccagtgaactactctttgagctcattgcccacctcagtccaatcacccacagtggagtgggaagggggcatctggtgtagaccatagcacactatgggctgggtggctggagtgggtacactgccttagaggtgggagggacacagtggtaggcatttttaatatcctccatgacttcatttggattttaggacaatccttgacataaacattattcctgcttttggtctcttttaagagatgaagaaactgaaaatctgagaaatgaaatgagttacccaaagctacacagataccaagtagaaaagacaggattccttttccaataagctgggattattcaaatttcaaatgatttgggaccaggcatccagagttccagtcttccctgtcctaacatataggatgatgcttcacaagccgattcctgccccacccacagcacagagctattgtcagaacagtgagagaatggatgggaaagagctctggaatgcacgaatattgtatacatataaagattgtggtccccattttaaagactaataaaagacctattgattcaagactgtgagcaggctatcatgagctttttggcctcgggattgtccctagctggtgattcatctcccggggagctgggtctggaaggctctagaactggcctcctgccacactggggagtgtgcttctcttctgcattgtatccacctcagagcctggggtgtgtcccgcagacccgggtctgaatctctgtgctgccgcttctaccgttgtgcccatgatggggtagattatccacatgtctcatttcccttctgtgtaacatgtgggtaataaaaaaatagcccctgccttacaggtttgccatgaggatcaaatgcaataaagcacgtaaaacgcaggaaagtgcctggcatatgagagattcacagtaaatggaagatcatgtttttttcccccttctctctcagagtgaggtacagttgaaaggtactttcacatgtatttcttcagttaatctcctgtgctatcctgccaggtaagtattgttattctcatattgcagatgaggatactgaggcaaagaggttgagctgaatggcttaaggtcacatggctagtaagtggcagagttgggacttgaagcaatgtcttctcattgcagaacctaaactcttgtcactctatctatcctcctaccttccagctgttaaacatccttttgctctctgacaataaaaaaccgttcaaagataaattgccacattgtgttaatagcaaaaaaaaaaaatctagctattcaacaatggaggatagttcaacaatggtacagacataaaatacagtatgaggcagcaactaaaaattatatacaaaaggatctatttaagtcaatgaagattcacaatatagtaattaaaaagagctgactaaaaatatagtatgcataattttgtcttattttcataaataaatggaaagacacattaatcgataccaacatattaattacttaaatagtaggaatgaggattattttgatcattttctttatgctaatctgtattttctaactttaagagcttttaaatttaaaagcagaaaacattggaatatacacgttcaaatgcataccgacttagttggtttcagtaaggtatacatttagttcttttaagggaatttcctcttgacagtgtccaaagcacattgttttataatggggtccatatttgctctgaggaactgatctcgtgttgcaggacattaagcatctcttgtcctggacactgcataccagtagcctctatactcacccacccacctacccacacatacacacacacacacacacacacacacacacacacagtgacaaacacatgcacacgcgtttccaggtgccccttgggtggggaagtgggaagcagtctgtctatgcatgagaagcactgagctgcctacactgaaatgtctgccaccattgaacagtgagcagcaggtacctaggtttgcaagggacacgtttctggaatggaattttgattgttttgcctccaataaccgtatactttcccagctgttgctctgtggggctcccagacctgaaggacactggtctggtgtcccagagatgctgtctttatcctccaaacttcccttaggaacactcaagctgcagaggtcacacacactgggaaattctgaggacatcatcacccaggcccactgagggctcccttaggcccccctcgaagtaccctctgcccacccagcctcggcatctcctcaagagcactcactgctaactcccctcctggccattgagtccggctgccttgcactatcatttatttctttatgaatggctcgaagtgccttttaataaaccactccagagtatatatattatggatgtatctacatcttaaatatagagcattgctatgggagttactgttagttgtttttggctgtgattcttcctagtcctaactccccaccaagaaattctgaaatttcagagcgaggtacttgatttttcatattaacactttgattgcagtgaccaatgtttagttttaggtcatcattctgaaggaaaaaagagaagtgattatgtatcaccatcttttcttttctctcatccctcagacccttacaccaatcccatatccttttctttttggagcccggggcattcctttttcctcttttctcctgacatgtctctgtccactcatctggtgttaggtgtacggtactgacatgttttccctggatgcagccccagaacccagtcctgtctttccaccccttatttctagcagttcaggcaggttctggctcccttaatgtgaggccaaaatcactaacacccctcaccttccaagaaatacatcttttgtgtgtttcccatttatacgtggtaggtagtttcttagtaaaccttgagcagagttcagagagaaaatcaagatgcctttttcatttgggttttggacttcctggaaagccaaggaccttgtaacagtgatttctgcctttgtttcatagtttggaattttcaaagttgctactcaaaaccatttctttctttctggattctttttctacaatgaggtggcaccttggttatggctttgtggcatataaaactagactttccattaagagtgactgaactgaatgagaatttagcaaattgtgtctatttttataaatccctgttttaaaacaattaagtagcataaaaaccagtagtactaaacaatgcaaaagggttatgcaaagtataagcactcaggttagatgtctttttccaaaatcttgcattgttacctctcacaagggcagtatactcttaggtaaactacttatgctgcttcaacagatcaaagaaagcaaaactccctggctcctggctttcctccaacttttctgtcaatgaattggaaaagagaatagacattaataaagggtagatcagacatctaaccttattaaacatgctggtctggataaattagagctgaagagaatgggaccacatagatacatcaactatgcacaggcagtgactgcctaagacttcacagatcaggataggtaacaaagaaccagagacaggagggtgcaatccctgcaatcctaaattttattttactgagacaggtgtcttgcttttttgcccaggttgtagtgcagaggcacgatcatggctacctgcatccttggcctcccaggttcaagccatcctcccacctcagcttcctgagtagctggggctacaggcatgcaccaccacacctggctacttttttaaaaattatttttagtagagatgaggtctccctatgtttccctggctggtcttgatcaaactcctgggctcaagagatccttctgcctcagcatcccaaagtgctgggattataggtgcaagccatcgcaccaggctgcaatcctgaattttaaaatacagaaggtgaactcacaaacttgacagcaaaagcaggcaaggagctaggagggaccctggacacccatagtcccaatagagctgggcttaggagggatcatatgatattgcacctacaaaggagaaataccctccaagttttcactgattgtagagctcaacatgagtcagcagtgggatgcagctgctcagagcaaatgtgatattcagctgcattaatggaactattatgtttccaaaagagagcacaatgacctccctggactttgcataactagctaagtctagaatactgagtcatctccaccgataatggtagtgatgattctcagaaccattttgtataaagaagagtttcgtgtgacttttctcctgggaaacagggtctgcacttagattttgcttttttttttaaatcacaaacattgcagggccccgagagacagaagctgtgcattttattcttaatcaaacactacatcaaggaatgtttagttttctccctactgcttctgtcctgtgcctcaaggtgggactcttcaacggtctggatagttctgggcccttgagccagtgtggcttgctgggtgtgggccctgtgacagaggtagggcatgtcttatgaagaaacctctgtgagctccgccagacagccaagtcaaggaggaaaattgtcccctgcccccagcaccccatgtttcagttcaatttaaggcagatcttctaacaatcagggctgtttaaacacaaaatgagctgctctgggaaggagcaagttctccatttttggcagtgcccaagcagcatgtgggtgacccactgaatactgctgtggattaaggaaaggcttggcggggatgatgctgggcacgcctccaaacccgactctgtgctcctatgcttagaccaccctggcctcttctgataagacttcccaaataccttgcttctcctcatttggagttagtatccccctacaaactacaattataggattctgaatccattttaaaataaaatggagtatttatcctcttatctctctccatcaccaccagtacagcctccaatcactcagctctgaccacttgaatccataagaagagaagaactgcataattttgtctttctagctttcctggtccattagaagggcaccgcagtgctccctctttaatccctttagctttttggcaaagcagcaggaaaaaacaccttatgaggaatgtgaacagatcacaaggggagccaacctgtgattgttcttcttcactcacctgcttcccagtcagttcagtccaaatccttttgaagcaagcacatgaattgttgctactttagggcaattacaggatttacagattaaacatatccccactggtttccctagcaaccgtctttgaatcacaggatgagataaaactattgttctagttaatagagtctgatgttaagagaagtccagccatgtaattcacagaggtatgcaccctggtgggagcagaaagagcgctaggcagggaggcagcagacctacgtgcaggttccggtccactggggtcagatacagaacaggaacatatctcaagacactggtgacagtgcccccggcaaaaaaaagggttcagagcactgccaggggaagaaagatgcaggtgtttctaaatgagtgaaaacattaggcacaaaacaatcgaaggcaaggggtctacttggacaaagccaagacacagtgaggtcaggtgcagggcccactcctccagctgccagaccaggcaatcaagccaccttgggcaatgcacattattatgtggccagacctgggtggggtctgggaaggtcagctggcaagaggggcatatgatttttggctttttacctgtataataagatgcttgggttacatttcaaggcccgttccaactcttctgggtagtagagcttctctgattctgaaccaattgagaaatagtcatatttcagcaaatacagatgaatataggacctttattggttgttgagtaggagcccttaaagtggacctgcaatcagatgaccttcaaaatgatacaaccccagctgggtctggacctgcacatgaggagaattgagtctgtggtgcagaaacatggaggtcagatgcatgcctcaaatcaatgaattctggagagcaagaagagagacatcaacctccagatcccaggctacgattcaacggttctccccataggaaagcagaagcaatgaaaaaattgtctcacagtcagcctaaacaagagagcccgctgtttaggacccttctccaacctccctaagaagagaagtcattctttcccttgggaagaagtaaaaagaggaaggggcaggaaataacttcccaatcccccagaggacagaaagtcctgttacaggctgggaagaatgcaggaggagaaatgtttcctctaacacagggaggagggtgttgaatggaataccaaaggcatatagctggcccatggtagacactccttacttgcccttgcttcccaggaaacacaagtctaaccaccttcacctgtgtgtgcagagtctgcagctcccagcagctataacgaaggtatttactgccacctacacacatagttcaaagtcccttggaaaatgaaaatcaacagtaagatatttgatttctctcccgtaacagctaagtagaatgaatatatgaagttattgaaattttaagagcgtattttttgtttcccagtatttctcgctgtaactatgaagttttatcattttccttgttaaaggaagagaaagtgtgtttataagcgtgtattttgcaaagccccttgcagccagtcttcctgaactttcaccattgggagactcacccccaattcatgaagtttctagatttcttgtgcaatatctcagagttcctcatttagtaagcagcatcttaataataccaagccctgtcttatattatattctggacagtgaacgtagacatatttgtttaagggtcagagagagaagacagcactctcaggaacacactagagtgagtggttgaattggattcagccctgcaacccttctgtctttgtgacgcttcatgtgatcctatcgggactgagcttcaggttctttctttccagacattcccgttcccctctacaaggtaactaagttcatggagtaagaggacacgaataaagcctttctggggcggcctcctttcttcaaagagcaaaggaaaactatttctcttctgataggttgctgatgcctataataataataataataatagcaaatatgatgaacatttattggcccctctctgccaggcatggtgctaggtgctttgtattatttcatttcttcttcacaacaacccatgaggtgttgattattatcatccccatgttactgttaactgaagaatcacaaggttcagaaacttggagaggagagctttacttctaacaaaaggttacagcctgcaggtggccatcctgataggctgggaagcatagcctccagcagacaccaaaagcaggcacttcaagggagagaggggtaaagcaggaatttatgctgaacggtttggccacgtttatgtttacatattcagcaggttacagggggcaataaatatttaggaagtgggggatgctcgcatacatagtaaagcaaacatgcatgttgcatgtgtcccatgttcatggtgggctggagacttatcagtgcttgtttaactgctagagtgaaagaaaaaaccttgaggcagttacaatatagtttattccttaagaggaagggtgtgtgacttcattcttacctggcatgaccttgggtcctgtttataatatggtatcttattgccacaaagagtccattccgacagccttatgatctctgttttgacattacagaagagaaaaatgaggcttggagactctcaagtaactttgtgtgcagtctcacaactggaaagtggtgagacttttgccagtttagacaattcaattttaatttctaaatttaaaacctttgcctcccacctacccattcgccctcttcctcaaagttgaagatttactatatttaaaggaactctactatgtgtttgcatattccttgagggtttgagtttaggggtcattcacacctgatttattctttgctctctgtcctttaggaagaaatgagagtttggggtgttatagaacagttgggagaaggtagaattttggaacctgtggacactctgggaaggagagacaataggctgcttctctgcacccctccacaggccagctccaggccgagatattggcaagagcagcagaaaagaaccaggggaccaggatcctcaactaacttgtggatcctcaactaatatgtgagcttggcccctagactttcagtgtctggctgcagtttcctgcactgtaacacaaacagattagaattgatgaatgtcaagtttcctctgagttttcaatctaggtaattcaattccacatctattagtgagaaaaactgctggtaaaaactgttttctctgagaactttttctgcttatttggcaaatgtttatatagtgcttacaagtaactactgtatactctcctaagaactttatgtgcaccaatttatctaatcctcacaatagacttgtgtggtattgtaggtagtgatattatcctgttataggtaacaagacagaagcatgtggtgatttgctcaaggtcctacagtttgtaaaagtgaagccaagttgaatgtatgcagtctgggtccagaatccatgtccttaccttgatattatagtcagtcctctgtatccgcaggttccgcacccaaccatggattggaaatattctaaaaaattaaaaataacaataaaaatgacacaaatgaaaaaatatagtataacaactatttccatagcctttatattgtattaggtattataggtaatctaaagattatttaaagtatatgggaggaggggcataggttgcatgcaaatggtcccttatgccattttacataagggacttgagtatctgcagagtttggcatccacaaaggtcctacagccaatctcctacaggtacggaaggatgactagagcttgtttttaatcttatcaacatagaattgtgtgtctgatcaagtattcctctttaaattgacaacccagttacttctcaactttattgagtatacaagccctgggagtgtgcgttttagatactaggctcagctttcagctttattctgcctgcctgtttttctttcattcttcaccctaccagatctttttcctgtctctgagtatatctctttgcagttcaccaaaacatcctttttggaagatgataagacatataaaaaaaaataaaaataaatttaaagatgattcaatgacacaagctgggaatcctcctaagtggcttgctgtatcccccagtgcctgtgctgggctttcacaggatttgggagagaaagtggggatgaggggggcagttctatcttaagatgaactagatacacgttctcaacaaggatggcagtgctgctcgggaggtgttggaaaatttgttgaatgtggaggaactgattgtcacaataattgagggaggaggtgctattgagatttagtgggcaagggagaaatctgcaaatgtcccacaatgaaggacacagtcctaaacaaatttcaaacactccactagaaatttatgtaggtaaaaatttttatagttacctgagccttggtcctaaactccatgttacatatttttttaaaaggatattttgcatggttttaaaatatactgaattttccaggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattgtctt

SEQ ID NO: 38738 - DNA, 154230 bp, Homo sapiens
actcggtgcagaccgaaccatcgcggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccaggtaagactgggccgtgggggccgggagagagactgctgggcgggggttgggattcgggttcagtggtcgcgccgcgccccgactgcggacaatgcgggagctgcgcgcggccaggcggcgcggagctaagccggctctgcgcctgcagcttccccgcccggcccgggtctccgttgagcccggcctcactggcccaggcggaccccgtccggctttctgggctgccgggggaggcgcagcgccgctgcctgccccgcgccccctctgcgctcggcttggctgcacgtcccgggctcggctaggaggctgggcacggggccggggctggagccggggttggagccagggcggggggaagctggccgcgctgcggagcggaggtgggctccgaaagcgcgccgccggttgctgctggaggagtgggactacgaaggatggggactccgctcggccaccgctcctgaatggtctctaatctcggtgttaaatactttatgagagtatcaataccacctaatcctttgctgagaattactgctagaaatgtagattctgaggttccgaaagtttgtttttggttaccccctccagctcctcccgtggcctcaattgtctctattttctttgaaagcatacagatttgaaatagaattaaattctccttggctcactcgtgtctccatcacccagcggagctcataacttggcaacaaagcccatacaggctgtgggaagccgcgatgcctgctgcccagcctggtgccctcctattgtttagagctggagctgtacagtgtaaatggcagtgacaggtctcccttaagctggctcgtggggaaggaagggagataactttgcagtgtgcttaaattactctggaaagtggaaagaaaacacctggtgctcagctttttaaccctttcaagttgttattcagatttattgacacacacacacagaaaagtgcaggctttctttcctgcctaaaaaataggcaacctctgtgttcttcctcacagccaacttatgtcctctgcaaaatctggcacacatctgtgacaacattgcacttctggcgtaactggtctatttctcaaaagggaatatgatagtagaataagcatttttgcagtatggatagtaggacttccattttcttcgtttcctttgttggtgaagaaggtatttattattttccccccagtttacacgtagtgatttctgggaagatacttgtattaatttcttgtactcatttttgtgacatcacaacccctggtcattcaggtaagctatttattaagcatagttattctagaataaaggtgagttaatggtaaactagaatccttcactgataacatcccattggtttaccctacggtatttaatctgtagtattactatagattgtacatgtaaagtcactaattgaacagagaggtggttggtgccttgttagcctgacataaagtgcttagaacagtgccttgcatatagttctaggtgtcagctaatattacttttaatttttcttatcaagctatgtgttattttctgtttggaaaatggtcgttttgatttttaaaattctgatctgttaggtcatgatctattttaagtctgtggttttaattttagatcagggctgaggttgggttgttattatgcctatgactgacaggcttctctgcgtatccttatgcatggtgagggttgatttaattcatcttatatattggatctctaagggcaagacatcagtcttgaacccagtcatgccctggtgcctttcataaggagacctggttgtctttaagagcctaattgtttaaagagaggcctccacattagggaagacctgggctctgaaccccattccttacctcccctgcactcccttgttctctaggtttagaatcccacttccaattcccaatggaaagaaccgttggtacagcagagttaagtaactctcacagtgttaaaagatgataaaagataaatatgtctactgtatatacaacaaccagagcatttaattctttttcatgctttaaaatattttagagcaggatttatagcctaactagctaagataagaaaactcacttatttaaaactacttatttgccatgtgttagtaaccaaagattgtgtttcctatttagatattttaaatgattgtcaggagtttactcttatttcatgttctcctttcccctttaactttgaagtgactttttaaaaaatcgtgattcctaaataacttagctaagcgaaggcatggtattaactcttagggccctgcagaagcaaaactgctgtaggcacagtggcttggcagtagatggtgctgtggacaaggctggtggaggaggcatatgtatggtctagtagaatcccagggattaatttagcaatcccattgtttgctgccccccaaaacatactcttaccaaccagacactgtccaacaatctttttgggaatacagtttgtttttaaatttgtactttatatgttcaacatttgtagactattggccatttttctgtctgaaagccatcgcattttaggtgctagacaaacattgcttgtaaaaatattattatgaaactgttcactttattttattttcccattgtagagtcagattgatcagctgagcctagagatctccaactaatctgaactttttttcatacttaactttttaggagagagaaacaaatgatcagaaacctacttgcatcttgaatttatttaagaaaacaacttcctagggccaattctcatttactttgatttgcatcattcttctggctcctggtatgatgcagtgagaattgatattcaggatgaagactgaagtgttgcaaagtcatgactcatccaagaaaaatacattcattctattcagtacagacaccaaggctagaaatctagtacactcagaaaaaggattttctggttcataataacagttatctctaagggctggctctgggaccagcaaaatcctcgatggttgatggtgggtgtggtgtctcctctaagagagagtaggtgctgttatcccctttctataatacaagtgaagggaagtgacttatctgagtcacatagctaatatgtagcaaggtgtgtgtgtctccagaccccatgaatctttctgtcatgccaggaggaataacttctgccttgtacattcagttgctggaagtgtttgtgtttcataccttcttttcaggtttgatgtcaacaaatctcttctctataactcattgacatactttgaattttgtggttaacatttgattatcaaagagtctaaaatgagaaaaggtacgccacttttagttttcaggggaaaccttttaagatttcacaataccttgttaaagatcacttgttttaggaaggttgaggagagagatggcacatttagcttctttgaactatgtagactctgataaaaatgtcttagatttagaagtaataaagaatgttgggtctgtttttggcttcgttgctcaggtgttctgagagcagcacagctccccctatgccaagtgactttctttcccttaggttaaaggaggtttattcattttgatcacttaagtacatcagaggggattatgatgattttggaaacattgaatcaaatcttcatttcatatattcatttattttattttagactttaggcagagcctaatataattttttaatgttgatttttttgtactgaaaacattatagaaatacaaaaatgtaatatttgggaattgttcagaagaaaacacatattatacccaaagtgtttctcaaagaagctaaatgtagcattaactctagactttgaaaggataagttatgggatgatttgcatgaaagattttggggaatagttgtaggaaacttagtttttcattctttgtgaatgttaacatccaaacgattacagataattaagatataaggcttctccactgttgcagaattctttttcatcctgttttaaaacaacctgagtttgtttctgaatgatccttttgtaatataaaattaatgaacttaaatcatgcctatgtcattttgacatcttagatttccttatacttatgggaagaagggattgagtgagatttttacgtttttcacattttacagttcgtctcataaggaaactcccataagaaactggcattcaaagacataagccttgttttttgttgttgttgttgttgttttaaaggaaactttagtaggtgaagcaaattactttctttgctcagtatgtttggtgataaaaatagtgaacatgtggatgattaaacagttttaaaccggcattaaatctatgactttaaaattgtaaacactttagagagaagttcaaaaatgaatacctaagcaaaaggaaacagtatgtcatttggtagacaggtttctggaagaatcagaagaattctgtggtatgttttatacatcagggcaagatcaatgggttttgaaattgtccagttccagatgaggcttttaaaaatacaattcacagacatatgggaaatttttgagtggttgtgttgtaatgcaaaacatttttttcctcacagccccattagaagtttatttcatctttttaattttattttttaggaggaatcacatatagccttcaaaacgatcattctcgccagtgattttttttttgtcccattaactggaacttaatataaataaaaaataagtaattatgcaaaagaacatagtttactaagttcctctactatgatgattatattaaacagatattgatagaggacgtattgtgtgccaggtactttgaataaacatcagtcaggaaagacaaggttccttcctctttgaggctttattgtgtaaagtgggaaaatagataataaattaaatgaataaatgaaaagcgaatttaaggcagtaataagtgcagtcgagaatgggggccacttttccatctgggcttggtggtctgggagggctttactgaggactttagagctgacttcagtgaaaagaaggcaacatgtttgggcatgtgtgggactaaatatatatacacatccatgaatgtggagtgtctacaaaagggtttgaagataagtctttgcattttattcatcaaacttcaccgaaggactgtagtcaacaagcaaaaactgtgcaagattaaaagcctgaagaagaatacacaaatattcttatttataaaacgagtatttattttaaaaattcttatttataaaatgacctctgcaaggtctctgggcattgaggatggcccatgcaaaggccctgtgacaggcagaacctgcccttgtgaggaacaggagatagcagccaaggaaccaggtcagcagggccttatggaccacagcggagttggggttggggtggagtgtttccatttagtttgagtataggggaagctgccagatggatgatggatgatggatggtagattattgtctcagtttctgctaagttcttttatgttacttatgatatcacatctcattgtaatgacttttgttagtacattgattttgatgctgtttgtatttttcaacaggaaatcatactcattttagaaataagaatatttgtgtattcttcttcaggcttttaatcttgcacagtttttgcttgttgactacaatccttgggtgaagtttaatgaataaaatgccaagatttatcttcaatccttttgtagacactccacattcatggatgtgtatatatatttagtcacacacgtgcccagacatgttagtcagtttactttctctggctaccacgggggccaccatttctactcttggtcaaaaagagacatttggaaattgggcattcagcaattttgggaaataccagtgaatcctgattacgcttgtgtgtttttaccacatagttaaaacaaggtgagagttgggaggttcattgtacagttgactgtgagttggggatttaaaaaaaattcctttaatctatccctagccagtgtcctttcaaatgatcatttattggaatgttgtgattttaaaatcagattttttccccccaatacattttattcttgtttagtgacaatgatagaagaagagaaatcattgtgtgggttgttaatatgactagtcatgggtgctcttcacagcttctgttggctttgttccaacctgcaacatgcacccgggtgtgtaaccataaaccgttttataatgttttggtaaagtggccacagtttttgcggggatagactgcctgcctagtaacttagttccttaatttaatgaagatttttttttctagttcttcttagtgaatctgtatgttcctctcttattggtggagagtagtacagtcatataaatatatattttgtgggtagttgaaatgttcttttaggtagtgccagagaatatctgtggtctgcctgtattatttggaaattgacttcaaatgaattttccatggaagcagtgaaagtgccacacttgtcatggagctagtgtgtgcaggtgtgtgtgtgtgtgtgagaaaggggcctagtgttcagtatacacatagcatttcctgtttttccagttagaagtggctctgcccttgcctcaatgtgacatgtgttttaactcatgtggcctgatttgcttgtttgatttttcttacaggtatttttcattccaggattcactagcgttacaagatcgaactgttttgattgttcatccctggttgttatctctaccagcctttttctgagtaatttcagtgtgaagcatgctgctgtttaggtactgtgagttatccataaagggaccaaatcgcagggccctttaattaagcataccggcatattagcaaatacctttatacgttttgtgccagagatacttaagtatcttcattttctttggacttttcattttaccagatggtattaattattcacatataccttgtattagtgagagaaccagagaaccagaaccaatagaatatacatagaaaaaaagagatttattacaaggaattgtcttacatgattatggaggctgagaagtcccatgatctgctgtctccaagatggagacccaggagaaccaatggtataagttctagtataaggtcaggaaaatatagatgtattagctaagcagctagagagagagagagagaaagagagagacagagagagagacagagagaattcaatctttcttcacctttttgttccatttgggccttctactggttggataatgcccacccacattggggagggccttttcctttactcagtccatcaattcaatgctgatttcctccagaaacacccacaggtacagccagaaataatgtttaacaagatatctgggcaccccagtagaccaatcaagtagacacataaaattaacaatcacatatctgtaatacaatcagagtcaggttttgttaaaacatttttgtaaaagtatacttcccaagttggtttaaatgagctgactccaagagtgttaacaccaggtaccacttctctaagtcctgcttctctacaaagtctttctcagtagtgctagcaacatcatactttttccttcctgaccaacacttcctttattgaaccaattgatggcagcatttttggtgtattcttggttttgtgagtgtatcttctgtaagacagtaagttcatccacaatgaagacagtatctactggcataccttggagacaaattgtgggtttgattccagaccaccaccataaagtgagtattacaataaagtgagtcacttgaattttttggtttctgggtgcatataaaaattatgcttaaactatactgtagtctattaagtgtgcaatagcattgtctaagaaaacaatgtacataccttaattaaaatactttattgctaaaaaatgctgatgatcatctgagccttcagcaagtcatactctttctgctgctggaggttcttgccttagtgttgatggctggtgactgatcagggtggcagttactgcatgtttgggtagctgtggcagtttcttaaaataagacagtaatgaagtttgctgcatcaactgactcttcctttcaccaaagatttctctagagcatgtgttgctgtttgatagcactttccccatagtagaactttcaaaattgtagtcagtcttctcaaaccctgccactgttttatcaactaagttatgtaatattctaaattgtttgttgtcctttcaacagtgtttagagcatcttcagcaggagtagattccatctcaagaaatgagtctttattttttcatccataataagcaactcctcatctgttagttttatcatgagattgcagcaattcagtcacatcttcaggctccgcttgtaactctagttctcttgctatttccaccggatctgcaattactcctccatgggagtcttgaacctctcaaagtcatctatgagagttgggatcaacttcttccaaactcctgttaatgttaatattttgatctcctcccatgaatcatgaccgttcttaatggtatttagaatggtgaatcctttccagaaggtttttgatttacttttccacttttcctggatacatcagagcaatcagtatctatggcagctatagccttacaaagggtattccttaagtaataagacttgaaagttgaaattactcattgatccatgtgctgcagaatgaatgttgtgttagcaggcatgaaaacaacatttatgtctttgtacatctctatcagagcttttgggtgaccaggggcattgtaattgagcagtaatattttgaaaggaatctttttcctgagcagtgggtctcaacaatggtcttaaaatattcagtagatcatactgtaaacagatgtgctgtcatccaggctttgttgtgtagagcactgagagagtagacttagtatcattcttaagagccctgggacattcagaatggtaagtcagcattggcttcaacttcaagttaccaactgcattagcttctaatgagagagtcagcctgtcttttgaagctttgaagccagacattgacttctccctctagctatgaaagttttgaccagcagtccccaacatttttggcaccagggaccagttttgtggaagacagtttttccacggactgggggatggggtgggggagggggatggtttcatgatgattcaagctcattacatttttcattagattctcctaagaagcacgcaacccagatcccttgcatgcacagttcacaataaggttcgtgctcctttgagaatctaatgcctccactgatctgacagaagatggattgcttgcctgccactcacctcttgctgtgcagcctagttcctaaacccagggattggggtcccctgtcctagatgacatcttcttccaatataaggccattttgtctacactgaaaacctgttgtctagttgtagccatcttcatcaatgatcttagctccatattctagataacttgtgcagcttctacatcagcacttgctgcttcaccttgcacttctatgttatggagatggcttctttccttaaatctcatgaactgccgggcacactggctcatacctgtaatcccagcactttgggaggccaaggtgggtggatcacttgaggtcaggagttcaagaccagcctggccaacatggcgaaaccctgtctctactaaagatgcaaaaattagccaggcctggttgtgcgtgcctgtagtcccagctacatgggaggctgaggcaggagaattgcttgagcccgggaagcggagattgcagtgagctgagatcgcaccactgcactccagcctgggcgacagagcaaaaccccatctcaaacaaacaaacaaacctcatgaaccaacgtctgctagctttcaattattcctttgcagctctgtcatctctctcagccttcattgaagagagttaaggccttgctctggattgggccttgacttacgggaatattgtggctggtttaattttttatccagaccactaaaactgtctcccgagaagcgataaggctgttttgctttctcatcctttgtgagttagctggagtagcagtttaagttttcttcaagaactttcctttgcatgcccaacttggttcactgtttggctaaagaggcctagttttgacctgtcgtggcttttgacatgccttcctcattaagcaaaatcatttatagcggttgatttaaagtgagagatgtgtgactcttcccttcactttaacacttagaggcctttgtagggttattaattggcctcatgtcaatattgttgtgtctgagaggatagggaggcctgagcagaggaagagattggggcaggggcggggagcagtcagtggagcagtcagaacacatacatttattggttatgtttgctatcttttgtggttacggtttgtagtgccccaaacaattacaatggtaacattgaagatccctgatcacacatcaccttaacaggtataataacgaaaaagtttaaaatattgtgcgaattaccaaaatgtgatacacagaccagaagtgagcacatacttatggcactgatgaacttgtttgatgctgaattgccacagaccttctatttgtaaaaaaacattatctttggagcatgttaaagtgaagtgcagtaaagcaaggtatgcctgtgtatttttccatggtgaacattgtctatgaaacaaaaacagtggtgtcgttgatacccctttcctccctaatctgtgtggtctctgtaaggtgcacatggagatgactattacagccgttagcatctcttacttttaccaagtctgagtctccattttatgaattatccccaacaaaacttacattcaggtgtaaagtgatggcagttacttcgtacaattacatcttatttagaggtttcattcctatttactcttcagattttgactaggtaaagaagtgttctgaaacttgaaaataacattttctggtataacagaagatagttatttgatttgatggtaactaccatttattgcctaacgtggtgatatcaggaaggaacagggctctttatcatttttttttcagaaactgtcattcacagctggcttttcctccattagcacatgaaatcaatcacaataataataatgacaatgatattattattcaggcagatccttatatcatgcttactatttcctggcactattttgtacttgcgtgatggctctgtcagtttatggttgaaatagttgatgtgctcctgcttatgtgcaattttagctttgctttctgagagtttaggtgtcaagtagtaaagaactgagcagttgcatataactaaaacttaataatttctctgagttcacttttagactcacttgtttagaatgctctggactttccaacggctcttcatctgttcctctttggtccaggagttagtttgagactagaatcaactacagacactggcttgggataaggcctaagggactgtgacagtagtgggtggccatggcaccctagtgctatggccatggcagggttcagtaggctgactgtgggtctttaaaccccagggaagagttttatctagacctcctagggtaaaactggctgggtccaagtgtaataaagctaaaacttctcactaaggacatttcagtattaggacctgaagtccacccttaattgatttttttttttttttcaatgcagggtctcactctgtcacccaggctggagtgcagtggcacgatctcggctcactgcaacctctgtctcccaggttcaagcgattatcctgcctcagcctcccgagtagctgggattacaagcacgtgccaccgcacctggctaatttttgtgtttttagtagtgacaaggtttctgcatctctacgttttgaactcaggtgatccgcccacctcagcctcccaaagtgctgggattacaggcttgaggcctgagccactgggcctggcttaattggtatatatatatatatatatatatttttccaaaaccagagtttgcattttggtcagctgatatggtgattattgatgtccctagtcactgacaccgctgccatttcctagccaaccagtatttcagtgcctacaatgtgccaggcaccatgctgctacctaggtgggtggaagtcgagtcttccctcgccctgaagtactgggtaactgtaagccccatgggcctcttctcttagctggaatgtcatcttcaccttcaccatctcttaaaacgtcacttctctggtctgaaccccaagtcactgcctggtgtaacagaagtgaactgccctcacaggtgctctgtcctcatgagccctctgaaatgtcctgttgccttttttaagaaatggctttagagtccattgctattgttgaaattgtccatgcactttgtgtatcggatcacgtgggtcccactgtttcctaccagacgcgggtgatgcagcatcagtggaacaaagatacgtctttttagtttggaagaaaaatgaggtttcatcccattttctttttaccatcacttttccacccctccatccctctgctatggtctgaatgtttgtggttccccagaattcatatattcagatctaatcctcaaggggatggtattcagaggtagggccttggcaagtgattagatgatgagggtggagcccttatgaatgggattagtgcccttgtaaaagaaaccccagaggactcccctcctccttcagctgtgtgagaagacagtgagaaggtgccacctgggaaccaggaaggggaccctcatcagacgctggatctgctggccttgatcttgggcttccaacctccaggactgtgagaaatttgtgtggtttataagctgtctagtttacagaattttgttatagaagccccaatggactaaggcacctaggcattatgctaggtgctgggaatacttgtaacaaaaagtaatgcaaatagaatgttacgtcagaaggtgttattttcttctttacatatttatacgtaaagtaacaaaattcctgtaagatatattttttctatcaacaagaaggtaaatttctcgtgcctaaaatagcaaatatagctacaagcaaggcagtttttatctgtgctcatagatgtttaatagattcattgaagctctgtggtctaatgaaatgacagtgtaggagtcgtgaaaagcttgcatttttttttttttttttttttttaaagtctcactcttgtcgcccaggctggattgcaatggcgtgatctcagctcggcttactgcaacctccaccttccgggttcaagcgattctcctgcctcagcttcccaagtagctgggattacaggcgcctcccaccacacccggctaatttttgtatttttagtagaggcagggtttcaccatgttggccaggctggtctcaaactcctgacctccagtgatccaccctcctcggcctctcaaagtactgggattacaggcgtgagccactgcgcctggctgcattttttcaattgttatttttaattaacatctaatagttatacatattcatggtgtacagcttggtatttggacacatgtatctaatgtgttatgagtaaatctgggtaattagcatacccagcacatcaaacatttttttgtgtgtatgttaggaatattcagaatcctctcttctagctatttgaaagtgtgtaataaattattgttaactatagtcaccctgcaatgctgtggaacactagaactgattcctcctctgtagctgtaattttggaggggactcaatgaatacttctccgtgcatctgaactaaggctgacaccaggtatgagctccatgagtgggagaggcctccacactgcaggtggaagacaggccagtatccgcagactgtgttcttgcagctgatgctcagcagctcaccagagcccgagtccccattgacatccctcatcctagtttttcttctttatctgaccctgaaatacctctcctgtctggctcctctctatttctgggtacccctccaccttagttcaggccttggtcatcttttccttcctctctgctctctctgcctctgaataaagacaagagaagaaacaaccccatctttatgatgctcaagtaacttgaatgcacagacgtaaattatatctctgcctgaccactagacaggggacttgatagggggacgtaagtcacattccagccagcggagtcttgtgaatatctgctttggtcttaaacctctctgctgctttgagagtagtttgtatctggagatttaggtagattatatctcgggtgttgaaggagtttgcagatgggagcgaagtaccactgttgataataacctgagagtttgtggagaacacaaaaggcactgggatcgaggtaaatgcctggattttgcagaaggtaccaagaaatcctagaccttcactgtacagtgtaggggccacgggacacgtggctgcccagcactggaaatgtgcctggcctgaattgagatgtcctcctgaaagtgtaagaacatgccagattttgaagattcagtttgagaaaagaatgtaaaataactcaataatttttatattaattacatgttgaaagggtaatattttggatttattgggttaaatatattatcaaaattaacttcacctattctttgatttaaaaatatgtctacatgaaaacttaagataacatatatggttcacatttgtggcttacattatatttccatgggatggtgccattctagactctgtaattcattgattttgctccatctccttggcagcattctaaaacatagtgcgaagcagatggttgtgtacttgtaggaaagaaagtagtaataactgaaagcaagaataattctactaagaacaaatcatgccaaactgacctcatttttttttctttttatagggttacttggctagaaaatcagaacacttctgtaggtttatatttggatttccgtaactcatttgaaatgtgtcctctgatcaggtcgaaggcattttagagagcattgagttgtggttgatggcacggctctctctgtagctggtgaaactcggtttgagacagtgtctcactctgtcatccaggctggagtgcagtggcatgatctcagctcactgcaacctctgcctcccaggttcaagtgatcctcgtgcctcagcctcccgagtagctgggattacagatgcgcaacatgacgccctgctagtttttttttttttttttaagtatagacagggtttcaccatgttggccacactggtctcgaactcctgacctgaagtgatctacccgccttggcctcccacagtgctgggattacaggtgtgcgccaccatgcccggtctcgtttctcagttcttgatggttgtgtcaagaacagcctgagctgtcctccagcttcctatagagtttgcttcatttcaggaatgtgagggaacatacactagcctcatttgggaagagatcaggtttggtcaggtttttagtgctctagaaggttctgccccatgagccatactctgttgagtgatctggggctcattcattgaatacatttctggagtacttacatgccctggcactgtgctaggtgctgggagtaaagattaataagatgtcatctgtaatcttaaagttccatctaggaggaaggaaaacagcttaaatgaaaccatagtccctgtggtagcgcaccattagaggcacatgtgtgtagggtgctggactgggctaggaatatcactcccagctctgctggtttggtaagattccacttgaaacctgatttctaactcctgccataaagaatggcttaattgttgtaaaactaaaatcattatctttaattgttcatatctcacaacttagaaaattcatttatgtgaaatttttctacagctacggtggaaagcttggcaatgtctgctttgacaaatttccaggacaaaattatcgtgacactgttctttgggaggtgtactgggcccaaggactagagtggccttcaaacatttctcaaagaacatctagctttgcctacatggtatctgtttggcggcatccttacagaagcaaagaagtctacattttggtcaggtgttttgaactctagctaagagttaggaatctactgagctctttacaatcgaggaggtttgttttctgatttgagagaccaaaatagatgcccttttctcaactaagaaagaccctaaggttaaagaaacaacgttgcctgtggattgagggttcagagccctggctggcatggcaaatttctaaattcctatggctctaagctccctaacagtaggagttatcaaacccctcctaacacatttgccacccagaccactgcaactctgactggatagagcgctggcctttcgagcatccttttctaataagcaactgcagacattaaacggtttcagcatgcttttagagactgcgcaggaactctgtttcctatggttcaccttttgacataaagagccaaattccacctcattttaatgctaaaacctcaccccaaagtgaacacgagatgtatgttacgtatatgtttacccactgtgcacgcactcagctccttccaaacctgtggaatgtgtaggactctcgtgtgatacagaccctgtgaggcataaaacctgagcagtcctcccatctttgaagaaagaaagagaacctttgacacacacccaagatcttctcttccacgccagcaaaccaatattgccagtagagctctcctttctactctttagccatcctggtcttttggatgacatttagttctggaagattatttcaaggatttaggtagcccatccatggctttgcttccatcagcttgtgtcttctaagtatgtagtaagtgactctaggcagcatacaggtggcaaggagttatgttagaccccctcggaatcaccttcgtgactgagtagccctcacgtctgtcacaggctctgcttcagctgaaggatattccagagatggccacacgacatctcactgtattttggtagagattttgtgaggacctcgtgcattactgcctagtgtactctgcactttacacacctttaacaacatgtcaaaaacctacaaggcaagtaatttgattagaaagatgaacagtcaacttaggcaaaattgaggtgaaactatagcaggttggtaggaaattctgactagtttcttctctagcttgacctctgtattatatgcttaaattttctctaggtactataattttaattttctgttttcctgatttttttttgttgttgaaatatctcacatatttttgggaaagaaggtagggtttaagataaaactaaagatcttcttagtgtcatttttggctggtagttggttgtgtttaaactctacaccgagaagatggaagttattttgttcaaacttttatattaaatgtctaaatcaggagtgggcaatgttttaatctttatttatttattttgataggtgagaaaaaatatttgtgtacttttttcacattcaaaataaaaggttttattgagtcctaggggaaaaaaaattaagaatgatttctttgagtagaaaacctccaaggggatttggtgctggttctgggccatgaaaatggtttgctccgggcctgttgggtggtcacaagtgtggtggcagacagccctttcagtccctgggcctgtggaggactgctggaggacatttggggttatcccatttcttcctcagaggaatgctgcagtctgtgttactgtggtcacactttagtaacagggacattggtgcaaagatgtattcttcaggttgtttggggagtggaggagtggatgagggacagggtctaaatggctccagagcttggggtcccggtatcctccccagtctgttcttccctttcctggaatctgaggtcttatcccacctgagcttggcaaggtgaagtgagcattcctatgacatttgccatcccaggctggtgtctccctgctgggatggctcccagtggccccaacttgtgcttccccccgggctgtcacttctgtcaaatcctccttccccccagacctgggaggggctgtggaaggcccctgatgggttttctctaggatctccttctcctgaaatgctgtgtgatgtctctagaactgaggctggctgagctttgcttatcaacaaagatttctctctttactgcactagatggcaaatgcctgctgttacagaatctttccccaaagtggatcaaagatggagtatcatcagtatcatcgcaagaaatgtcaagtctggcagaagagtatgaaaggggcagctttgggctgtccccatggcggtctttgggcacacatcaggggcttatggtggggagtgggtgttgtcctgtctctggcagtagtcccagcctggcgcactttttggggctcagtaaatagttgtttatatattggaaaggccctggtgggatggagggatttgtgaattatgtgcgttcaccacattgctgaatccacgagggagagtggtggggaagcaggcttcagcttaatgtgcagtcccaggtgacccaaaccaggatgggctgccaaataaagtgggccctctgttgttcagggacacagagggggagtccagtggggctgcacagtcatcttttggtcctgcatgctgaagccgagatattttttatcttgacacatcatcctcacccataaactacagttgctattgctatttctggcaccaccttttttacttctcattttgggtttattttatcatggagctctgagcctgcctgctctgtggtagactcaggtactctcagggacaaagtgttggaaaataaggtcacttctctctttaacaccaaaataaactgataaatgcttgtacgcagagtacagaaggagtaaggtagctggcctttcgtgctggcatgcctgtcactgtgctgtgaaagtgactgggacatgggcctcttgtgaacaaggattgactgtgcactaagacgtggcatctgcttgtgatgatcatgcttttgtcatccgttctctctggcttggaaaaggcccgagccaaactagaactgtcagacctaaattggcgtaacccatgtcagttcttcctcgaagagcccttccggattacctgcttcagtgatccagactgtctagtaagaacacttaggatcatagagcttcctgggcctccctctgcctagcgggaatcagtgggactgcgcagggtactccctgggggatgctgatgcacaggtagctttaggaaccctggatctgggtcagtgctttgtcaactgtagcacacagtcaccaggagggctattcaaacaaattgccagttgctccagagtttcttattcacacggtctggggagggcctcgagatctgcattttcgccaagttccctggtgatcctgagcctgtctgggtgaagtcctcatctgaaaagtgtgtagtgctaggtctgtgtccccggacataaggttataaaggtggatgtcttgcagggaaactgctgcaaagggcagaaagggttgtaaaagttctcccagagaagatgacctttgatgcaacaggctttaaccttctcattgagaatcttcagtgcagttcctaatttttaaaataaaacttctgtttaataagtcacatacatgtatgttttccctaactgctttgcatttttctttaatctgtgtagattttcatatttaaaatgcaagttcaattatgatttggttttggggttatcgtttattaaacattttggacatctggaagcaaacctattatctttatttttaattttaaaagaaaatgtttttgtaccatattctgctataaataaaatatttataagtgtagtgattattagaaatttttactaacatcaagactttaggccatgaaaatgtacttatttccttggatttaaaaatatttttacaaaataactttcttttcttaggaattttaattgttttagttgatgagttgatgttcttctttatgctcagacagcttgggcagtttttgtttaagataacgttaaagccgggtgcgatggctcacgcctgtaatcccagcactttgggaggccaaggcaggtggatcacttgaggtcagaagttcgagaccagcctgaccaacctggtgaaaccctgtctctactaaaaatacaaaaaattagctgggcatggtgtcatatgcctgttatcgcagctactcgggaggctgaagcagggcaatcgcttgaaccctggaggtggaggttgcagtgagccaagattgcgccactgcactccagcctggacgacagagcaaaactctgtctcaaaaaaaaaagacattaaatttacactctcagaaaaggtgacattaaatttatactctcagaacatttgtttttcaacaaaaatggatacagatactattgattaattttggaggaatacagtgaagataatttctaaatttagtcttaggtccttaagtaaaagtgccctcagttaactaaaacgtgttcttgaaaaggcatgaggggccgggcatggtgactcatgcctgtaatctcagcactttgagaggcctaggcaggcagatcacttgaggtcaggagttcgagaccagcctggctaacatgatgaaaccccgtctctactaaaaataaaaaattagccaggtgtggtggtgtgtgcctgtaatctcagctactcaggaggctgaggcaggacaatcgcttgaatccaggaggtggaggttgcagtgagctgagattgtgccactgcactccagcctgggtgacagagcaagactttgtctcaaaaaaaaaaaaaaaagaaaaagaaaaaaggcatgaggatttcaagtgaaatccagttaaatgagtattacataattaaaataggtcctatttggaaataaatttaactcttggaatatttaactattcctaactgtatcattcaactcattctatttatatggtttaattatatatttgacccatttaatcttaatacctcacgaaaacaaagctatgtagagtatcttttaatcagttttagcatctgagaaatctgatgtctctttggtggatttggccagagggaactggaacacatgctctcattgccactttgatggtattttttaaatctatgaaataaatgcttttagaaaatgattttactgggcaaagagagccaggtgtggaagtaaaatttgtattatctattgttgcataacaaatgacgccaaaacttagtggctcaaataatacagattttctctcttcacattctgtggggattcggagtttcttagcagggagcttctggcttgggcctcccgggaggttattctcagatgtggctggggttgcagtcatattgaggctgcacagagcctggaggctccagcacccaatgtggctaagctctggctcagctctttgactggagagttgatgctacctgctggtgggagcggggagctcagttcctccccagcttaagcctatcctggcgctgcttggttgcaggtcaaatttttggccagccaagaacctgaaggaagatctttcataatgtctcagtttggctagctacccaactccacgtattcatcctgtttgcctcgtggtgttgcctcatgccaggaagtgctccagtctgtgtttgtcatgttctgtgccctccaggagctcatgatgcaccagagaaaaggctaagcccagggcccaagagaagctggtgcaatgagcagcatgggcacagcctgaatgagggagggagtgtgtccaggaaaagctttcctgaagaaggtcagatttgagctgaatcagatgtgcctgccttctaagagaaggtagatgttagccaggtgaaggagtaggctggaagcagggagtagggggagaaatttaggaaggaaatgctaggcagatagaacagacttagtgaacagactgaggctcgaaacagcacagcaagtctggagaactttagcagtttactttttcagtgcctagggaaatgtttgagttagggagagatgccaggactggagatgctagtgtggtaggtaagggagttagtgcttctcagtcatgcagcttggatgcatgtgtttcttgcccatcatgcatgttttcttactcattcctcaacaaagatttgagcatttacaaggcttaaggcattatgccgcttcattgaaccctgaaaggtagataagtctgcattttatagataagagactggctgagggatattaattgacttgcccaaggtgatgtggccagtgagtagcagggctacatctgtgtgaaaacctgaaagtcgagttaagatgcgaaccagttcttcataagaatcactggaggcacatattttatataaagatttcaggcctccaccctagacttactgatgtctaggggaagggcctcaggtactctttactattggtgaagtggagagcttagctttgctctcaacttgaacttgacatcagtgagagtggaggaattgtggaagagggtgtgcagtttcttttctgtatgtgctgaggggcatgaagtccaaaagatgtttttgtttggaaaattctgagtgacattacagcctcaatctcttagaagatgttttcaaagtctctaaaaaataaattgtgaagaaagatatccacaagcttcagtatcttggaatcaacacacaattggatttttgatatctggtttgatttgatatttcatgtgaatgagtagctgaaaggtgctaatgaggtatttaatactggtactagaatcaaaagctgagaaatacctgaacacaaagaccagactggtaataatgtcatgagattccccaggactagagaaaaacatgaagaataaaattactaagaattattcaaaagagtgttttgttgttaaggattgctctgtatgtcataatgtactgttttaagctcttcacgtgtattgggtcattttatccccaaaaccaaaaatgttattgtttttgtatttcacagggctatagaatgtgaaaaaatgtgtaatttagttaattgttgtttttaaatgctcaaacaaatgtatttaattttttaatatccttataattttttctgcctgttctatcaattattgagtgcagagtgctaaaaatcttcacctgtgattgtagatttatctgtttctgtctttagttatataaacttttatttcatttagttgaagttctataattaggtacatgcacatttagaactctcaggtctttataataattgactctttgatcattatgtaatgccttttccttgtctttggaaatacttcttgtcttaaagtttactttgtctgatattgaaatagccacaccagctttctcatgattatagagtttgcatggtatatatatgtatatattttttccattcctttatttttagtatacctcatctttatcctttaaatgtgtctcttatagtgtacagttagatagtgctttttttattcagtcttgacaaactttcccttttaactgaggggtttagtccatttacattgattgtaatttacaatgatattagacattgatacggttgatttttaagtctattaccctattttttgtattctatttgtttgatctgtttgttccttctttcttgcctcactttggcttaatctagtaatttttcgcattttattttgtctcctttgcattttagccaaggtttggttttactttttactggttgctctagggattacaatagatagatagatagatagatagatagatagatagatagatagatagagaatcaccatctacattgaatgaatattttaccacttcacattaaatgtaagaatcttacaactgtatattttcctttacgctcctcctgtcctttgtgctgttctctattttagttgtatgtttgttgtacacctcacaatacattattttttacttttcagccaaatatctttttgtaaatgtaaaaaagaaaaggccaggcgcggtggctcacgcctgtaatcccagcactttgggaggccaaggtgggcagatcacaaggtcaagagatcgagaccatcctggccaacgtggtgaaaccccatctacactaaaaaaaatataaacattagctgggtgtggtggcacatgcctgtagttccagctactcgggaggctgagacaggagaatctcttgaacccgggaggtggaggttgcagtgagccaagatcacaccactgcactccagcctggcgacagagtgagactctgtctcaaaaaaaaaaaaaaaaaaaaaaaaggaaagaaagaaagaaagaaaagaaaagaaagaaaaaagaaaaaatatttatgtataaatccacacatttgccatttcttgtgtgcttcatttcttcctgagatctaaattttttccatttggtattatttcccttcagcctgaagaactttctctattgtttattatagggtaggtctgctggtgattaactttcttagctttcatttagccgaaaacttcttgaatttgccttcattttgttgctgagtatgtagtattctaggttgacagcttccttttttttcttgcagcattgtaaatatgttgttccattatggcctcccttgtttctaaaaagaagttggctatcattattatctttgttaccttgtatatagtgtcttttttgtgttactgctttttagaattattttcatttatgttttattttcagcagttagactccattatgcttaggtgggtttttctttgtatttgctttgagttcactgagcttcttggttgatttttttccaaatttggtacatttcatctacatttgttcacatatttttaatcctatccttccctcttttctcctctcctctaattgcccgtatattttattgtttggtattatcttgcaagtcacttgtacttaatttttttccagttgcttttctgtctatgatttagtaaatttgtgtgttttttttccttctacaaagtccaattagcaagccattcaataaatttttaatttgaaatattatattttagtcttgtattttatttagtgctattttacggtttttatttctgtctgaaaatgttccatctcttctattagatttttttatttgctgtaaacgccttaatatatttgacgtagttgttctaaagtccttcactagtgagctcactaagtgagtcattggagattctgttcttactgactgtgtttatttttacttatggataatattttcccattttaaatgtattttgaaattttaaaaattttcagttttaaatttttaaattgtattccaggtgtacacaaaataataatatttgtttgtttcatttctcaagagtgcaagctctcttcttaatggagataaggctaaagagctgtatattcagattcctgaacatttagttaaggttggagttacacttttaattaggttgagttcacctaatcagccttttaaaaacaagtccgtgttagtatttcagctgggagaaagttggtctacaattttagatctttgatttcctgttggattaaaagattgaatgaagcatcatcagagtatatgggctacatgatttctctcagccttctaacatttccactgttgcttttttgtctaatttgggaggctgggggaaggtggtggtagatcagaaggcttattaggaaagtaatttgtttttgcatttgttcttctagcatccaatctgtcccaccagtgcatgccactgtctgaggcttgtctttctctccttattactgcgagtctctctctgatggcttgttcctcctgatctagacgaggcgtcctcagataaggaagctgctatggctttcagctcacccagaaaaggctactttcttcctggccttaggctcctttgcatttattattttttgctaggcccatagaaaagtaactttttattttgtccaggtaaaattttttgttgccatcggatggaaggcttttttgtgcttctaattagacacagaaatcttctatacatttttaaagcaagtgccccaaagtgtaaagtgtcaatgagttctcttgcccccggatgctgattgggtttcaccagttggaagcactggatgaccatcagtgcccagttgtatgtgttaagtgacattcttctaatttttcttttatccaacttaaaaatctgtggtatctgtgctattctattgggtcaccactggttactgatacctgccaaccaaaaaggatatctgaaaggcagtaaaaaaattaataaataaataaaaccaagcattgctctgtaggacttgccctgagacactctttttcagttatggaactgcccaatcacatgtaagccagaaaacatgaaaagttaaagacacatacacagaaccgattcctagcattactactacttatggtttaaatgtaattatttactgtttcatgtactgtatcaatgttgttaaatatattgtcatttagtagtcagaacaacccagagtaacactgagattctaagttggggttgactacagaatatacacttttaaccactgtgctataaatgctaccttcttcaaccaagttgatcaaccagtattattttatccaataccaacttggatgagcaaggtatcatttatagcacaatggttaaaggtgtatattttgcagccaaccccaacttggaatctcagttttactctggtttattctgactactaaatgataatacatttaacaacattaacatgaatttccttgaagttctagagagcatatagcagacattaaatatggaaagttcaatctgcggtgaaaccttaccctaattgttttacacacatactctatggcctggctctagcattccacttgctggggagccagtgttgagagtttctggggtgcacaagtaagaagggagctgagctgtgagcagcattctggggtgctgttggtgctagtctctctgaatcctgctagtagtgtagtcaggctctcactttcataaacacagtgatttgtatttagcctgttcatgcacaagagctttactggtgagaaagaccgaactctgtgcttctattctgaaagctaaatgtcccttgacatgagaagttaagaagtcctacaccatggacgaaccatgtgggcattatgctaagcaaaataacccagtcacagaaggacaaatgctgcataattccacttacacaaagtacctagagtagtcagtggtgacagaaagtacaatagtggtttccaggggctgtaggcaggaagaagtaggggtgaatgggggtacagagtttcagttttgcaagatgaaagaattctggagatgggtggtggcgatggttgtacaatagtgtgatagtacttactccactgaactgtatacttaaaaatggttaagatggtcaattttacattatatacattttacctcagttttaaaaatttaataatataaaacatgatgtctcaataaaatttatatttcagcctttaaaaaaagtatccagtggattctgtttggttttactaacattatgcttaatttttgtagaacagcagaaaacatgagtattgatattggcattgttctacacttgcttattaaggagatgaatagcttttcttagggaaggccaaaagtagaaattctttggcctgaaatcattgccacctgctctggaaagcacttgaagaaggctccaattatacttctagacaagaaagcccaaacccagggggttgttagacagtgattagtctctccaggggcagaaaaacagtgtgggaaagccctgccctcgcaggtgatgaaccccagcagcctgtgtgtctttcaaacagattatatgagacttagagtccctgcatctgatgttgaatatattgtggagactaattttttaaggaaaaaaaatttaaagagagataaacttcatcagaactctctaatacttggaaggatggaaaactgccagtttataatcatagtggaaaacaaatttgttgacttaatttcttggcatggtattctagggttacttaagtactattacataatttttatttttatttttatttttcaagcaacacagtgagtgatttaatagatagtcatttaaaaataataatttaaaagatcagcctccagataagagaagtgctttctactttaggtttttgtgagttccttacccctatgtttttactttaaataagtattttttatgatgtcagctaataaaggattttgcatgtaaaactgagcagctacaaaatacatgtttttttgcaacagtttctgctggacaaaaaagtacagtgactttggaaaaactgggctaatgaaaaagtaaatatttttcaatatagttttggactcatgaatctcaggtcctgcacaagttcaaacgtttttaaggaaggtggccctaccattctctcctgcctagaatagcatggtagtcccacagaacatatcagagttacccttgtttacattcatacatggggatctaaatagtagtcccatctagctgctgctcacatgttggctgggaactttactataaactctgtgtttgctttgttattgtattcttcttttctagatgagttaggatttccagctattgactcaaaatcattgaaatcgtggaaaatgacaacattattaattagatcatatccagtcagtaatgtgctagctttgaaaacatgtatttgtatactaagccgtgtctgagtaccatttttaggagtgttaaaaatgaaactgtgagctgtgtagcactctttttaaaaagctgtattctttgccaccaggtgtatttatctttaatttgcaaccaagtatatttatccttaaaaagattttgtgacactgacattgtactaagcacttacagatttttccatcatggcattttccagaatttctatcttggcttaacatttctttgaccatatatggatttgctaaatgttattgtttatagagaatcaatgaacaaaagtgatgggctacatttgagtaaatttaatgaaactttcactgtgctttttttttttttttgtaaaacccagagaaatatacggatctgtttcaactcggtccaaataaaaataaataattagaatacataaaaggctttttaagttgtctttttccatagcatgtgaggagcattatagagaggggattttggtcttactagtttgaacctcagagagatgtctctaattgtataagcctgcctttttttggaaagaaaaggaaaattttccaattgttgggaaatcaatgatccataaccaaaaagggagatagaaagaactttattaagtgactcttctgtgcctggcatttttacatatattattttgttgacatacattcctccaaagtaggcattatttctatttgttgatgaaaaaatgaattgcctaacttgatttgtccaaggtacgttatgaataatagtggccaggacttaacacaactctgccttactcagtgctgctgctgaacagtcagccagcattgagtgagtgtgtgccctgtgcctattcctttgcccacttttttataataaattgttatttgattctcacagtgacccttgcaggaaggggctataattacctttttacagaccaggaggttaagttagttgctcaaggtcacatagtgccatggaggcaggctttgaactcagttgatttcagaatgccaaagagagtatattagctaatcattttggttcttatgttatatcccaacttaaggcagcctggatcctttagagagatgctcaccttctatcttctgtagacttataataatggtatttgcctgggcttacactatatctgctgcataacccacgttgatacactgcagacaggacataaacaacatggctaatttactatcttggaatcccactcattcaaaaatatctatgaagtgtcacatcctgggccacatcccagtgattaagataaccaggcaggggtttgtggtttagtgacgagatacagctataactaacctttatatctggggcaaatgtttttgtggagatgagcaaggcaccatgggcatgaaggggagaagtggtcaaagctcagggaggtcaagggaatgtttctcaaaggcagcactgtctgaactaggggggcatgggccgaaagtctccagactcacagcaggagacaggggtattatttcagacagtgggtagcatgtgcacagtgggaaggcaagaagaagcatggcctgatgagagggtgctgtagtgcctctgaatagctggaacacagcaaatggggacattggtagatgagactccatccatagcaaccttgtctgccatcctgagaaatgtttggccttgatcttgtaggtgatgaggagcagtgaaagtgtaaaaattacaggcatgagggcaggagggcatggtcacaactggatatgagaaagattaattttgctgaaaggctggtgttgggagacaggttgtgaggtgatggtaatgacctgaatgtcacactgagattaatttaggatgagagtattactaaatttgtagctgctgccaggtgtccctaccttagcaggcagtccattcagatttgagattgttcaattgccaggatgttcttatcatgagctgtataacctctctataacttctgctactcagaatgatgtctcttcctccacatgacaggcacttccctagttgatgtaaatatttttaggtccatgtcctatccacccatgcctcagtttctcaggatctgctagatcttatcaacttggattgtgcaggaggtccatggtctttccagactcatgcatcatcttagggacttagtagtgggggttagcaacactatacaagattctggcaccttcagctgggctttagaagagggcttgtaatgagcacattcacaacataatagaacatcccctttacccctgctacatgggttgacccattgagtacagggtagtgcttgtatatatttgtactgaactcaatgcttctgatagtgcaccctataatttctctagtatttctgccatagctaacagctgagtgataaactcaaacttgcaggcttttttcacataaaatagtttgagcttctactgtgaattgcattacttaccttttttggatgatgaactttgtaagggcaaggactcttttttacttaatcttggtgtccttttccatctagtatagtgactaacacatgccagcccatcaggaaatatgtgttgaataaatgtagtttgattattattttgatctgcacttgatattagtactatgaaattgttctagcttagcacatttggaatcgtgattctattgtatatcattttagtcattatcaaccttgaatcatctgtaatcactttgataagcctgtcttatgggtgggttcaatttcttggtgtgtgaaagtcccgtgaccacaactggatttaacaaggggattgtattacttgcaagaagtatggacaccaggatagttcccagagcagtgccttccctaactatggtgaaaacagcgctttcattaggctggttagctatcattgtatgaagaggtaaaggtagtgcagatgcagcttctggtcatgtttctacatattatcaatcttctacatacaatcaaacttctacatatggtcatgcttctacataggtcacatgtatagaaaattgcaaataaattcctcctcaggcagggtttttagtatggtgatgaggagagtttgtcaaagtttatctccaactctgacatccctggatccaactgttttttgtttttctggggctgagtttcttctttttaaaagaacacgaactcaaggtgcaacagggacaagtgggtagtctttcacagtgtttacccaaaaacccagggaccttaggctacatcttccctctcctgtatgtcactctccatggattatcaagagttttagaaagtttatccctttacattgaagaaatttattgtagactaaataggattagaatacattttggaaatctattgtaaggtcacaacttattagaagttgtagaacaatggaataatttagtttccttataagcagtattgttgattattggtttttcttttttgtggtctccagatacttagccatcattgattgctataatccttattaagtatttgaagatgttgagtaccatccactgaaggagtcccagggctgattgaggaagttcgtgaatattaaaagatgggaacactgagttttttttttttaaagcacttttgtgagttacaatgtatatataactaaatttactgattttaagtgtatggtttaatgtattttcgcaaatatggcagttatgcacccactaccacaatcttgaaatagaacatctccatcaccctgcgtgttctgtcgggcgtctttgcagtcagtcccttcccccacactgtgactgtgccaatcattgatgtgctttctattgctccagtttgcctttctctaaaatttcatataaatgcgatcatacgtgtagtcttttgtgtttggcttcttttccatagtataatcctcttgaaattgctttacgttgttgtatatatcagtaattatttcctttttattactgagtagtattccttcgtgtggtataccacaaattgttgatccattcaccagatgatggacgtttggattctttcaagtttggagttattatgaataaggctgctgtgaacattcttgtgcaaatctttgtgtggaatctctgtgtttaaattttgtcctgggtatatacttagtagtagcattgctgggtcatatcgtacgtgcttaactttataagcaactgccaaattagttttcaaagtgcttgtaacattttgaatttccaacaatcattgtaggagaaccaagttgtttcatatccttataaacactttatattttcttttcgagatggagttttgctcttgttgcccaggctggagtgcagtgctgcggtctcggctcactgcagcctccacctcctgggttcaagtgattctgctgcgtcagcctcccaagtagctgggattacaggcgcctgccaccacgcctggctaattttttgtatttttagtagagacggggtttcaccgtgtcagccaggctggtcttgaactgctaacctcaggtgatcccgcccacctcggcctcccaaagtgcttggattacaggcgtgagccactgcgcctggttaacacttgatattttgaaaccttttaaaattagccatcttatttggtatgtagtggtatctcattaaggttttgttttgcatttccctgattaattatgttgaagatctcttcctgtgtttacttggcatctctattttctttattgaaatgtgttggaatggacatcttgtcctttttccccccttaatatggttgtttggcacttagtcttaatatcaatagtgagtttataaaaagaaatataaggaaaatattttgttgctttcacggtttctagaaaggagtatttcttattggatgttttgtttcctgaccatgtgtgtgcatgtgtgcttttttgggcatgcgtagaggagttcttctgtcatctgttggccagatttcatttatcttaccttgcttccttgcacatactctttatttctgcggaatctgtcagttcacattccccaggaaaaccgcatgtggatttactaactacccatctaaagacacactcacagttacactctcatcccatgcaaaccttaactccagtgctgctctgaaggccttccttggtgacctccatcatcagcccacagtgggcaggacaccatctggtgcttttcggttctcatgcacctagcactgtgcagcaataaataatgggagagtcaacacatgactgttgttaataagctgctgacctgggtgacccaagtgctctgcagtgattctagggtttcagtgaatacgaattcagtctgaactgatagaactaatactaaatcattttgaaattctactttcaaaactgcttatgtgagctttgtgtatagaacacctatgttttgcttgagagactctataaatcgacttgaaaatgtgttgcagcaaacctatgattatgatctgactatgaataagacagggaaactatatactctttttgtattaaatttatctaggttagacaacctaagaatatcccaaatttcattttggatttctcatgggcattcatattttaatctagctttatcagtgggacaaaaggcagcgtatgcccttgataacttttaacagtgggttatattgacagaaagttgagttgactcgtgatgttgtaatcatgctgattagaaatgattttttttttgttttacactaaaatagatgaaattgtaatctcttaagaggttatttaggaaattaaagatccgctatgatctaatagagcactggatttacacctagaaaacctgggaatctggagctggcttagctgtgtgactttgaagtggtcacttaaccactctgggctttctttttctcatctgtgaaatgagtcaactggagcagatgaccgtatgatccctaagtttcaagcatctgtgctatgagttatttgtattaggatcgttttgatttcacatggcaactttgaagataaatccaatcttgaagttctccatatgtggtattactccctgtcttaatcacagttgagtgacttttctatctgtgaattcattctagtaagtgttcagctctttgctattttctcccttcaaaagtgtgagaaggataaggcaaaaatcatgagaaaaatgaacagggattttagatataatttttggccaaaataaaagtattggttgcaaaatattaaaatacagaaccttttgctttgttatatgggtcacaatcaaattaatatgggcccaaatatattttaaatcaatatttctctaacataataacagcacatgatttcattaatttgagttgctggaaatcccatatacttcagcaagcaaataaaatactatcttaaatttcaggtattaaagcaataaaaagaaccatgggacttggagtttatatttctattttaatctaatactaatttactctgtgttcttgttgaaccttgttaggtaatgggacaggagaaagtaggctgttttgaaagttttgaaagtgagtggaaagtatcaatcttagttgttatttaaatgggcattttcaggctctttgtattgttttgaagcgatagaaaatctaggtcaggatttacagccttcctaatacatgtttagtgtatcattcattacacatctctccagaaaggcgatgatagtgctgaggacgctggcatagatcttaatgaagtagttttttagccattatctgttggagtcccaagtgcctccttaaaatatttttctcttggttcctcctataaacctgcaaaatatacagtaaatctcaataaagaagatatctattgcagacaggacacttccttccctgtctgttggctcctgcttttgagtaaacaaagacgcagtcatttggactgatggtatctgacaaaagcagatgctggaggagaagacggttaagattttcaacacagtattttctttagcattgccagctgtcccgataaccatcactttcatgactcgtcccagtatctccaagtgcagcgaaagcagaacatgtccagcagaagcagctttcctccaggagtctccgtttctttccccgtttgtaaaaaggagtcatttctcggtccagtcgatgttaatttttgctgataatgaaatagtttgtacttgaaatttgggactattgaggccatcaagatctgtcctcaatccaggaaaaagaagtccaggaccagcggaaacatgtgtttgttcgtgaccttgggtctgaactgcatttggaggacagaaggagctactagacctgtcttgtgatatcttctccctttgcaaatattaacgatgtttctggaggacagtgtagctgttttcctagccagttttgcagttgtttatgaggaggctccatcattttctgcatgattctgtgagttagaaggagtgacatgtcctttctgggatgttgagtatgaagcagtgcaaagccggggttccccaggctcatggaaatacacaggctctcatttagtttgttttccattgaatacatgaagttggcctcatactttgatttttgtttccttttggaatcagttttagtttcctggagcagctgaattagaaacaggctttgaacctagtttatccttagataaatacaatgtctgtgattcaaggaaaaacaatttcttttgaatgataccttttaatcacttttattctccagcataatttttaatctgcgtctttttccttttagaaatctccaaattggacatccagagcagcattcttgttctgtctacgtcttgaattagaaactatcaagctctgtaagtcctgaaaaggaaataaaaggtaattacattaaaaatttattattaaaatcatgtaggaatctggttataaagtaaatttgatcctttatatgttgagcagaatttaggtattccccaatttttcccacctttttcgttcttaaatactttcccttccctccttccttctttcttctctcccttcctcccccttccttttcatatattcatttagcaaacttttgtggactctgccctgtgctggtcactgttctaagcacacacactttattccaacttcccatgccctggcaggaatggggagattggcaaaaaccatccttgtagaactggctccccagcctctgtgccggctgctggggggcagatgctctgccattggtttggctgaggctgatctcggcacctgccccaccttcactatccccactggccttgaaatgcatgcgcttctcccagccctctgaacttgcctgggtgttcacttgcagtggcttttttacctgagaattctgaacactcagtggacatttaacttccccaattgggactgttagaattataatcactcatggggataagtaaaacagaaacagtgtactgttccccaactactgaatatgtgaatattctcactggacatgggacctagtatatatatttttaattattaacataatgtaaatattgcaaacaaataaatgttacagataggtagcatagaatgcaactttctactcaaaagccactctccagagaaaatattggttagatttaggtgcacattctttaattattttttctccatgcacatactaatgttcaggtgttcagtctgtattaaatgccttaaccctatgagtgaaagtattggggtaaagatgacttcataatttctggtaaatattgtgacttatttttgttcttggcgtttgttaatctgaataatgatgtctatgagttgggggccactggcacacctatgcacttggtttatttgatggtgttttgtagtcactttgtagtccagagcgctcacctcccattgtgttaggaatgcattaattgttccagtgttccatagagaacctggactcgtgtggcaaggtgaacacccttatcttgggtggtgggcaggagtggtgaacttctccctaagctgagaacttctgtggtaaatccacttcaatgtggctcttgagacatcgatttcattttaaaaaataatgtctactgttattttaaattcaggaggtgcacgtacaggtttgttacatgagtatattgtgtgatgctgaggtttgggatataaatgatcccatcagccaggtagcaaccatagtatcccatcgataggtttttcagccttttccccctgtaactccccccagtagtctccagtgccttttgctcccatttttatatccatgtgtactcaatgtttagctcctacttatatgtgagaacatgctgttttctgttcctgcattaattcacttaggataatggcctccagctgtgtccatgctgctgcaaaggacgtgattgcatttttttaatggctctgtagtattccatggtgtgtatgtaccacatttttttaatccagtccaccattgatgtacacctaggttgagtctgtgtctttgctattgtgaatagtgctgcagtgaacatataaattcatgtgtctttttggtagaatgatttatttcccttcagttatacacccaataatgggattgctgggtcaaatggtagttctaagttctttgagaagtctccaaactactttcacagtgtctaaactaatttacattcccaccaacagtgtataatccttccctttcctctgtggaaggagcataaatgatttcaacaagcaaaaaaccaaatagccccggtaaaaagtgggcaaaagacatgcagagacacttctcaaaaggagacataacaagcagccaacaaacatgaaaaaatactcaatgtcactaatcatcagaaaaatacaaattaaaaccacaacaaggtaccatctcacagcagtcagaatggctattattaaaaagttaaaaaaaaatagttttatttttcagtgttttttcatctgtcattaagctgtcagctgcaagtcagttgattgccacacgtcttcctcctgctgaccgtctcttaccctggcttcctgcctccctcctgggatgccagagcattgctgctggtctcaggctcaaccctcctactacctttccctggtagcctttgttaacctccccacgcgcccttggaattgagccctcccatcactggatgcccaccagtatatcccaaaacaattttgccgtaaattccagcagtccctcctgaaacaggcctgggtaaccaagagcctgagtaacaaaatcagtagtccagagcctactatggccgagggacacagtgggctgcggtaactaagggacagatgaccattgaatgggcatggtgcatctgtctagaccaaggcttgttatcctggaatgcctagtgccctggacactcagaaaccctgtcatttgggtcttgtgctccgggtatcattgagttgccagctttgaagcaaggcttctgttttcttatggtgagttccttcaggaaaacttgggcagggggagtgtcccagctggatttatcagctgacttatgggtcggaaggtctggctctgcccaaaccagccctgacccctttcctgtccattgtttcaattcttctcatgtctagtgacagagagcagtcctggagagccacactcctcagtgctgagggtaagagtgtgggctttaatgttagaaggacctgtgtcaggacctggactctgccatgtgcaataggtacagccctgggaaagctgtttacttgatgtgccagcctattcatccatcaaagcagaattacgatagtgcccagatcataggattgttgttaggaatgtgagttgctacatgagctggcacatgagaagtgtttaaggtatgttagtagcttatgtactgtgatcttctgcagaatggagataatacctacttctgagggttgctgtaagcattaaatgaggtggtgtatataaatacattgtgctgggcgcatagtgcatactctgtaactgagagccctccgtgataatggtaaagtaaaaatagcactatcagcaaatgtgttcagaatgggacagacattgtgacccagagtgtgggggaatatctaatagtagtagggaagaatggccgcaagttcagtcatctcatcgttagtttaagtcattgtctaaactttggtcacaaaggctcattcataaaagctttggttatgattgactactagagtgaatagtcaagagttatgtgtccaaaaatccttttattcttattaggtgctactttttaaatataaaaggcaatatattcttggatttttatgaaatttaaaaatcaacttaagaataaagatagtagtaattattttgttctctcattagacaatattttttatcatccttaaatgggaagtatactggaaaatgctcacttatgttatatggttgttatgaaatgattaaagcaagcaaattgaaatctattaacatttgaccctgtcatctcatacctaaattaaatgagatgtgtttaacaaactttggcattcattttcctctactttgaactaaagacacatttgaatccttggtatattagagaattttcttaccatttgtttcacacatttgtttttcgtatacttgaaactaatgacattacttggcttaaaaatgtgttttaaagaaaagagtatgcataattcactgtaagtcaccttagaaagtgaatgtgtctgagccctcctggccatagagacctgtcctgttatcttagcacccaggcctggcattaagcatgctcagtacagatgggaactgaattgaaaatgcagcaaaggaattgaagatgtgaaaacccatttgttagaatgctgagaatatgatgacttttcaaatttacctttagcagtacagttaaactataaagaaagacattgtagtgggagtaacatgtgcatttgagtgcagtgatagtgatacttgttctttgctctatgctaagtttaggatgccgatgggctggagtcatctgtctcttgtttccttctgccctccttccctgcttgccccttccccctccttatcttaccatccccaactcctcctccttatgagactgaccttgtgcaaggtcccatgtgttcttgttctcccagcattccctatgcagtagcccgggcctctatggaggaggtcctgatgtgaagcaataatgctactacacttgctgtttctgcagtggtgacttgtattcctgtagacccttatatcagttacacaccaagggaaggagtaggcagcctctctttcagaatcatggtgccacgtctctcatgctgacttaagtccacctcttagagtggttttatcagtgtcctttgctacatcttttctcagctaatttgggatgaaaacattctgtctctattaacatcattatattctggcagagaacagtattacgcctgaatttcagcaagtctgtttgcatttcacaggagagagccaggctcagccagacattttatattctgtgtgaaatcaagacttattatcttacttgataataccattcctcatggtggaaatctaaaactgaacttgctaagtgttcttctttccaacagtagacatcagcagtcttaaaaatcactgactttttaaagtaaatttgccttatttcatggttgcccacaggttaggatttgtcatgagattaagctggtaagaataatacagccacctctcaaaatttgtaatcatgccaagtgaaagtttctgaaaaccaaagagtagttaaggtgctgatctgaatgggatagattagtgagaacccccactcttcttgcacacatgtgcacatgcaaacacatgtgtgcacacatacacacttcccagaggtgtgatttgattttggacttcagctgtaattgagtttgcttccttatttgctttaggtattgatctgacttgagtaccattgaagagcaaaccccttaagcatgagtgtattttaatatgtagtagtatacagttcttcaacctcttcaaaccctaagaatttgaatttttcttctccaagtacaagagtatactggttttgtgaaatttggtaatataaacttagattttcccggaatgagtttcccttattgttatccaatcatacttattattttttaccttgtttcagtgtttgagtaaaggggaagaacatcggatggtgtgttttggtttttcagattgtttgaaaacatcaaagtattgatagacccttcatgtattaatgccgttaaggtacaagtatgttaaatttttttttacatagtctataagctgatcaacctacaaacctactatctatagtaaatgcattcttattgttacataggattatctttttaaaaacagtacttttagtgatttgaggttttatatattaatatataatttttacttgccttctctctaaaaggaagtttttttggtttgtttgtttgtttgtttgtttttttaattaaaatgtcctccaatttggagcttagaatggtggcttatgaaatcccaacactttaggaggccaaattgggaggattgcttgaggccaggagtttgagaccagcttggcaacatagtgagactcagtctccacaaaaaaaaaaattaaaaattatcctagtgtgtggtgcacgcctataaccctagctactcagttaagcttaggcaggaggattgcttgagcccaggagttggaggctgcagtgagctgatagtgccactgcactccagcctgagcgacagagtaagactctgtctctttaaaaaaaaaaagttttccgatttaggttgcatacatcagtcatgatgatgaaattcttttttcacgaaaagtattgttcacaatctgtttagcttttttagtggcatctcttttcagtgagtactgtctttggcaatgttttctgacttgtttcctaacttaattagaattggaaaacagccgttacttttctctctttctctttgttgtctggggccgtcatacctgactatcttgattttcgctttctccttcccccactacagttaacgcttcatctctgaggctactttctttgtttggagtctatcagctgaacagataggcatcaccaatgtgtgacacaagcagggactgtctgggtttgaaatgcaagatgtattgtaccaaatgaattctagattgttttgcttagtagctcacccaatttttgtttctttaatcttcgaaagatacgactgggaggatacttgcacctattgagaaagcgtgtggtcctctccctgagtgattgctgatgacatagaaatgcatggtagcctcttttcacttaaaaattaagtatcaggtactgcttactctaaattaggttacagagctgccatcactcctcatcatcaaccctcggaccattaatgactgttctgtttactcagagctgtgttatattttgcatatggaatcctggagtgttgaagacagagatgttgcatatttaattttaactccttgattttcagaggagaaaacggagatcatttcacaattgccttgtaaatagctataagaatacagcaaaggtattcttagtgtaggtattcttcatgtaattaaaatatctatgaaaattacctttaatcccagcacgttgggaggccaaggcaagtggatcacttgaggtcaggagtttgagaccggcctggccaacatggtgaaaccccatctctactaaaaacgcaaaagttagccaggtgtaggggcacaggcctgtaatcccagctactttggaggctgagtcaggagaatcatttgaacctgggaggcaaaggttgctgtgagccaaaatcgcatcactgtactccagcctgggtgacagagtgattgagactctgtctcaaaaaaaaaaaaatctctgaaaagtaacaagtgcatcaaattatattaaaagtgatgagctctctctacccacccttcagatccacttcatcccggacccagagaagagcttggcattcaggaatttcctaaacagctgtgtgtttgtgtttgctcattcattggttcctttaacaaatgtattctgggcacccgctgtgcggtgccagaaagacgtggctcttgattgagaagcacatagttaagccaccagagttgttatctgatcccatatttctttatatttagcatttgactgagcctgcaagatttgtgtttttgacagaattccctggaggagctgaggaaagcatgtcagcctgacggcatttctctggagccagatcgccgggtgccagcctgggctggcactcacagggcccctccttgctggccctgctgagcccagagtcattgtcattctcagaacctcctatgtttgggttatgctgaaaatgcagggagctctcttagatcagccttaatttgactggaagaggaaactcatttcctgcagagtgcctgtaatgtgtccagtccctgtttgtctccctgctggttggccgaggcaggcgagtccaccctggagcaccacaggcctgttccaggggccaagaaggcctttgtctccagcttcactttcttactctttgcttttcaacttctcaccagccatgtagaaaaagtcttatacatgtgagatcccattgagtttatatggtgttgaaatttcactcactagtactcttctcacaattttaaaaatagtcatttaagaagttttgtctgttgagtaggctgtgttaggagccgctcctatctatgggacagtgggaagtacagcaggaatttcagagccaaatttcagatctgcctcctgatagtggtggtttgagtcacatagagtaaggttagtctccccctctggaggtcacttcttatatatatttaaacatacacacacacatacacacacattagagacagggactccgtcccttgctcaggctggagtgcagtgatgtgatcatagctcacagtagtaaccttgaactcctgggtgccagcagtcccacctcagcttcccaagtagctgggactacaggcatatgccaccgtgcctgtggagacagtggtgtggtctctaatttttaaattttgaatatttaaaatttttttaattaaatttttaaatcttttacatttttaatttttaaaaaaatttaaattttttgtttgtagagacagcctctcactgtgttacccaggctggccttgaactcctgacctcaggcgatcctcccttctctgcctcccaaagcactggaattggtcagcgcttcttcgacatactgtacccacctcagcaatttttgagtgaacgcttttttttttctcctgcaaaatatttaacattccctacttgttatttgggcacaaataattctgtccccaaagtggattcatctgcattctgtgatagtttatttattgaacatacagcacacagaagcagtttgctttcctctaacgttaccaatacctgaaatatgcttacgaagagaaactggtatctgtatcccagtgagcatgtgccatatgcgcatggcggctgctctcccaggcgttggcttgtggctcctgcacagtcatcttgtcagcatcacaggcccacatagagaccaggcactccagggccgctctgcctagattagagctggaggaagagaaaatactaacccaggcagcagtggccattagcccacccagaaccaaatgcctacacccaaaacggatgcattcacatcttaggaaatagtgcctgtttccatataattttaaaaacactgcctcaccttttttgctaacaattatattaggaactttaaaattgtattttgatttgaaaatctagagacttacattaaggtaagtggaaagtaaattatagctatgcaggatcagcttttttaaaaaaaatcagtttttaatgagactgaaaatgtccacttatgatatttcttctttctctactatccttaagttggcataccatggtttatagctaaaataataaatggtagtgataaatgtgataaatgtacatttttttaaaagcagaggttagaaatgggaaaatctttttttttttttttttttttttgagacagagtttcactcttgttgcccagtctggagtgcagtggcgcgatcttggctcattgcaacctccgcctccaggttcaagtgattctcctgcctcagcctgctgagtagctaggattacaggtgcccaccaccacatgtggctaatttttgtattttcagcagagatgggttttccccatgttggccaggctggtcttgaactcctgacctcagatgatcccccacctcagcctcccaaagtgctgggattacaggcatgagccaccgcgcgcagccgaaaatgggaaaatcttaatcgtctgtgcacacctcactaacatatccagatgaagggagtgaacattagtcgcagtgttcgttccagcaagaaatgggaccactgttttaatctaaaaggtgatgatagttcccactcttctcctatgttacccttctgtccacatctgaaacatccagtcatgactatgtaccatcagtggtcctcattaattgattgatggtgatattttagccaacatatcagcaaatgttctttgctgattctgtctcccccatccccaacagtttgatttgttgttattctgcagctactgcccatgtggagtgagccacagtcaatggaaatcataacacatggggagtcttgttgccaggtagggaaggtaagcacactaccctgcatggtaaaattcactcactacagtggtaatcagctgtcaccaacttgtgacattgatgccttgcattgcactgattggtggaggaagaataggggtcatcagcacttactggtgttaaccatctgctaagtaaggacttacttaaagctagtgcaggtattcctattctctgaatttcagctgtaggactcactaatcacttaactggcagatggttgacagacagctgacttctgctgtcagtcaggaagcagtgctaggaattgaaattatttccttgaactctgatttttcttagatgaaataagcagggttctcgcttcagttcttagtgggatagagcctttggtacagtgtgtaaactctccaaacctgtttcctcctgtttaccatataaaggctgaataaaatagattttgatttctctgttttcataagacatagaattttttatgtgactgttataatcaggcaaaaatttagaacaagtactgttattggactgaaagctcctattccatctttttagattccacacatgtgatctagtgtatggtactaattgcatttatgatgaagaaattctaaaatcacagatgttgattaatttaaaaatagaacatatgcatttttattaagctgttgagttacagggtttgggcaccacttcctgattttctggcacaatccagtggtaatgagaattgtgagtgcaatgtcagcatcatgcagagatgaaattaggggacccatttgtcttttggctgctttttgcagagattcttttacacaacctatctattcctagtttagtcagacctctaatttacctggatttttctgtgatacaaacttcagttttccccagtgggatctccccgtcttatttcttccaagagaactagttaggtgattggttgcaagaggtactgtgggacattttggtacagttagataatgtgtgcaccatcatgtgccagcattttatgagtaggactgcgcttttctagaattgctagatgtaggtgtgagagaagcttgaatgttgcatatatttaattctctttaaaaatatgtttcttgtgtatgttgtgttttctactatctaaaactgtaatccacatcaaaactgcttatcaaatctcctggatgcttgcgtaagaattgaaatagataaaaaagcatctgcaaattaacatgccaggactttttctggtttctagctgtcccacttcacactgtgggaatagtcctggctccctccagcctgggaaactttgcgtggtgctttcatctttgtaacacttccttctctctcatagcaccaggagcagggcctgtttgcactgcagtgaatgagataattttccaaggtgggagtgcgatgcaccagggattagctgatatttaaagaatatgaatgaaagcagcaaacacctcaccagggcaggctgcacgagcctttgggcagttattcccttgtaggatttgaagttttattggcagctgattaggtaaactggagtcgtttgtcccctaggtgcgtccctacccaagaggagaggtggccagtaaatgtcagctgaggcaccgaaggctgcgatgcaccagcccggtgccctgtgaggacggccacatcaatagtggtaacactcagtgagtgcgagtttgcttttcagacctaatgattacttcaagtcagggattttaactttgtcagaaacttgagttgtaaaacagattggtctgctgaaaacttccctgttaatcaagagccttcattttctttttatttatttattttttatttatttttataactttttttatatatattttttattattatactttaagttctagggtacatgtgcacaacgtgcaagtttgttacatatgtaaacatgtgccatattggtatgctgcacccattaagtcgtcatttacattaggtatatctcctaatgaagagccttcattttcaatctggaatacatcactaattcttaaacccctgacctctttctgctttgatttttttacctaatagaaccaatacgaaatccaaacacttacatagtttgctattgccaggcactggtttagctattttacatgtattacctcatttaatcctcctaacagctctgaggtaggttctgttattatgccattttatagatgaggagactgaggcatagagagatgaaatactttgattagggtcacacaagctaataaagtagtgaagcaggtacttgcatccaatcagactgattctagaattcccttctcttgactgctatactgtagtgtcttcaaaaaatgtaatgcacatctcccttatttctttgcatttggtttgactatgtgaatacacatttccccttttatgggagatgtttgaaccaatgaatatgaatactatttttctgggcttagatatgttttggggggcttgaataaagcacctcatctgtgctacttgtgaattactttctagagcagcatgagttcacacctagataacatgtgttctcagaggcactgcatatactcatacaagtgaataatgtgcaatcctaggggtgccacttacatagactaccgtggtcatgatgacccctgagattgttcagtgtgcagcctgtgcaactgtctgtgcagcccttcaaaagctgcctgacagccttatttagataactttcaggaacatacagaaaacaaatatatctctggtaatagttcatgctttataggcttacctcagtgcatcgaagctacctttcagttaaaaatgtatgaatgaaaaaataaaaatatgttatgtaggaaatgtctgtatattaaaatatccatataaaagcagcagctaccaggtaaataaagaagctgttagggtggcagctgaacaatcaaactaagtacctgcactcatttctaatttagatggaccttagtagccagactatggatgttacacttaacaaaatcatcagctttgtaactttgcaaattagacactgacacaatagaatcagaaaataaaaaccaaatggaaatatttcagctgtcatttagcttgaaacaagcaaaactcactcacacatcagacttcagggcatcatggatgctctttaatgaagagcattgtggttaaaaatcaggcaacacttggaaatttttatgagacaggggcagaatactttatggatgaagtgaaacagagccctcaaactgtttttatcaattaaggatattcaatattacatgagttatgtagcatttatactacttagttttaggaaataatgagttaactggctaaaataaaaagctctctttttaaggagctttaattaggtaaaagtcaatgcttaatagcctgttaaagcattattttaaaaattagtggagtggaattcattgtaagctgacaatcttaagttggtgtggtgtaggtctctgcaattatgatggttattgacacctttattaagggaggagggctagcacggggcttcatgtggagttcagagcacacttgaattccattcccttaactgttcacagcagtgctgtgtgcatcagcagtcatcagggctgtggcagggtgtcagcaaagtgacatataaccacactctctctcgctactgtgtcgctcttcatttagtaagttcagtgttaatagtaggatgaggatttaagcatcttgagggcaggatgttttatctgtttcttgactgctctatccccagggcctggcacccagtgaaatgaatgaactgtttcctgatctgactgcatgcacgctctgtgtactcatgaggcataggtctgtttctgtgaacagctttactatatgtgatgtcttctaatgacttggacttcttttaatattgtacttatttttattttatattgtgaccttgaggccagttagccacccaggtttcatctgacagacatgtttcatagttgattagagcaattaaagttttatctattggataaaattcaaaagtcatcggccatctgtgaaaaccactgcactatggaccacagaccaaggaggattttcatcttatgaaaaacaaagaaattatattaagatcctaataccagaaggtggacattcctttacagagaatgtcttagtttgctcaggttgctataacaaaatatctcaggctgagtaatatataaacaacagaaattgattgctcacagttttggagtctaagatcaaggccccagcagagttggtgtccagtgagggctccttccccatagatggtgccttctatgtgggttcacaaggcagaagggacaaggcagctctctggggctcttttctaagagcctgatcaaaagcactgatcccattcatgaggttgcagcctttgtatcctaatcatctcccaaaggccccatgttctaataccatcaccatgctgattaggtgaattttttttctgctatgatcttattgttaacataagaatcacttcagtaacataaaatatgatattcattaagcatggtggccaagttagcattatattagctctaattagctataattgaatttttatattttatgcaattaaattgtcaaaaccaaccattactatatatattaataacacaactgtgaactttaaaagtgttagtaattcagtcttctaggactcctggattctcagaaatcatttgcacatagtttttgtcattctgaagagtgcccatttcacagatgaaaaaactaaggcacagagcagttctgtggggcccaggagttaactaacaaatgtaactgaagactcatgattccaggtattgtgttctttctagtctacagtactgtgtataccaggaatcctcattaactacaacatagtcatccattggcaaacctgagataaccagaaaaccttagttagatgtacataggtatgtaatttcttccttgctggggcaacctttgaaactcccttagagcaggaatctaagaagaaaatcaatgtatccctcttaccataggcaaaatagcatttcttaattttcaactcctatcatctgctcctgctctcacttattttgcaagaagagtcattgatgccaagtcaggccaccataatggccagttttaattactgcatctcctgtcttacactagaccttgcagaggggtcacactttactgtagtgactatagtgcagttgaatgtgcaatgtttgggtggttttacacatgttggagagaatttgtactataggacatagggtcttaaggtaaaagtgttgggctgagaatcctatgaaatatatatggcagatttctagagctgatgtcgacagccgtaatgttaacacattttcaaagcaaagaaagttggatagaagagttacgaagagaaaatattggtgatgataggggacatttccaaacgatattgaaaataatattccaggagataatttgattaggtagaaaatgcaaactcagtacactgctttcctatgaaaacagtgaagactctttaataagaatgagatattctgcttttttggaagcggtgactgagcattctgcaggatttcaaatagttaaataattgttacgccttggcccaggagtctcagcctatctgcagagaagaggtaaatattaagtacctgaagcctttgctctgaggtctgtgttgggggaggatgtttgtagtaaggtttgggtcttggggatgcattcataaactatagagatatgtgatctatgcctggaagctgccatttttgtttcctttagaagttccagagtagaaggcaccatcacagtctccaaccatcacctcaatggcatccctgaactacatctggggtgtagttccagcaactgaccagaggcactctgtacctcatcaaattgtaattaatcttcctttttcctctctctctctctctctctctctctctctctctctctctctctgacttatataaatcaagtcacggtccttagtaaatatctgaagaggtacctattaaataggaatagtaatacaggcattctatctgtacagtttatacttgttttggtaaatgactgatctcttgtaaaacttgagagctttttctgggctattcagtgtgcataatgaatattgatatcttagggctttaaaaaatagcttctttatgtaggagttagtgtgcttggagaccagtttgagaattttgaaaaaaaaattttttttaatgtcaaagtaggatttaatttaaactttagcgtcttcatcttaaccctctttcaacttctccagaagagttattagcataaaagcttaatgatttacatctgaaggttatgtatgtactgaggaaattcagtgttgattctaaatacttcttagtcatccttaaacccagcttgaagctctagggtgcttaagcgtagttcattattacagaagtaactcatcagtgaattgtttggcaaacagcagtctgtagtggtttttctctaacttaggctctttcagaagtgtctgcattttccaggaaaattatctgttcatattttgaggataaaaatagcattgaaaggacttttagtgcagatttgctggggctattttggtggtcctgatttttttttattttaaaaaggaatattaacattgatctcaccattatacttcttggaattccttacctgctgatacctgacacctttgcctctgtgggggaatttcccattattggggtttcctcaggccccaaccctcctgtctcttctgcctgccctcctccaaggcattggtgtcttcctagcttgatcatctgccccttccttccccctgccctcctttcctttttagttgtggtgaaaaacatgatacaaaatgtaccatcttaatcatttctaagtagatagttctttggggtgttttgttattgttttatattatgaatttttaattttaaaatgttcacatgtttattagctgcatctctacagccaagatctaacctacttcagggcttgggcccatgttgtccttctcactacattcaatcagtgcattcattatgtgcctgttatttccaagcactctgttttgcattcctgactttgttgagcacacagcagatgttaaacatctgatcactgagtttcagaaattttttttaggaatgattttcagtggtagaatttgaaaacagcttgtgtgagtagtcatagctcatccttttaaaaataaatgccaaataagaaatggattatcgtggggaagtctctcacttaagaaaaatcattatagagtaataccgattgagattttcatttcctttcagcaggactggtaggatagatattgtgtgtgtgttttttcttaaactataatggtgattattttcttttttaattactctgccatctcaagaatacatgtattgtcattttagattgctgggtcaggaatgaaagtttgagtgtgtttgatttcagtcctgaactctcatatattatgtttctggggagtaagcttggttttgatataactttctatttgggggattttagaagttagtgcataaaatagtgctccctttgcatggatggatgaaattttgtggtgttcaaactgttgtattagagatgtgaatgcctaatcataacagattaaaaactgtcaactatctttcatatttaagcaagttacaatggatacaaatatttcttgaaaagctagtcttttttttttttaaatgtagttgcttacactccttaggtgcacagcaaatgccagaactgccctaattaggtcagatgtttctcattagcttgtaacagtcttggatgtatggatggatggatgcacagcagatggattgacggaggatagacactttaattgacccctcgccactgtcacactacacatatataactccctggctacactgaatcttaaagaccacacataccactaatattgtactgattgaaattgctcgtttcaattcctaacagactgtctgtgtctttcttaatagcctgtgaatatctgcagaacaagggctgaatcagatgcagaatatttgtatattttatttcagaatatttatattttagtaagttaatgctcactcttaagtaaagcaatgggaaaaacatcctctaatatttactttttcttgtaataatctactgatggcatatttttattagcattccttggaattattcagtaagcatttacaaaggatcctgtatacagtagataattagtattttgatgaataaaagatgaacacttttcctaatatacctcatagaaatgtaaataaattatattgttgatattcctgtcattgatgtgacattaataaaatatcatggaagggctggtttcaattttaccattgctgagaaaaatggcaaatgcatggtggtctttaaaatagtcattgtcattaaggatttgtatattctgcttgttcccagatgtcatggtcttgtgaggaggatagaatattcttcagcaacctcttatacttttctttttttttttaacatgttcacatctgtgagtttaggtgatagtgctgtgagatacttttaggatgttactttttgcatgaacaaacagaggctaggcttagaggaaagcataccagttttttattgctgcataacagatttccacagacagtacccatttcttagctcagtggttccaagtctgccatggctcagcagggttctctgtcagggtctccagcgcaaggagttggctacacagccctctcaagtaaggccatggggaggaatctgctcctgagctcattcaggttgtcggcagggctgaggtccgtgtttcctggctgcaggccaaggactgaagtttttagaagcttctagaagccacttgcatttgtttgctgtgggccttctcaggaacattgcagccaacagcaggatccctcatcagattcctgtcagacttcaaatctctttggattcttttctgtgaccagccaaaggaaacccttttaaagggctcatgaaattaggctaggcccacccagatactctctctatcttgaggtcactgtgccacatacctgccaatcacgggagtcaaatccatggtatttactagcccagggattacgcacagggcatacaccagggggtgggaaatcctggcccctctttgaattccgcctccatggaaaggtcagttaaaatgcttgggaaatgctgccaaattcaccccagcgtttatactgcttctactttgagatgctgaagaccgtgctctaagaactctcttcttgtttaaccttactgtgtttctatgggaaagaaaaacagctctgtccttggcatgcagagatgttcttaatttacagtcagtagggctgagggtttgatgcttaatgatttccattcattgacctgtattgtttcagccaatcactcctgggccagtggtgcccagatgaggactggagccaggtgtgcaggtttgcaatgaacatagaaaccaaactgactcttgttaagggcttaacctaggttaagaacgtgacaagctaggacacagggagctgccctgagttcgagaccagaggagcaacttatcaaaatcactgttttgagcagattaaccttgaagctgtgtggatggtaagaggggagaagccagaaacaaaagccagccaggaattcagaaatgaatgctcatttatcagtggtaagggagatttagaaatgttttgtgttccttgaattgctactattggtggtggtagtgctgggaaaatgaaaaagactggggaagtctaagcaagctataagacaaaatcaggctgcttgttaggacttgtgaacacctgggtagcctatgtttacttttcggagaggccgtgtgcttgtgactttcagggtgcattgttcaggtaaattgtcaatttgtgtatgggacttgcaaatatataacatatttggcatttcaaatggtaaaaagtactatggaggaagataaagcagggatggagatagatgtatattagtattaagtgcatatcaatttggggcttttaaaaatcacctaaaataagttgttaaccagaggcacatgggttggaacggatataaatgtgtatttcacatggaattgtatttcatatttatggcatttggccttttactctcccctacctctttcaaaaagcagcattcatttaaatgaggtggataatggatctataacatttattactctggtaagaggatgttcattccttctgaataccttacttctgtctgtttgaatcattaacctaatcacatactctaattttcttaaagtcagtattcaaagagagtttggcttttacttccttttccttccactgtttgactgaagaatttttaaaataaaaaatcaaaacatgggaatcatctgtgaggctgggcactggacagggaacacgtaaaatgctggctttacaaatactcaatgtggacttctcaccacatagttggctgaaatcttccatgtttgcagtggaacttgaaatgaaaatagaactatatagctttgttaccatgggaagggataacatttaatttcatcctttgtgactcaacaaagttctgatgcaatgcaatgacagtagaaacagatcatagaaagcagtatagagatgttgagatcctgatgttttaaaagtaaacctacatagtaaatagtagactaattcaataattatttattgataacttacttatcaataaatattcaataaatatttattgaaccaggcactgttccgcagactggggatatagcaggaaacaaaaacttctgtccttgtgaggcttatatttgagtgaaatgaagcagagaataaataaatatataacatatttgcattcaaatggtaaaaattactacggaggaacacaaagcagggatggagatagatgtatatgtatattgcaggggtgggatagggtagcgattttagagagcgtggtaggcagagttctaagatggcccttgcaatgggtggttataagcctgatagagtgtggtgagagtgatggactctttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgagagtgatggactcttactgctgtgattaggttgcagtatataaaactctatcagctgactgcagtagagagtctcttgctggccttgcagaagtgaggtgctgtgtttgagagagtctacaagagaccagtaagacagctacagacatagattgcaagggatggtggcttgggccaggggttggctgtcaggtggtgaggaatggtcaggttctggaaagactgataactgaaagtgtaagatttaatgacaacttggctgtgtggtgtgatagaaagaggaacagaaatgctgactcctgagtttctggccaacacagcaggaagaaagatgctgccattaactgacagaagaaagaagaatgtggtggggtcacgtttaggagagatcaggaactcagtttgagatgctaatgacatgcaatggagacatgtagttggctattggatacaccaatctggtgttttggaaagatggcctagagatgtgaatgaggaggtcattagcatatttatggtatctaaagccatgaggtccctaaggcagtcagtatagataggcaagaaaaatattttagaccagagttttggtgctccagtaaaatattttccattattttatctcaatgatttttatgtttcattatgaacttttattcaatatttggcttaacttaaaatgtttttctattcccttctagaacttcagctcacttaaaaaatttttctgttttgtttggtatactgtattatgtatttaatggagaagaaaaatcttagacaaattaaatttaacgtaggttacttgagaaacgaattattcttaaattgggaagcccctgaaccagcacaggttcagaactccagtgctgccacatggtggaagatttatggacagaaaaaagaaagtggtgtacagaaaactgaagtgagatgcataaacaaccagatgagttacagttcagtgtttgccttatttgaacttggtttgtataggtggctgcctttgattggccaaaactcagtgattgacacaagagtagatgacagtctacacatccaattaggttacagtttactatgaactgaaaaacctttaggccaaacttaaaatgcataaggaggcagctataggctaaatttaatttaataattagatcctgaggggagtggaggcatgaaggtggatatgaaaccacaagataccacatctcctgaggagaagattctagcaccaactagaaacagtctacacccatggtagcctccttccagagggcaaacagacatataaatcaaacatctccttccaatcccagatgaacaaaatcaagcagaatatttctatacttctccctaatcctcagcttcattaccaaagaatcagtgtggtttttcaaaatggaatttatggaagacccatggctagctgggtgtaatttgctatatttcttcagttataaccgtttaaacaaatagatacacagaaataggaagatagactgtcaatgaggatagacagaagattgagactgcaagaacagagcatttgagagtaggtgggagcatagtcttgggagcccttggaaatctacctttcctgagtgcactggggccagtatgtttgcagctagaggcttgtaagagttgatggcgggagtggggagaaccatgtccctctaaagcaaaagacctctacctgtagatctttttttaatgtaagtaatccctgtagttaataaatttcttttttaggctagtttcatctttactcatatatcttaaaaattaacagttatttcatagcactttctcaggtcctatttttcttctttttttttaacctgatattagaaacagctgtttagtattgaattgcttaaaatgataagtaattctccaaagtggtaccattttttaaaagatccatacagatcatgatataacatctttgggaactgaaatagttattcttacccttgctggttccaaaaaggactgcaagcagcaacctttgagagtttgggttttcagtagtttatctactgtaatgaggacatcaacccagggcagccagtggagcttaccttgtcactgcggcgagttagcagtggggtcagagagcagcgtggtttcactgtgtacaccctgattttcagtgctaaaagtccagaatagctctccacttgacctgccatggtcatttgctcagatctgaccagcagatgtgcagtgctgaggatctggttttagcagactgtgttggaataggtttgaataggtctactcttctcataccttgatatgtctttttttgtcttttctatttggggttattttccttttttggtatttaagtagctaccactcctgatctacagattatgttttaattgattttccttaaacctgtggagacaaattgttttgtgtcatttgagaaaaacacatcaagcttttctctgctcctcttactgttttgtatgtttttcaaagcatggcattctcagtgcccttttgaagttgagtgaatcagttgagctcttatgtgacagaagtgacttttttcttctaaggtgcacgggccttgttgagagccaatcctagtcaaatgaagcatcctcttgtaagtagaacactttctttagccatccggagttacacatgggacccactctacttctagctatgatcagcattgacacctgttcatgtgctctatgcaagaaaggataaacaccctcaaatctcatgtttcatgataaaagttaacaatttgcggaaactggagagaaacattgactgtatcaaaagttgtacagttggagacaaagggattcgtatttatgccctgaagttgcagcttccagtatttattagagatgggattccacttgatgttttagtctagcctagatcaggggttggcaaactattgcctgtgtgccaaatccaaccctctgtctgttgtgtaaataaagttttattagcacacaaccgtgatcatttgtttatgtgttgactatgtctggtttcactacagtggtggagttgagaggtcataagactgtcctgcaaggcataaagtatttactatcaggttctttatgaaaaagttcactaatccctagtttagtatatataacttttttaaaaactaaatttttcagtcactaaataatttttgaataattgatacttttagcttttatacttcgtcaggatgagtccatctagaagatagccaatagtttaaaataagtgtaatttaaatatttggctttctagtgccatttcaatttcttcaggttgttaaaatctatttaacttaagcataatgtaattgtataataaagtcagactaagagagagcactgacattttatataaaactaagtattaggttgcattttcatacagcctgataacatttaaaactaaaatcttcatgaaggcataattcatgtatctgctaagtgctcccttataaattacccaagatgacatgtttatggccaaacatgaaggttggatttgctttgatggaaatcacatgagaacttagtttgttcaggttcatgtgtgcatgcatttctgtgaaaatttcagcgtttctttctggtaggttaaattgtcatactaatgcatagtttatttgaactgatgctcagttttttgtaggcttttggttgttggtgtgtgttccagtatggtaatggtgggtcccctttcccagcattttccatcccacccctgctgtaacagcaggatgtagtcacagggtctggaactctgcgtgcatgttctctctgtcacttcttgtgcctcagggactcaggtgggacgcaaggccgaaaatgaggaggccctatgtttttagtggaaatgatctgcctttctttctgtctagagctgcaacatagttgcataatgagggcctcataaatgagggcaacataggaatggcattaagtgctgcagagtgtaattaccacttgatttatttacaccatggccgaggggtgagtccactgccacaacagcacactcagctgggctccctggtcatgggctgcctagagggctctgctcctctttgctgatcctgcacttggtcactaccctccttggtgagagcaccggacagacgagctctccagggtgacctggctggggcccctcgagcacacactatgggcacagatacaaaagtgctgggcttgttgatagagtgagaattgtcagacatggacctgctcactcatgtgtgcacaaacacagggcacatttaggcagctgagcacaatatttttggtaaggctgcccttctgtatttcctagacattgggaaattagactgtaatttattttcctaaagaatatggctttcaggttttcttattttttatactgctgtgaaccaaccttaaggatccaaaatctctcaaacagactgttttaaatcaagaattccccttttctcagcctccacccttttctctgtcaccatcttaagcccctaggaaagccatgcagttcagaaatagtcatgtggcttcatggttcaaaggcacctcttgggtccactgccagcatgctcccaattctacctcttaccggttggtagtcctgaggaggttagttatctctccatcagtttgctcaactgtaaaatggtgacagtagtatctgcttcatggaattttgcaaggattaaatgattaatgccttttggcatgggaccaggcacatggaagttgctcagtaaaggttagctattcctcggctgtcgctaaatgattcacctggtgcttgtgttactttgcttcctcctgcagtccacaagggtggcctccaacctgcattgctttgacttgtcctatgtagtgtcactgagaccattttgccccttggggccgtggggagaggctattttgtcattgacatgttttagaattgtctgcatgtggctttattattgttttttacattctctacagacaatacactcccttattagttgcaaggggattgatttcaccttctctcctcttttgaagctatgaaattgctatagtgacagctgttattatttaagaagtagctggatcttaatgaaattatttaacttaaagtcatatagtgaggaaggaacagaacagagagtcaaacccaagattatttttaaagacttctttgacctcaagatgcttagctgtgagtttaagaacgatatcagagacaaaaaggaaaaaaaaaaagacaattgtgaataccacagtcatataaagtatatattaatttcctccagaaagtggctttattacaaacgtgggacaagtaaaagaaaaactggtaagaaaaaagctgaagaggcaaaaatactagttgaaaacataaagaaagatgttttaagtcaatgttaacagtgattaactttaaaataaggcctatatatgaataggaagaattattctcaggtccttataaaataatctcaatatcaaggcacaatatgacattgaaatacataaactataactgtcataaatgcatgagagattgagtcatttttttctttagatatgcatgatatgctacatttaaataagacattgaaaggttcagtggaatttaaaataaaaataattttattaggatgatcaaatcagtaataaaaccttttttaaaactttatagtaataccatatttgtaatgttttgtacaatagggttttttgaggtaaaatttgtcaatcttaagtgtacagtttgataaattctaacaaatatatacactcaggtaatcacgctaataaacataaggaatattttcatcatcccagcaaattctctcttgccacttttcagttttctctttctacctccagaagaaatcattgttctgattctataatcgtgagttagttgtattaaagcaaatggaatcctatagtaactagtgctctttgcattggttcctgtcacttagtaggatgtctttgagattcatcttcctcttatatcagtaggattgctgccttttattggtgaataatatccattgtctggctataccataatttgtttatctgttcttctgtgaatggatatttgaattgtttccaattgtacagtttgaataaagttgctgtaaatattgttgaataagtctttttgtggacatacgtttttatagatcttgggtcatgcccatgattggaattgctaggtcatagtgtaagggtttgggtaactttataagaaatggtcaaagaagctttcccattagcagtgtgtgggagttccagttgtttcacatcattgccaacatttagtattgtctttttctttttagttatttggatggctatggaattgtgtctcattatgtttttaatttgcatttcccttataactactgatgctgagtactttttcatatacttacagatcatttgtgtttgtgaagtgtctgttcaagtcttttgccccctttttaagttggattgctgttcttttgttattgatttgtaggagtttttttttttctggttaaaagtcatttttcaagtatgtgtattggatatattttctttcgtctagttttttcctttttattttcttaagtgttatttgatgagcagacattttaatttttgttaaagagcagtttattaattctttcaaaacagttgatgtttttgcaactctagaacatttttacctactttaagtttgcaaaaatagtctcctgtttgctctagatgctctatagttttagtttttaacttttaggtttgtgatctacctcagattgatatttttggtgtgaggtaagggtcagcgtttactaattttttttaatatatatccaattccttcatgatcatttattgaaaatactttaaatttttcattgtattgtcttagtgcctttgttaaaaattgattgtattatatatgtggatctatttatagtctgtttcttgtcttttattgatatgttggttcttattaacactgaaatgttgggattacagtgtctttatggaacaattgagctgtcctctgggggaagaggatactttcttatcagtgggaacacaggcaacctacctatctagattcctcaccgtggctcacatttccacaaaatgtgaaacatcactaatgcatgattctgacattgaattttgtaggtggaatgtgttatgcagttggatgacttcagtttgttcagatatgaaaaatttggtgcagtacatttcatttcactgcaatttaggtcagggaataatgctgaaaagaaatatgtatgaaggcatgagtgagcacagactacagagtggcccaaaactaataaatcagaaaggaaaatagatgaactgaaattccaattaatctcacacaaccaagaccagtgagactgaccaatactttaagtaacagtgctttcgtattatttttcttggttgccaatggagtattttttttgctccctaacatcttccccagcagcacatagcatacagtatattttgggaaacgggaaattattttgcaaaaagtaaaatgacagggaagaaattctctgtaaatttcattgctgaaaatgaggaaattttaaggaaagagatagttacaaaatgcaaaaagatctttcttctctgtccccttctctcaacctatcccaagctgggatttgaggaaagaaacccttgcccaccagtgcagggccctggctctgtcacctagggcctctcaagcatgagagctcaagcattagtcctcatcagcgagacccaccatgactgatggaagagcaaagcctgtatgattttctgctttctttacccagagaagccaggatccactctgttctgtgtggatgagctgcaccaattaagggcaaataaaattaactgagagcaccccctcccccaacatacacagtataatattctcagtataagagaacaccagctaccatctttctaaagcctggcattgatttatatcacatgttcaaattgtttctattcaacgactatagaaataaatgtgaagatcatgcttaccctttgggagaagacggttaaaattataaaagcttctttggtctgtaaaacattgaaaataccatcaagctatcaggtggacagttcctgttgctgctctcttgacccctggaagggttttctgctcatctgtcggatactttgtgccatttcttcctattacagaatatttctgtggcgctactttaaaagccttctatataattgagtatgcaaaccacttgtgtaggcttgactcagactttatgataaaaaacattcatcatatgctatcccctataagaggaatttaaactctcctcttcattagaaggcctgcctgcagtggaattaaaatagcttctcctgaaagggagcacagacttggtaaagatcatgagcagtcattcaagaggaatgtaatcgaatacttgaaatttaaattagcttgtaatctgactttgaaaataaagtacaagagagacccaagaaagtttcctgaaggtgaattaatgtccttcacaccacttccagtttcagagctaatagcatacacatgataaaagtaatatagcagtgaaacttatctttcccatgtgctccttctcccaggtcactgatactgtgcttagaaaaggtgccctacatagagagaacccacatctgcaaaagcagctttcagacatcaccagggatttacactcttctagtaatgtttggaggaataacttctttttattgggtccataaagcatacattgttaacccaagaaagagaaagaaccttaaataagtgacacagattttcttctttatttagaaactattctgatgttcatatttttaaaggattctttctcttcaaataacttttcctcattcttgaaggacacgatacattttttttctgttaaaatcatccagtggtaaatgctgcagcagactgacacttctgaaatgaaaaaggtcccatggttgttgaggctgcctttagcaaaattatataatgaaaaattgtttctttgctataaaagaagaccatggaaaagcatctctgcatatattattgtatgtaaattagaaacaggagaaatatagggaatctagatacagaaaaatcatcactgtttatgcatggcgtaacatttctaaaaagaaattgggggtgatcgttttcaacagaagaaaagtcttagctttacaggtaattacatactttatagtacagatggaatagagctcagtttgcttcaaggcagatttctgttaaacagactccatttgcacattaatttctattgtggaacttaaaaaattggtctctagatataataaaactacctttaaaatatacatatataaatggaaatatctttctgacaaacccattgaaccattatctgttaatgatactgagctatgattcacagatattttgtactgtggaagtaaaaatatagccaggataggcagacacactgaaatatgattgctttgctttaccttattttaaactcgattcccactatagtggtaacaatccataaaatttcagaaacttgccaaggttcatgtcaatcttgaatcatgctaatgtttctaactttatatccaaagaaattattttccattttccccatcacttaaacttattggctgctttccagacatttgaatctggccatatcttccaagtatataagaatatccttacataaaatgagagaattgtccaaataaccaaggaatgaaatatctgggccttccttagcgatgaggacttgtaccagcgccaacagaggctttccctaatgtctaataataatcagcaaattggctgacaattctgagctgaacttttgggtcctagcctaatggtttgactgatggctgggaatggttagcacatcaaaatcctgtttgctgaggctgctacttactagctggttaacaaagctgagctgcaccatgtaggcaggcagtaggccagatcagatgaccagagcacggggcataagaatctcttaagaccgagactttagaggggccgctcatgaaacatttaccccctccagtttttaccttttccttgggtggaagtgggaaaaaaatacaagtttttattaacaatttatattcagtgttagtaatgacatagtagaaaaattaaacaattcagacaggttgactatctttgccatgcaaagataaaaactattgatgctgtagcatttgcctcagacctttcctatgtgtatactcaaagagatacagcatatgtttatacacacagagactttaacaaaactgagtcctcatacatcatttgaaatgcttgaaacaagaagtgttttgaatttcagattttttcagattttgtaatattttccgagaacatactgcttgagcatccctaatctaaaaacccgaaatctgaactgttgcagtaagcatatcaattgagcatcatgttggtgctcaaaaagtttttgatttgggagcattttggaaccttcatgctctacctgtatacattgatttataacttacctaatattcagctatattttcatttggtaaatattttcctataataggactttttgataactttacaatgttctattaattttatttatatgctatcatttatttaactaatttgttattgtcaaatggtaagattgttaatttgtttttgccttataaaggtgtattagtctgtgctcgcattgctataaagaaatgcctgagattgggtagtttataaagaaaagaggtttaattggctcatggttctgcgggctgtacaggaaggatggttggggaaacctcaggaaactttcaatcatggcagaaggcaaagggaagcaggcacatcttatatggctggtgcaggaagaagagagatggggaaggtgccacacatttttaaacaaccagatcttgtgagaactcactcactgtacagtaccaagggtgatggtactgaaccattcatgcgaactccacccccatgatcaaatcacctcccatcaggcctcacctccaacactgggaattacaatttgacatgagattttggtggagacacagacccaaaccatatcaaaaggataccatggtaaacacctttctctaatatttttgtacatatcatcaattatttcatttttggggcatgtgatcccaactatttccttagaatgatatttccaaaatgaaatggacaggggtaaatgtatacactttttttttttaatttcaaaagttattccaaattgcctcatggaaaaagttgcgcttagttaagtcccagaatttctagatattattaacaaattcttaacagtataacagttttcatctgggttgtgctcagggcatgaggcatgtatttagggcatgtatttatactatatacatctttttcagggagagtgtcagtttttctagtatcatctatcccttggcctggatgttttaattttgccatcatccaagtggggagaatttagatgatgtttactaagtgctaggcactccctaaatgctttatgtgtacattaactcatttaatccacacaacatcctcctccaaatgttccagatgagaaaattgaagcatagaaaagttaagtagtttacaaaaggttaccagctagaaagtagctggtttgcgataaaacgtaataaatggcatagaaggagagacgtatatggtgatatttttctaagaagataatttccccctaggaatgtcatttaagatataaccctcgaagtttttgtatgactcttatcgagacagctatcctttagcctctactaattttaaaagtttcagaaagaccctagatgaatttcatagcaaatgatgttctttacttacatacttgtttagattaaagtctaatctttcaaagtgactagtgttgaaacataattatgaacattcacggcatgcatacttgaaattcttgcatgaatctttttttaaaaacagcagcatgctttacccgtgcaaaattatatgccttgattttggacagtaagtgcagagatgcattaaagggctggtgatggggttgaatgggactacttcaaattatcagaacctccatataactgaaatggtagacattacgctttagaagacaaaactgaaatttaggatatttgctcatgtattgttacttaaaattttataggaattattccacggtccatgtagaaagaatcccaggtactttaggtagtacagagatgaataatgaggtaaacactttcataacctagaggatgcctattaacatccgaaaacatggtatgatttgagaacagaagggaagctaaagtcttaggatgacttctgcaacagaattcatagctctcattaaacaataatatctatttatgattataatacctaattattattaggttgtaatatgtcattattatggctttattatatattagattaatcatatccagttactatgcccatgggatgattattaataatttttgtgtgtaggaatgaattgagtgttaggaatgaattgagtctggagttgctgagcaagtcctgtaaccaccctggaccatttccgtatctgtaagtgggaaggtaagaatacctacccaacagcattttggggattctcaaagcagatactatatgtgacgtttcctttgcaattttaaagccgtgttcaggtttagtcattggcattgttgaatctgtctccttccctggtttggaaggtccttgtactcctcatcctgacacagcatttggcaaatgataggagtaaataaatactagttaaatgtcattatgaggacagggaggaggagccgtgatgacaaggaagtatatgagaaccatgttctggccccagcatgagagtcctagtaacctctttaattcatgccccttccagagcctcgtagtaccccgcccccttcaccagtactataaaaagcagatcatttgaggaagaacaaaaactaggctttgagaagacactccaagatgcacaactgacttctaaaccgagccctgcagagaagactcgtgcagtctgctcagggtttttgtacccagcaaggtcattgtccaacactattatccctctcagcgggcgacctccctgagaactcacactcggtgttcggggctgatgcgcaggtactggggagatgctgaggacctcttcaggcagtgaagctgcctcatggcacagggatgccaagtgtctgtggaggagctggggccagggctgctgcccatggcctttggagcagcaggagtgacttccagcagccagtttcagtctgttccaggccatccaggccacagctgagtaagtgtctggtatgccacactcttcacaaaaaaagaaagactgctgtttgagtgtcaggaacagaaaaggaaggggcacaagctccccggactcttgcccgccagttgtcttgcccctggtagccagaaggagactttcacagcctgggtactcttttcttttcctcggtgtggggtgatcctggtggctccccggacctggcttgcgttgactagggagcggatcgttggtttctctgcctgcagtgacttcatgttgtggcttgaggtcccctgatagaaatgctgctcagcactcagccctccaagctgccctctactcatgtgggctggggcccaaggctcctgctggatcacagctcaaacgccggtcctttaacatcagccgcaatagccctacgtgcagccaagcctccttctcaggccctggtgctgttcatcagagcagaaacagctctccaggacccttctccttaagatagtgtttgaccagcaactgaaactgagatacttcctgccagaatattatgatctctctaaagttacctggaaccctggctttcaacagaatcattttttatgcgtgaaccctaacttttttccaaggggaaaaagctgtaacagttgtaacaattctatgtgaaaattctggaaacacagcctcattttcagtctccagggttagagaatgagaacagaacttgaggaaatccatgcaatgaggcagacggtttctgtagtgcctgctcctccttgccagtacagcaaatgtaaaaagtacacgtctgcattctgtgagccaggaagagtagatgagggtttcgacttggaaggtaatgggaatctacaaagatctagaaggagagaagctgtggtcagaccctcagggagcttgagccaaacaaaccctttcctcctctagtgtgtatggttgtgtctcctccttcctcctccatccactgccctctgccagcctctccacgaccttcacagctcttgaatatcttttgccacactccagctgaggaagccagcaaacctgcttcagacttagccagatcctgcacccctctcatgtgagcatcctgtgctgagctgcagtttacctgatctttattgcttatttgttaatcacttaatgagcattcccacattacaacagaagctcctttaggaatcagaatgctctgttattccctacagtatttccagggtgcagcacaagtccttacacatagtaagggcctaacatgattcactgagtaaacaaatgatttttcagaatcaaaagtgtgttgactgaagttcaaagacaagaggactcattccagaggttgtatacataggccccccgcagccaagtggcaatgagaaagattcccaatgaactgttactcagttccaaaacaaatactgggtctgaacatgttgaaagataagacccaagaaaggacagtagctttcttcttttagaaagtgtctgtttaatgtcttctactaaacaggcatgaaacaaattaattaaacagctttttcagtgcctattttgagctagcagtctgttaaattaagaggaaggcagaagctgttagatgtttcctagagaaatgcctggaagtgttactagcctgtatcctggcagccttcagggagctgtgccttaggccaaatctctgaagccaattcctcttggagtttttacctcctggtaatggtgattgcactctgataattcactaggatgatgcttcaaggtagcacacacagctctcattttctttagccaattatctccatcatattttttcagggtttgcgtatgtgtttgcattccagcacaagttttcactcttgaatttatggaccatgagtttctgtgctttcccttgaagtttatggtccatgtcattcctttcactggtttgtttcccaacagtttgtggtacacaaagattggaggatgaaatgcccctttgccaatagtcctgtttcttggctactaattaatctggttcctcagagcaaatcataatgcctcttgagcatgtcagctttttgtaaagttttttagctaaaaataaaaaaaaaaaaaactacagaaaagggaagtttgcattttatctttgatctttggaatggaatttgactggtagaacatacccacttgtaggaaatatgaaaaaaaccatttaacatttacagatttgattagatcagctcaggactgctaattctgtagaacacattgagaagaaagaaattaggggaaaagaagtagataaacaactctcagaacggagagttgcatttgactggctgacttctctcccttttcaacataaatttgtcattttaaatttaatccaactccttctaattaaaacttttcccaatttatattccatagaaaacatttttaaaatttatatcattaataaaaataattagaagcccttaatttcctgaaaatttatttttaagatagctttgtatagaatcaagtgaaagtagtgactattatgtatctaaaaagaagtaggggaaataatttgccttataacagtgaataccaataatggttctgtgtgattaatcaaccctaccattagcttctcagccttcatggcttcagaatagtatttctgacagaactgtacgatggagacatgttgaggtactctcttgagtgctgtgatgctggaaagaaagggagacaatatggagtggttgagatcactactactcattagagcttagtatagagcccagaatccaccctgtgccaggccctgtgctaagcacttacagctcattggcagtaactcttcgaggtggctcctatcattgtcttagacacagaaatgcagttacttgcccagggtcacagcgctaggtaatggagatccagaactgtaaccccggcagtctggctgtgagaacgcatgtttttcacccacgtatgtatcacaggatttggcttctagaagtagtttggccgttcagttgtgtagtggccaaatgtgtttaatttttccttttacaataacttctgagatcccttttctgtcccttataactgcgaattaatcactgtagtcaagattatgatttttgacaccttgattagcacttttccactatagatagaaatttgcatggtatttccaactatattgaagagagattaattagcactttatgacaaatatgtggcaaattgttaattagggtaaataaagtaagactcagattttatagcaccactattattttcacagtatcgattttattatttattcttaatgctggaatctgataagcttaagtaagccgatagtgctatacattgatttaaccactctttgtttctctagatttgaggaaaataagaacacactttaaaaatcacttatagtttataaggtgacacattaatcctcaaaatgacaggaaatcgagatgattttgtctatgaggtttaatttattaaaattgaattttctcctgtgctttgctccaatggctctgtgctagcaaaccagctataattagattagcagcctgctaaacgccggtgacagcctgtgtctcagagagcatgtgctggattccgcatgtgccttttcctcattggttggtggcgttgctgctcgcccgtgtgataggtttccacagtaatctttatgctgcattagagacatagatacagaggtgctgtactgtgttcttgcaacggtggaggtgctcggctggtaacgttaaagaaggaataaggcgcccgacagaaggcgtttgtctttgttgtggagcatcagcgttaaggacagccggctgctgtgggaggtcagtgaaggaggctcagttcatggtaattacttaagtctgtctctcacgaaaaacacggccatgcgtgaaatgaagtatgttcatcgtgtcatctgtttaatctgatcttgctttgttaataccatgggtactccagcattccatatgaaaatacattctcccgcaggcttgcctggtaaacagctaccctgtttatggtattcaccaaggaataatgtttttacctggattcaagagtgcatgtgtgtgcttgggagtgatgcttaccgactcgcttctgttttggaatgcccaatgttgcatcaatttgggtgtctttgtaggtgtgtttcagtacccagtagactttgtttgcattgagtccacactgtcctgaataatgagcgatcaggaagaatttagtgaaacacactctaattaggacagggcagtgactttcctgatgttgaagctgtgccttagcagaagtaatgtgctattgtttctttaaagatgtgtgcagccttcattttggatggttttctttgtctcaccttttgtagtttttattaagccttttgaatacagagagggttaacatatcccattctgccagagatatttaaagtgtatatttagctgtgcttgaaagagaaattttcgtctcatggctttgtttagcagggacattgagttaggagttgaaacgaagtcgcaggaaggtggggttcttaccacttactttgtctactgtttgacaacatttttatttctattaattttttcctgaaaattgataatcttaaataatctgggattaaaaaaaatggtacattctaaaagaaaaatatttaaatgggcaaggctgaggttcaaatatcccaaacaaatgcagcatgagtttttccttctcagcgtcccttctccatagtgtcgtattttataccaaaaacgcctttgtttttacttattcatcaaacttaaaaattgatgtccttcccatatcagactgtagagtccacagaaacttgtgtattgagtcaccagtcacacggctggctgccagccaccacgcgtctgctgtcaccagagccttgctgatctctgaaaaccatcaggaattatttctctgctcctgaaaaactaaacgttgcaattttaatgatttgttcaaatacctgctctgatctagaactatgttctggttaaaggggttctgtactttctttgacagagtaaacttccgagtacttaccaaccgtgcctccctccccaccccacatttcctttcaggtccatcctggcagatagtaagtcatccagtacaaaatgcatccaaataacatttttaaggggaaaaaaaggaatattatgaaagcttgccatgaattgtaatagagtatcgtctataataagaaagtttgatagttgttgcttgtaatacagtgtctttgtgacttgaaccagctggcggcattctcaggttttagacaccttgtgtggtgaaatgaacctgggaacagtcgttctacttcacattccacttccttgatacaaaccacgcctgttcccattgcagaagggtgcgtatcagtagcggagagtgcagtttcagtgagagtggttttgctctttccagaagtccaggctcctctctcgtttccctccctccctctgcctgctgtgctcttctatgtggatgtgcagaaaaacctttctgcgaatcaacagttaggcttggacactcattttgggaaggataaattggtgtggatccatctcgctctctgtgtgtctctctatctcctgaaatgctccctaaattgccttagtcttaaataatttccaagaaggttttttccactgtgaaagccttgggcacacataaacattgtctagagttccttttgggcagagcccctttgaggtgtgtgtcatggaaagatgtaggaagtagctctaagtgatgtcaaatgcctagggctgggtcttaaagactttctgtgtggaggaggaacttttttaaaaatttaaatatgaatgtatctgtgtactgtgtaatgcaacggtattatgatatcccaaagggacttttaacatacaccaaagaggcttctttataacagaattaaacaagtgttatttatgtttttgcaaagtaaccaaaatatgtgcttttattttcagatgtatcacgtcttaactttttaaaaactaaattaaggagactctttacatatttctgtgacaagaaaataaaaagaaagtttttggacactttaaaatgttgttctttttcctcgttaaaattccatagctctttactgatgacatttctgaccaaacaacaataggtctatcagcataaacatacatatcatattttaaaatcaaaacattttctgttataagggatactttctaatgttttctcctgaggtctcaacaggaaaagtggtcaccagtttaaaaactgaagtcattccatgaaaaatatgatgtgccgcaaagtaactgggctgaacaaggtgtggaaaatatttgtgaaaaggaaagagaaatgggtagtgcatgatattgcatgtaagagtttccatggcaatatctataggtggatttgtggctggtcacttggcatctgtcataatccaaaaacctgaaagatatttgtcattagcaattgataaatatttcagggttgacctgttaaagttgccgggattggaaaaatatgtaaagagatattaggcctctcatctaagtgtagttatttttcactgtagtattccatgatcatggacacttaaccatatgctaagctctgtgctaagctttatcgagagaaaatagaaggcacagtcccttcctgtaagaagtgactactgaggaagagaagcagctaaattaataataatagggctgcacgaggcagacagagagacatagtttggtgataccaaggaggggcaaccagttttttagaaagggggtgaggagtgccagggagggcttcaggagaagagagatggtacccaatccagaacttactatttcctgcccatcttgacatcaccttcacaactcagcattaagttgaagctggcatagcttcatatcctgtttttatattttttattgacttccatacatgtaaaatatcatttctcttctccctgctaactcttctcagaatacacattaggttgttgcatggaaatatgttaatagatttacatcatatgggaattgaagttttctttaacgtatccagaatttagaaatgcatcttagataaatcaccaaacactttgattgctattatactcttaagtaatttagtgattacttttggaactgtttgcattggcaggaattgtcatttcctcttggctgcatgtagactcctgaaagtcatttctcttctatgtgctcattaaagacaagcttgtaaaatttgagactgtattgtaacacttggatttcaccttgaaggcatctgcttttgttacacatttaattggatttaaattttaactcttgacaaatttggagggggagtccactttaggggtcacctgtttgcacaagatcttgccaccagtaaaatctctacctggaaacagatcttgcatttctactcctataggtcctgcggtcaggaaatcctcctaattctgtcatgtgttaccctagcctggcttccacacttactttttcaaaccctgtaaaatgcgcaggctttacttttcccaccctccggaccccaccccactgcctaagctggatggtagtcccttagagcagctctctgacccagcggacctccaggacaggaaacaattctcctctgttgctctcttaactctaactctggtttgttttttccctgtctcctttgctacccccctgtaagtagctattctccaacgctctggccttcatcagcttgcctgtccatgccacctgctttccatcggtgggcccgtccattgccacacagtgtccaccaatcccccacactcacagccacaccaacctcctgtgcctttgcacagcgcggagaatggcactgctgctccccctgctgcctgggatgtgcttccccagagagcccatggcttgttccctcactgcctgcaggatttcactctaatggagccacctcagtgggacattctgagatagtatttactgtatttgtttatttctttagtttcccctttctggaatataaactccatgagatcagaggtttttcgtcttaacccccagagccttgaatagtacttggtccatagaaagtgttcagccagtacctgttgaatgaatgagagaattaatgattcccggcatgggggtgctacagtgcagatgaacggtgctcctggggcaatcaagagctttgccccagccagccggagtggtgctgcggagcccctcaccttgaatgggcctcagtttctggttctgtagatggggagtgtgtaccagggactctgaggcccctttaaactcttatcactctttcacagccctggaagtaagatatgatgccacataaaatgttatttatgcaactcatcacaacttgatactatattcttctttctgcataattgctatccatggttaaatgtctgttttaaaaaagaaacaatagttgaagtaaacaaaatagtttccaaatgaagttgtaaaaactaatgcattttggtgtactgacatgtttgctgtcttttttttttaatatattgatcagtttctatttttattatttttgagacagagtctcgctctgtcacccaggctggagtgcagtgacatgatctcagctcacggaaacctccacctcccaggttcaagtgattcttgtgcctcagcctcccgagtagcaccaccacactgaactaatttttgcttttttttttttttgtgtgtgtgtgtgtgtgtgttttgtagatacagggtttcatcatgttgggcaggctggtttccaactgctgccctcaagtgatctgcccccctcggcctcccaaagtgctgggatgacaagcgtgagccactgcacccagcctgtattgactaatttttaaaagaattaccactgtctgttgctaaatgtatttaatagcttgcctatttttatcaaataaaaaggcaataacaatcttttcttcctttgatttttagcaatttcctgctgcagagagcattttaagaaaggacagcattcctgtgacctctgcctaccatccataaaatactcattcccctctcaggtaagcatattgctttgctttgatccattctgagaaggagatattgattctctacgaaaacctgtgtcattattgcactaagacaaagaagctgaggtttcagatattttgctgtctggcaataaataaataaataaatatttaaaaaataaaataaaataaaatccccaccttttgaggtccttgccaggaccaaagtatcggtgatggctgtttgccgttccaaggggtttcatgatacaccttctacatatcagctagttattagtttgttaaatgctgtgtgctatttatcaggtaatctcccaggagtttagaagtcctctgtgttttaaagaaaattttattttttgtcaatgatggggttttgccctgttgcccaggctggagggcagtggtgtgttgctcattgcagccttgaactcctggggtcaagtgatcctgctgcctccacctcctgcgtaattaagcctatgaatgtgcaccaccatgcctggctaatttttaaaaattttttcatagagatggggtctcactatgttgcccaggctgatattaactcctggcttcaagcagtccttccacctcgccgttgcaaagtgttgggtttacaggcatgagccacctggcctggtcagaagtttactctctgtgctcggggaatgagatggtggtgcagggtcagcagcaagggcactgggagtgggtgacccgcagagatctttgcaggctggccccttaagggaggcagggtcaagagagcagaacttaaattccagtccaggaactgagactgaggaggtggagcatctttggaggatggccgaccagcaggcctgggaatggcagggtgcttttccccacgtccccaccactcccaggactcctttctggtccccacagctgatggagagcctgggaacattttttccaggtctcttcctacagccagaccatcttccaggaaagagctaaggaagtggaagaatggtggggtcaaagtacagatgattccctcttttatggagggactgagagctcaataacaccaaatgaggaggttagaaatgtttaggaaaataaagaagctctccagttacctcatttccaccatgagttgaagagtgtaaagagcaaccctcaggagaacagagcctcagcctcagtgcccacattctgagtggccccatgcttggatttgattgacagccttcctctagcttcctttctagcatccatttgtaatgtactcttgcttatatagtaagccatgtattttgtaatttattattactgcattatgcaggatgttgtcgggtgatatgatctcttttctagaacctaagaatctaacttaggctgacaaataagaatcaacctgtgccagacagaattctgcaatatgtagaaacaggaattaaagagaaagccaacaacacccctcagtgctataacctgaagtctctcactcttatcgccatcttacttatcttcttatctcagatataagaagctctgatacgaaagccgggggctcctgttggctggaaggaggtttgcatctgccatcgccagcacttgcggagctgaggttgtagaactgtacccgagtgcaggtgtacttagtggggaatactttccaacaggcccatgcttttcattctgcaccatcctagagagctgaggggtttcctaggacatgggacttgcagtgctagaactgggaagtcagagcaagccaggacatgttgctccctcttgtgatcccaccacccctcctctctcttgtatgtggctgcgtgatgatctgctcaccaggatggctgctgactgcagttgagtttgcagccctagtggccagggaagaactacagagttgagtagacctggccttcacctcagctcgtctgcttagtaaccagttggatggactgggatggtttgctttatttctgtgagcctcagtttctcatatgccaagtaagaagaacagcaaggcagtgggggtatagggaaagtaacaagacagagcaatggagatacctgatatagcctaggtacacaagaaggggtaggtccctccccccatcaaggcaaaccatccagagaagacagtgagttaccttcacaggcataagtaactggcttgagctttatcagtactattatttacctagatcaggaaagttagaaagaacttagccatgtgacttaccaacacagtgtcagttgggttgcaggcgtaaatcctaaccccgatacctaattcttaaataaccttaagtcaatgtgtgcaagttacttggagttgttttttatatcagttttcccataaatagattgaaacatttttaaaagtgctttaaagaatgttttgaaaagcataatttgtttcttatctgtatccaaatgtttttaactttcaggttattattgcatttaaagtttattaaaacatttttctttcctagattcttaaattacagataagcagccttatgaattcatatgcattattatcgccattaaattttcactgctctcaatatgtgagtttaagattactttgtttttagagaacacactgggtctttttaaaagtggctccttgtttaaggaaactaaaaggcaaatgaagtcatgaaataaaatgatattgtaatgttcttttggtcaaaccttttggagtttgttcatcctagaatatgaaacgtcctgagtagtgtatatatgtaagtcatttttaaaggaatacacaaacaccaatttctatgcattatgcatgtaattacaatttcaggaaataagcttgaagacttcctttgttttttgtttcttgttatcttattcaaacttaagtaattgataaagtcagtttctccttgaaggtttcctttttcaaaacttctctccagatttttgcctttttttttttttttttttttgagacagagtctggctctgtcacccaggctggagtgcagtggtgcgatctcggctcactgcaagctccgccttccaggttcacgccattctcctgcctcagcctcccaagtagctgggactacaggcacccgccaccacgcccggctaattttttgtatttttagtagagacggggtttcaccatgttagccaggatggtctggatctcctgacctcgtgatccgcccgcctcagcctcccaatgtgctgggattacaggtgtgagccaccgcgcccggccagatttttgcctttttaatatggtgcgtgctagatacttgagaaattgctcagaacaacaacaaccctcgtgcatttattttgcatgttaaatgggcctcaccaaaaatgcttgctggttttccccagacaccttttttttccaactcggtgtttcctaaagctggtcctccagaatgagaggtttgtaccttgtcaatgactcatcatcctctcatgccagcacccctgacttttgcctctccccagatcagctgtttgccaagagaatgactcagagatcagattccagcagtacagtcaggtgtggctcctctgaggccatctcagctgaccttgagcaaggtcttctcaggaatcaggagagtcggcacgacagtgagacccactgtgccgggagccaggcttgctttctgcttttttaaaaagaggaggaggaaagggcattctctgggaaaagaagcagggattttagatgttttcttttacttattcacaaaaattgtatacacttctctaagggtagatctagggatagtctccctcatactcagaaggaagtataattctatttttgaggatttaacacacacttattgtgaagttcaaaaaattattgattggaatttaaattatcaaattggcagtagggtgttggtggcttacgcttgtaatcgcagcacttttggaggctgagttaggaagatcgcttcagaccaggaggtcaagaccagcctgagcaacactgtgagaccctgtctctacaaaaaaaaattttttaaattagccaggtgttgtggcatgcgcctgtagttccagctgcacgggaggctgaggtgggaggattgcttcatcccaggagtttgaggctgcagtgagctacgatcatgccactgcactccagcctaagtgacagagccaagaccctatctttaaaaaaaaaaagagtaatttgacatattaaaattttttaaatcaaatgtaagacagattctgtgttactacctgcatagtttattagtggctgttataatagaaattgtgtaattgtaaatgtagtcactgttttcttacaaagatcagcagagaggaaggatgggctacagttatgaccatggactgtagaaggactgccctgtggccctgtgctggagacgttatgtgcagttttcacttgcccttcagagaagcattagaatcttcagtatgtagatatgggatatatgtaatatgggtatcagaggctaaacttcagaccaaagggcaaccatgtggttagacatacactgggtataaagcccaagtctacccaaggctcttctatcaaacctctatccagcccttgcacaccagttaattgctttacaatatcagggtcatacatgcaacaggaaagtcggttgagggaagtcggacaatggggaaagtagaatggaaaggttacaaggaaacataaatgtctggtggaatattagaatgatctgtagaaaccatgaaaatcttcaatcagctagagtaggaaagaggccaaaaaggtcatacaaagagggaaagagactgttaggaggacacaggtgaaagagaggagatttaaacagtgattgcagttgtgccaggagaaaacctagagtttccagaccttctcactttcttttcaacctgtaaatcatgtgctaccatctctaggtgtggacgcagaaagcactcatgcattctgagtactcagagaagttcagagagatgtgatgcttgccaggaccctgtgtttagtgagcactggagtgtcctctccacacaggtttccctcttccatagcataggataaaagaatgctaaatattcaattctggtatcatgtgtgtgtatctatgttcagagatgcgaccaaaaacctaaatatattcctaatctgcatttcttctggaaattcctcctattcaccaggggagcaatgctgccctctccttgcatggtctttaggcagagcttcacagagcactggcccttcatgttcctgaaatacttatgttttgcctttacttgagtcctatgggtctagttctctatgatacatttaaaaccaagctccacatcatccttggtcaaaaagagacagctttcactcaccatgacagtcagtggagacctttcctctgggaagaagcctctcaagtgactgtcccttactatgcctgcctgttcaggtgttgagccctgctgactcctcctcgagggctcatgcctcagcacagccctcttcatcaccaaacaaccccattactgacttagccctgtgctggtcacctgcctctagtttctgctcccacaccagtccatgtaagaggcagaaaattctttttcttatttttattttttgagacacagtctggctctgttgcccaggctggagtgcagtggcacaacctcagcttactccaacctctgcatcccagtttcatgcgattctcctgcctcagcctcccaagtagctaggattgcaggcgtgtgctaccatgcctggctaatttttatatttttgataaagacagggcttcgccatattggatacgctggtctcgaactcctgacctcaagtgatctgcccacctcagcctcccaaattgctgggattataggcgtgagccaccatacctggccagaaaattcttttacagttttcatcctgttacttccctgctctgaaacgttgtttctcccagttatctgtctactaaatttaaattccaaagccacctctcatctgggctcttctgcttactcaaagtcagcgtctgttattctgctcatgttccctacacacctggttcctcagagcttgtgggctgcgtcttgcccgaaatcccctatccattccactctcttaaagtccaagagttcctttagtgcccgtttcaaaagttactttttcctttaaaagcaatgggttttttttttcttagaatctaagaatttttgccatttattcattcaacaaattcataattcatgcaacaaatttcttcacaatttaatgtataccatgtgcatttatttataagtagtcttggaattattctttgctgtctgtgagggtttatgtgttatctcttaaattgtatgatcaatttatttaaaacttttgccttcatcaaagaacctaggctcttagatgctcaaggggatgaataaataagccttgccctcccaactcttctgtacagggagctgcgagcacatgggctagggttgaaatcctagaggagattgtagatggctttgcagcatcagcgctattctatggactgattcacttcctgaagaggaatgaagtgatttacccacccaggaagcctttgtgaaaataaaaattttcatcaacaacacagaatggaaagctattgtcagttcttaactgcctatagtagagtgacgtcttaatgggcatgtagagacaaaccatctaggggaaaataactgcatctcctctagaaggcaaagcagccccactgacagcagaagaaggaggaactcagtctaaactgtgaagaaccagttcagattctccctcccatgttggcttcttatcctttaatcaccatttattcatcatttacattctatgtcctcagagttccttatgactgtgagcacatagtcatgtacattctttagtctatgaggacattaaaggcacttgtgaaaatctgatttaagttacagtaaaatttttctgtctctctctaatagactataagcaagttgggggtaagaattatgttttaactctgaatctgtagaatcgagcacagaatatagcaaactacagaggataaagaaatgtttgtggggctgggcacagtggctcatacctgtaatcccagtgctttgggaggctgaggtgggaggatcatttgagcccaggaagtcgagatcagcgtgggcaacacatctcctcattggtagatgtgagacccccatctccatttttgtttttttttgttttttttttttttaaatgagcatggttgcacacacctgtggtcccagctacttgggagcctgaggcgaaaggatcacttgagcctaggagtttgtggcttcagtgagctatgatcatgccactgtgctccagcctgagtgacacagagcaagaccctgattcttaaaaaaaaaaaaaaaaattaaggagatgtttgtggaatttaatagactgaagttttttgtacatatgaaggaaagtcactgtacgttgctcatctatctttttgctcactgcctctcacaagctctgacagcaacatcttcagatataagacacaacagcacagggcttagcagggctggaagcgctatttcactgaaagaggggagacacagtctattgctggagaaagaaaggcaaaaatgaagtcagaaacaaaagaggagaagaaacagaagaaactgggttatttatgtttagttgtagttgaacattatggtgcagaatggtaagaacttgggtgaaactttaaactagtcaaagtaaggaataatcaaggcgtaattagctttattcaaaggctgcttgaatttggtctcctcaactgcgtttaaaatagggttttgtttctagaattcagattacatagtttatttattcattttttaaattttgctcaaattgattgttccctgtggactcacagattcaatattcagagattcaattatttgtgattgtctccacgttcactacttgtgttaattccgctatttcggggaagtggcacctttaaaagcccacactccagggccaatgaagaatacagaatgcaggccactcccaccatccacgcctcccctgggcttcgtgttctgtatgttaattctctcatcatttgctgttccattaaaaattacgtatccagtgtctagtttgcctgggggtgaaatggggattaagaacctttcccaccttgagacactgacattcttgtaaagggataaacactctatatttgaaaaatcatcctaagaagaacagtaactagtagtgctggagttggaagtgaagaaaatgtgaggagatccaagaaaatgatgaattttaggcagaactgaagctctgggtacataggagagtacggctaactcctggttgatccggatcaatggcatatgagagaatccaccacagaactgtgtgtatttgaatctttggttcaaactagctcaccatattagtggtctgtcctgtgtatcttcagaagttacaaggctgtctttcctgaggtcagcaggctactgaattgtgcttatgaccaagaccttgctggctgccatctgaatcatatatagtggaggaaaaaatgagtcagtagaaggtatggatggtgtacacctcgctaaagagaagatgaactataatattttcaagcatcattctagtgattgttggcctataagtagtgtttgattttaatttcatttctaatttatgtggttctataaaattctctatgttttccttccttccagcagtggacttgaatctccattttcctttttttttttttttgagacggagtctcactctgtcaccaggctggagtgcagtggtgtgatcttggctcactgcagcctccgcctccctggttcaagcaattctcctgcctcagcctgccaagtagctgggactacaggcactcgccaccatgcccagctaatttttgtatttttagtagagacagggtttcaccatgttagccaggatggtctcgatctcttgaccgtgtgatgctcccacctcaggcgctcaaagtgctgggattataggcatgagccaccgtgcctggtgaaatctccgttttttaaacatgatttttcactggaagtcttaccaccatgtacaccttaaactctccatccccagatagaatgggttgtgaagcttcactctttacctattcatggggattatgtccctagaggctgctgtcaggtgccagcagggattttatggatcattaccaaggaaatgatggtaaatgtccccaccgagtggcattggtttctaagcatagtacaaggagtaggttgcaccctgcacctcccaggactttccctctggacactgtttttacagagggtgttagagtggctacaccgaggcacaggatgctagggcagtcagagtagggattgacgcatcactctctgaacctggcaattggcatcaaaaacaggagaaaaagcaggcttcgttttcatttactctcctagttgtatttgtgattcagcattccatgctgtattggtaaagggaagaaattactttttgtgggggtcatgcccccttcctttaatcaactgaagagtcttgtaaagctgatgcacatgtaggcaggcatggtggcccacacctataatcccagcccttcaggagtccggggcaggcagattacttgaggtcagaagttaaagactagcctggccaatatggtgaaaccccatctctactaaaaatataaaaattagccagatgtggtggcgggtgcctgtaatcccagccactcgggaggctgaggcaggagaattgcttgaacccggaagatggaagttgcagtgagccgagatcgcaccactgcactccagcctgggtgacagaacgagactctgtctcaagaaaacaaacaaaaagttgatacacttctagatttaatttaagattttgaccattggcctatgagccagagagatgtttgtattgaacttgggcctgaaaaagtttcacattcatttttagagtataaggaatgctggaatacctctggcacattgatttatgaaacattttaagatcatgttcactttcttctccaccagatatctattttctctactttgaaccccccacagatgaccctgttatgaagtgtgctgcatatgaagtttttgcggggtggtttatcccccactgcagttcttgggcactggccattcacacacggagctctagcctttaggggccagtgctcaattaaaaaatcaatggaattaatataaacctgagtaaattatcaatgggaaagtatgatttagcttacaaaattaatttgtaactttccaaaatgttttctgattggtgaagccaacttccccagaagtaaaactccttacgacctcaactcaatacctgatacctggttctcacttgactggcttataggaggggcctaataaatgtggctaaaatgaaattaacgctgtgttcatcacctatgtacagtggtcatgttcataaccgaatctgcagctcttctaaggtagtctccaagagggttaagccaaagtaaattgcctcatttggagcctttgagagcatctctcttacttttagcagtctttggtcactacacattagattaagatgctaagtataataaagaaaaaattatatgaatatatgactttaaatctaccattaagaaacaggaaattaagagatcgcttgaagacattttatgccaaatctgcaacaattttgaatttcttattatattttattaataatacttcatgttatacatgtttatagtatcttattaattttaaactccactatgtttaaaaccattttatgattattagaccctttcattcagtcagtatcttgtttttcagacgactgaaacctggctttgaagtgctacctgaagtgttcttaagtctcatactgagaagtcacctctttattggcacttaacgttacgcataaataggaccactgtgcacttcttaggacattccacagagagtgctacttctgttgtaaatttgtgcaatattgctctcatatgtaaaatactctacaaactgccacctttgcaaagttcccagtcccctcacttgtcagtgatggatggtgatgctttaagggtccatttcaatagaggtatatttcccccagtaaagacaaaggaatgttaatgggctaatagctccgtactgtcatgactgacttatgtgatattgcacaaggtgaggacagtggagctggtattttgtttggcattcaccaggcacttcagccctttagtgcatcatctcccttcattctcacaacagatagttgatgggacacatagcacgtgatcatggggctagatctgagctcacaccatacaccgtctggttgcagatctgtgcctctaaacagtcttgccaagtgtccagtgtgctttaggtgccaggtgcttcacagacttcggaggtaaatattttcctactatttagaagtcatgttttttcagcacattagattttctgaaggtttctctgaacaaaagaacttgctgcagatgccaaccaagattcctcctcaggggtgtttaccatgtagtagtgccaaagaaaccagcgctgtgcgtcaccttctaccttatctagagccctggagaggtcacctatctgtctgtgacttagatcggtgggcttcgcttccagttctctgatttaaggcttctgttagagcagcagctgtagcaatttgctttttgaataggcatatacatttcacaagcactttcacttcagcggcctggaggggtggagtaaactgttatatcagcttcatagatgaggcaacagagcatcagagaaaagggacctctcaaagctacatgggtcataactggaaaagccaggatacaagctcctctgcctcattcgccatcacaactccaaaacttgacctctctctctggggccatctcctcattggctcatcggcagaatgaatgaattgaactccagcagtgattttcaaaccctgttccctggagtattagtggtttcaaggctgatggggattgagatttgggtctctcctttagccaaaaccactctgcattcatctattttgcataccaatgttccacattgtctttaaagaaagcttctgtagtaagaaaatactttgaagattactgatcctcaaagtttttattacattctaaactttaacctttaggggccagtgcccagtttaaaaatcaattgaactaatataaacatgagtaaattatcaatgggaaagtaaattggtcttacaaaactaatttgtaactttcaaaaatgttatctgttgggtgaatccaagaggcttccccagaagtaaaactctctaggacctcaactcaatacctgatacctggttcccacttgactggcttataagaggggcccagtaaatgttgctaaaatgtaattaaaagaaaaaaatttattttgatagtagttttaagtaacacacagactatcaaaatgtatttattttacacctgttgtagtatgctaggattataaatattctacaattaattttaaaggacaatcacaattttagtttctccattgaactttattttgcttcattcatatatatattcagtgagtcttccctcttacccaagtctctccataaatgtcttcattattttactgacttgatgaattcccagttccaaatgacgcttcaagtcatatatctagtttaaaactcctgcagtaaaataacatttctagacagaattctgaattcaacgaaatgtgtttctttctctataatacattgtctgtgttatcttcattcttggaagagatttgagtagaaggattgtatatgcttctttttatgggatgctatgaatatgaatacttatttaacaaaccaaattatatttctctcattccccaaactttagaaagttctatgatttcagttgatggcacacactagaatttgtgtagaagttacaaggaaatggagccgcacttgagagttgcaccttcatcttgggttcagcagtgtccttagagtgaaaagagggtggaggagttctaactgcattccaagaccaagtgatattctgtccaaaaactatcaaggacagacttctctgcttttaatactagctttttgatcagagggctcatggggtgcaacatgtacaccaacttgctgccttgtaaacttgatcctttgtaaatctgtgacatttttccttgttacaagagttttatattctcatgtatataaatactgcctttgacaggataagagactagtgccatgaatattcctttagcagtggtaaaaactctgcaataaagctttgacgttttaagatgacaatcaaatggtccaacaaagggcaggagaggctaaagtaaaaaccttcacagatgaatggttttatttcacatcaactctatggtcttaatgctgcctatcggaggcacatttttgcatcagccacatgaattggtgaactttagtgtatatggatcataaagtatttcttcacttgaaggtcatctgtggctaagctgtaatttctgcagttctgtgaaaattagcactctctatcaaccttgtcatttgaattggggatctttatgtagatgtttgatgcttctatttcactgctgctttccctctgctatagtgcttaaaacaaatggtgtcagattcactctaatctagttttgtggtttaatttacttgtgggtgccttggttttgtgggttttgctttccacaaaaagatgtaatagaatctgatctcacaggcattaccttctacacccaagggctttttccctcccttgtcacttcttccctattagcagacatcattttacttcaggattatttgatttggtgtgataaatggattaagatcaaaattagcatcaaaataattatggcaatttgaaaagacatccattgggggaacactgtaaacactccaacttcataatgataggatacagacattttgagaaaaagctattgtacagaggcactgatgacaggttttacttctgagttagttattgtaaaagctcacatagctcttatttatttttgatcaggagatcatgttttagaagaaagcatttcatggaagtaaaatggcatcaaaactattgcttactttgaaaacatatttttgccatttggcattttctagaaaattgtatcctttatacacatgcagtatgatttctgtccttctcatacattagcaggattcagtagcagactttctattaaatacagttggcccttgaataacacaggtttgaactgctcaggtccacttatattttcttctgcctctgccacccctcagacaacaagaccaacctctcttcctcttcctcctcctcctcttcctcagcctactcagagtaagatgatgagaatgaagacctttatgatgatccacttccacttaatgaatagtaaatatattttctcttttttggggggcaggggggcggagacaaagtctcgctgtgttacccaggctggagtgtggtggcgtgatctcagctcactgcaacctccgcctcccagattcaagcagttctccttcccgagcctcccaagtagctgagactacaggcgcatgccgccacacctggctaactttttgtgtttctagtagtgacagagtttcaccgtgttgcccaggctggtctcaaactcctaagctcaggcagtttgcctgcctcagcctcccaaagtgctgggattacaggcatgagccaccgcaccagcctgggattttcttaataacattttcttgtctctaacttactttattgtaagagtagagtgtatcatacatctaacacacaaaatttgtgttgttatcagcaaggcttccagtcaacaggaggctatttgttaaagttttagggcagtcaaaagttctactcagattttcaactgcatggggtggagggtcagggtctttaacccctggcattattcaagggtccactctagtttactcaaaataaaggctaaagtatctgtatacccttcagataattcctttaagcatctcagtggtttcatctcagtatttataaagattgacttgagattttccccacaaggcctttgagctcagattctattgtgtgttttttgtggaaagcaaaaaccataaacttaaggcacccacaagtaaattataatttttaatatgagcaatactagtaacattaacagtagtaaatatagcagttaacagatatgagatgcttgctatgcacttcacacccttttaagcatttacttggatttctcactgaatccttacagccccttggtctagatgaggcagtgcaaggcaggtatagccatgcctttgctctcctaaccaagggcccttctactaaagcatgctctttagttatccaaacagtctctgtagtgggccaaatgttaatgcctctcgaaaaggtgaacatggtaagacaagatgagggcattttcatactcctctcttcagctgggagtatgttttaagcaaagcagaatgaaaacatttcccttaaagaaataggctcagtgaagactccctcattccaggatgtgagagtgcctagcgtcaggttacctagcttccatgtctttgtttccagctcctcggggtagcctctcccttacccaagcacaggcagattctggtcatcaccaggacatttatcacagctcaggtgtcctgcttatgctcgccaaggccctgctggacggcaggcactccttgcagcacaaccccatgaagggttttggctcagccctcctgtctctcaggattccacctcagaattttataatcacgtcggctgtagctcacagcataatgagatctgtggatgaccttatcaccaccaggcttccatcagagcccatgcctgatggtcactggcagactgaagaagagaaaaaaaaataagcataggtaatttttacatattcatgacagatgccccccattcagcattcttataaaaatacgatcctactgaaactcatttttaatggtgaccctgaaaatccaaaatggggatcttgcttctcccctccatgtggtctctgggttacaaggaacatgtgaaatgatccctgcatggcagagcagcctgttaccatggagacagcttactactttcccagccctctggctagttccaggaacgttaactccataccagttttaaagaaatgaaaagaagtctaaggttaatatctagctttttaaaagttataattattgaaaaaagcactcaagttacaaacagactcttctcatctggaaaggattacatttaatattattaataatagtacttcatgtaagcagagtaaccactgctaaaagactcacattctgttgctgttaattgagccttcctttttcatattttactttcaggcttggtattacactcatctggaggaaaataattttatttattcatattttgctgtttatgtattatttttgtcttttaaatctcaacatcctcatggagacatgctatatttttcttatttatttttttaattttactctaagttctgggatacatgtgcagaatgtgcgggtttgttacataggtacacatgtgccatggtggtttgctgcacccatcaacccgtcatctacattaggtatttctcctaatgctattccttccctaaccccctaccccccgacaggccatggtgtgtgatgttcccctccctgtgtccatgtgttctcattgttcagctcccacttctaagcgagaacatgcggtgtttggttttctgtttttgtgttagttcactgagattgatagtttctagcttcgtccatgtccctgcaaaggacatgaactcatccttttttatgactacatagtattcaatggtgtacatatgtcacattttctttatccagtctatcattgatgggtatttgggttggttccaagtctttgctattgtgaacgtggttgcaacacacataatatgtgcatgtgtctttatagtagaatgatttataatcttttgggtatacacccagtaatgggattgccgggtcagatggtatttctggttctagatccttaaggaatcgccacactgtcttccacaatggttgaactaatttacactcccaccaacagtgtaaaagcattcctatttctccacatcctctctagtatctattgtttcctgatttttaaatgatcgccattctaactggcatgggatggtatctcatcgtggttttgttttgcatttctctaatgatgagggatgatgaactttccttcatatgttttttggctgcataaatgtcttcttttgaaaattgtctgttcatatcctttgcccactttttgatggggtcgtttgtgggttttttttgtaaatttgtttaagttccttgtcgattctggatattagcccttcgtcagatggatagattgcaaaagttttctcccattctgtaggttgcctgtttactctgatgatagtttcttttgctatgcagaagctctttagtttaattagatcccattcgtcaattttggctttcattgctgttgcttttggtgttttagtcatgaagtccttgcccatgcctatgtcctaaatggtgttgcctaggttttcttctagggtttttatggtgttaggtcttacatttaagtctttaatccatcttgagttaattttttataaggtgtaaggaaggggtccagtttcagttttctgcatatggctagccagttttcccaacaccatttattaaatggggaatatttctccattgcttatttttgtcaggcttgccaaaaatcagatggctgtagatgtgtggtgttatttctgaggcctgtgttctgttccattggtctatacatctgttttgatgccagtaccatgctgttttggttactgtagccttgtagtatagtttgaagtcagctagcatgatgcctccagctttgttctttttgtttagaattgtcttggctatgcgggctcttttttggttccgtatgaaatttacagtagttttttctaattctgtgaagaaaatcaatggtagcttgatggggatagcattgaatctataagttactttgggctgtatggccattttcacgatattgattcttcctatccactagcatggaatgtttttccatttgtttgtgccctctcttatttccttgagcaatggttcgtagttctccttgaagaggtccttcacagcccttgtaagttgtattcctaggtattttattctctttatagcgattgtgaatgggagttctctcatgatttggctctctgtttgtctattattggtgtataggaatgcttatgatttttacacattgattttgtattctgagactttgctgaagtggcttatcatcttaaggagattttgggctgagacgatggtgttttctaaatatacaatcatgtcatctgcaaacagagacaatttgacttcctctcttcctatttcaataccctttatttctttctcttgcctgattgccctggccagaacttccaacactatgtcgaataagagtggtgagagagggcatccttgtcttgtgcaggttttcaaagggaatgcttccagtttttgcccattcagtatgatattgattgtgggtttgtcataaatagctcttattattttgagatacgttccaccaatacctactttattgagagtttttagcatgaaggggtattgaattttgtcaaaggccttttctgcatctatcgagataatcatgtggtttttgtcattggttctatttaggtgatggattatgtttgttgatttgcatatgttgaaccggccttgcatcacagggatgaagcctacctgatcgtgatggataagctttttgatgtgctgccagattcggtttgccagtattttattgaagcttttcacatcgatgttcgtcagggatattggcctgaaattttcttttttggttgtgtctccgccaggttttggtatgaggatgatgctgtcctcataaaatgagttagggaggattccctctttttcttttgtttggaatagtttcacaaggaatggtaccagttcctctttgtagctctggtagaattcgctatgaattcatcttgtcttggattttttttggttggtaggctattaattactgcctcagtttcagaacttgttaatgtttctattcagggattcgatttcttcatggtatagacttgggagagtgtatgtgtccagaaatttatccatttcttttagattttcttgtttatttgcgtagaggtgtttatagtattctctgatggtagtttgtatttttgtgggatcggtggtgatatcccctttatcattttttattgcatctatttgattcttctctcctttattagtctggctagtggtctatctattttgttgatctttctaaaaaccagctcctggatttactgatttttttggaagggtttttcgtgcctctgtctccttcagttctgtctgatcttattttttgtcttctgctagctttcaaattagttcgctcttgcttctctagttcttttaattgtgatgttagggtgtcgattttagatctttcctgctttctcttgtgggcatttagtgctataaatttccctctaaacactgctttagctgtgtcccagatattctggcacattgtgtcttttttctcattggtttcaaagaacatctttatttctgccttgacttcgttatttttctagtagtcattcaggagcaggttgtttggtttccatgtagttgtgtggttttgagtgagtttcttaatcctaagttctaatttgatttcactgtggtttgagagactgtttgatatgatttccattcttttgcatttgctgaggagtgttttacttccaattatgtggtcagttttacagtaagtgtgaagtggtgctgagaagggtgtatattctgttgatttggggtggagagttctgtagctgtctattaggtctgcttggtccagagctgagttcaagtcctgaatatccttgttgattttctgtctcgttgatctgtctcatattgacagtgggatgttaaagtctcccactattattgtgtgggagtctaagtctctttgtaggtctctaaggacttgctttatgaatctggatgctcctgtattgtgtgcatatatatttaggatagttagctcttcttgttgcattgatccctttaccattatgtagtggccttctttgtctcttttgatctttgttgacttaaactctgttttatcagagactaggattgcaacccctgcttttatttgctttccatttgcttggtaaatatttctcccatccctttattttgagcctatgtgtgtccttgaacatgacatgggtctcctgagtacagcataccaatggtcttgactcttttttttgagacagagttttgctctttcacccaggctggagtgcagtggcgcaatgtcttctcattgcaacctccaccttccggtttcaagcaattctcctgcctcagtctcccgagtagctgggattacaggcacctgccaccacacccggctaatttttgtatttttagtagttacagggtttcaccatgtgttggccaggctggtcttgaactcctgacctcgtgatccacctgcctctgcctcccaaagtgttgggattataggtgtgagccaccgcgaccagccgggtcttgactctttatccaatttgccagtctgtgtcttttaattggggcatttagcccgtttacatttaaggttaatattgttatgcgtgaatttgatcctgtcattatgatgctagctggttattttgcctgttagtttatgcagtttcttcctagtgttgatggtccttacaatttggtatgtttttgcagttgctggtactggttgttcctttccatgtttagtgcttccttcaggagctcttgtaaggcaagcctggtggtgacagaatctctcagcatttgcttgtctgtaaaggattttatttctcctttgcttatgatgtttagtttggttggatatgaaattctgggttgaaaaatcttctctcttagaatgttgaatattggcccccagtctcttctggcttgtagggtttctgcagagagatctgctgttagtctgatgggcttccctttgtgggtaacccgacctttctctctggctgcccttatcattttttccttcatttcaaccttggtgaatctgacgattatgtgtcttgaggtcgctcttctcgaggagtatcttcgtggtgttcactgtatttcctgaatttgaatgttggcctgccttgctgggttggggaagttttcctgcataatacccctaagagtgttttccaacttggttccattttccccatcactttcaggtacaccaatcagacatagacttggtcttttcacatagtcccatatttgttggaggctttgttcgttccttttcattcttttttctctaatcttgtcttcacactttatttcattaagttaaacatcagtctctgatatcctttattctgtttgattgatttggctattgatacttgtgtatgcttcacaaagttgtcgtgctgtgtttttcagctccatcaggtcatttatattcttctctaaactggttattttagttatcaattcagctaaccttttttcaaggttcttagcttccttgcattgggttagaacatgctcctttagcttggaggagtttgttattacccaccttctgaagactacttctgtcagttcatcaaactcatcctccgtccagttttgtttccttgctggctaggagttgtgatcctttggaggagaagaggcgttctggtttttggaattttcagcctttttcagctggtttctctccgtcttcatggatttatctacctttggtctttgatgttggtgacctttggatggggttttggtatggatgtcctttttgttgatgttgacactgttcttttctgtttgttagttttcccttttctgtttgttagttttccttctaacagtcaggcccctctgctacaggtctgctggaggtccactccagaccctgtttgcatgggtatcaccagcagaggctgcagaacagcaaagattgctgcctgttcctttctctggaagctttgtcccagaggggcacccgccagatgccagctggagctctcctgtgtgaggtcctgactgtcccccagtcaggaggcacgggggtcagggacccacttgagggggcagtctgtcccttagcagagctcaagctctgtgcggggagatccactgctctattcagagccagcaggcaggaatgtttaagtctgctgaagctgcacccacagccaccccttcccccaggtgttctgtcccagggagatgggagttttatctgtaagcccctgactggggctgctgcctttctttcagagatgccctgcccagagaggaggaatctagagatgcagtctggctacagcggctttctctggctgcagtgggctccacccagttcgaacttcctggcagctttgtttatgctgtgaggggaaaactgcttattcacgcttcagtaatgacagatgcccctctcccaaccaagctcgagtgtcccgggtggacttcagactgctgtgctggctgcaagaatttcaagccagtggatcttagcttgctgggttccttgggggtgggatccattgaggtagaccacttggctccctggcttcagccccgtttccaggggagtgaacggttctgtcttgctggcattccaggcaccactggggtatgaaaagaaacccctgaagctagctcgatgtctgcccaaacggctgcccagttttgtgcaggaaaccagggccctggtggcataggcaccagaaggaatctcctgttctgagggttgtgaagactgtgggaaaagtgtagtatctcggctggaatgcatagcccctcacagcttcccttggctaggggagggagttccctggctccttgtacttcccggatgaggcgacgcccaaccctgcttctgctcgccctccgtggtctgcacccactgtctaaccagtcctaatgagatgagctaggtacctcagttggagatgcagaaatcacccaccttctgcattgatcttgctgggagctgcagaccagagctgttcctattcagccatcttgccagccctttgacttgctatatttttcatgccgactgtccctgtgcagacaggatacattcttgttcactcttccctgttgataggaggttttgtaggttttgtgtgcagtgtttctattcctgctgatttcttagttgaaaactggtgtaatacctcaagggatgtagacaaatactcaaggttattttataataaactgtgatgtactaaaatatttaaatgtagttttaagaaaaatgaatgcaggttgagcatccccaatctgaaaatccaaaatcctaaatgcttcaaaatctgaaacttgatgagcacccaaatgccgctcaaaggcaatgctcattataagtataatgaaactattccaaaatttaaaaaaaaaaatcaaaatccaaaacacttctggtcccacacatttcagataagtgatactcaacctgcatttaattatttaaactgtattaaactgtatttattatagtttaaaaattaaacacgtttaacttcagcatataagtaatttcagtatataaataaatttttgaaactgagaaaagtaagcttatctattcagtctgttggggtcttgcttaatacatacctcagttctgatctctcctgtcccatctgggcagatttagtactctcatatagcacattaatttgcagatacttattgttatttcataccaatgttaagatttttaaatagatatacggatatgaatactgtatgtatatcaaactgtgttgtcattccttttagagtagatctcacctatgtcttttttaggtattttattacagtatttcttaatgtgcattttctactatgtggcctattgtattctacctaaagggcttgatgaaagctctgtgttttatgtgcttgatttcattttaaagatttttattgatttcagtcactctcttcagtctctccttaccaactgcgggctcagcatccagaaacaccatgtgtttgttctagggttcccatatatcctgtcaatttgcccactctttctgcctcctcccaagccatttctcagtactgtctggccagacctctcctcgtctaatcactctgcctgtccctttcttttctcttgtaacttagattgtagggaaatcttttggaaatcagagactgtaaactctggtctcctggttctgtgtaatatacagtgtaagtattaatatatttcacaaactactaacactgaaatggcacttccctggagttaatctggtgcttcctttagattttgaaaaaaaaaaaaaagtcatggactcagtttggggtactggagttattcccatcagatacattctgaagctgggtgggctccttcaaagagagcaagggtggtgtattttggttttgttctcaattgactatgtttcctattgtataagttttctaggctgctctagcaaaatgccacagactgggtggttgagacaacagaaatgttttgtctcacagcgctggagactggaaatatgagataaaggtatcagcagggctggttccttctgggggctctgagggagaatctgttccatgcctctcccagcttctgctggtttgctggccatcttcggtgttccttggcttataagagtgtcatctccatctctgccttcatcttcacatagtgttatccctgtgtctgtgtccaaattgcccctttttataaggacaccagtcttattggatgaggggcccagcctactccagaatgacctcctgttaactcattaaatctgtaaagaccctatttgcaaatggagaatgttatagtacaatgcattctgaggtattggaggttagaacttacactaatgaattttggaagacccaattcaacccataacacataccattgcaataaaactggttttctggccgggcgcggtggctcacgcctgtaatcccagcactttgggaggccgcagcaggtggatcacgaggtcaggagatcgagaccatcctggctaacacagtgaaatcccatctctactaaaaatagaaaaaaaaaattagctgggcatggtggtgggcacctgtaatctcagctactagggaggctgaggcaggagaatggcgtaaacctgggagacagagcttgcagtgagccaagatcgtgctactgtgctccagcctgggtgacagagtgagactccgtctcaaaaaaaaaaaaaacctgtttactattccaagtctatttactgattttacaataagcagtgattttgtaaatctgtaattttgatcttgtgtttggatcaaaatatagtacaaatcaaacacaattggtgtgagtgcatttaataaatgaagtcttgaccatttgtgtgttgccaagctccaaaaagcagtctgatcattcatgtacttgcagggtccatttatttctaatcatcctagcttaacttcatttaaagaataaattaatcgtttttaaacttatgccagcagttgttaattcccagatggcaggtgaactctctaaacatttttttaaaacttttcatcaaatagtaattccattttaacccaaaaatagctttttgttttctttcttaaaacatgaccatgatgcatcgtcaatcaaaataaactgaagtatttattaattacagctgtattgatttctactctaaactgacttcctccgaaatctagtatgtttcatgtttcaagaattaatttcttgatggtactctgctgcactgtaatttagtcatggtggattgagtcaccagatattaagacagtcatgattgcaaatgacagatggcatccagtggctcaccattgtttgtacctcttggtacccatttctctgaagctacaagtacagccatgaggcagtgataactgtcttagttggagtctcagagctcatgcttcatttattcccaaggcaaggcactaaaaagccatagttggagctggagcacttgccaacttgtatttctgccatttagaaggtgctcagtccctacatctaaaatttgaagggaaaggaaatcttccatatgaatgccacttttcgttattttccagaccatcacatcttacttttcctttcattcaacaatgataacttattcgccaacacttttcaagaatgtgtttacatgaaagcagagcaagcatgttaagagacccagactgcaaataactttggaacggcttcagtgtaattcaaagtgagtcatcctgcctcagttacagaatgagcagctctgattgacagaacttggaaaagctaacacagagcggcaaagggtattccccaaaccttaatttatttctgtttgagagcaaaaatattgggaaattatccatctacagcttaccttttcttactgtgtaatttgattttaatgctggaggatttaccgtttacataatttgatcttcaatgaaattactccttatgtccgacttttggttcagattatatctaaattaagagattaataattatttttaaaggtagtgaactagcgtagatcagatggtatgattcctgactacgaaaaggaatttatttgggcaaggattactggtatgtctattgcttttgttgcgtaaatgaattgatttccacctacgccataacagtgtatctcacatgcaacgactaagctggagttgcaggagctttcttgtctgccactgccctcagcctccattctcccttcctggtgccccagtacagcctctgttctcctttttcatagtttccagtgggagcatctccacttcccttctttttgaggggcctggtcatcttcacttccacacagcccacaaacttctcacttgtatctctcctggtacagtagccatgccataaaacaagatggatactgatcagttactcaggctagaaacttcaaagccatgaaacaggttcaagaagagagtactacaattagacttacgctttagaaaagtcagtcttttacctgagcagtattatatagtacaatgcttgttatgaaaaaaaaaaaaaaaaaaaaaaggccaattgaattaaacagctttgcaaggcagaacaaactcctattttgtttaaaatttgctgaactttgtaagggggtacaggaaggtttatgcatttgggtcaatgaatgcaatatgtacagaagggcatgtatttctttctttctttctttattattattatactttaagttttagggtacatgtgcacagtgtgcaggttagttacatatgtatacatgtgccatgctggtgtgctgcacccactaactcgtcatctagcattaggtatatctcccagtgctatccctcccccctccctccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgcccctacaaaggacatgaactcatcattttttatgtgtttctataagcaaacattcatgtcccttcccagacatatcagtcaaccttgataataaattgcaatcatttttactactttaaccccttccaggaggtgtaaggtataatagttagtcctaatagttttacatttccggcacatcctgttttctaacctggcattccatacagcatatgtgaatatgaataaggattcaagtgaacttcatgtccctcggaatctaatttgggcaacaaccatttctagaaggccccttctcctcctgcctcccacagccccacactgttcatttaatgactttttttgaagttcacgtagtgctgtctgctaattgtgacacattgttgattacactctaatctaattgtctgggtgccttgcccagctagagcacagtcccatagtagctggaactctgtcattctttcattcacttctcattgccttgagagcagggcttacctattatgtatgttatgtatttgccaaatgagtgaataaaagactaaggagatattttaactctttattcagcaccttatcttttgcttctctgcatacccatatttcatgctttgatttttctgcaactctagtctttaaagatttacctgtcaacttaagaaacacattgattggataagatgtttcctggcagtgtaatatggaatcatgtggttgaaagggacactatagttccacctgttcttctccaagaattgcaacaaagcattttcaacctcatctgcagccaattttaaggaaatctaataaagaggtttgcagagcacctgagagcagctaagatcccaagacaaagtagaaaattacctattgaaactacaaataaaaatgaaatttaaatatatcgttttatatatgggccatttgcttgctcaatctctttgtacctgggagtggagggaaaggctgggagtaaaatgggactggattaaaatatagtgattgtagatttttatgacatatgaaataaattgtaaatattaaaaagttgacctgtagtaacatgcttgcagccatctatgttattaagacagtacttaacgagttttgaaacaagtactcctggcaatattactactattcttaacctatatgtgatagacattttcaaaaagtcatcatatctgattgccttctatgctgttctttaaatgtttgaaatcgtgtttttatatatgaatacaaccaatcagaatacaggtacattgcttcaagtactatttcaaaaagtttctccaatgacatgactcagcgatttcttaaaggatagaaaaacactttgttaatggagaaaaccagaagtccaccttctcttggaaataaatgttgaattttaactgagtaactttgcatcagccacatcgtattactgacatgtattaggtggtagatttctgtagtagcagttctttaaaggaaaaaaaaaaaaaaaggatttcttttccattgccttcttttttttttttttaacaaaatgagatattcctcagatgggtaaccttcagctttgcagcctgagggccatacctaggaagtggaactaggtgccttgggtcagcattgtcctgtgttagggggaggtggtaatttctaagacttttgccattttcctgaaattgctttgggctccatgttacctaaggtttgagaacaagctctgaagctggatacacgcaggtttcatcacagctctaccactcaatatcagggtgcacttggcaaacaagttaattaactcctggaaacctcaggctcctcaggattgtgtggattaaatgagaagatagatataaagcacttagcatattctgctgttctgttggctcaatttttattgcatttaaaaggatagttgaagtcaggcacagtggctcacatctgtaatcccaggtggggaagattgcttgagccctggaggtcaagtttgcattgagccatgatcacaccactacactctagcctgggcaacagggtgaaaccttgtctgaaaatgaatgaatgaatgaatgaattttttttttttttttttttttttttttttgtgacagagtctggctctgtcgcccaggctggagtgcagtggtgcgatctcggctcattgcaagctccgcctcccaggttcacgccattctcctgcttcagcctcccgaatagctgggactacaggcacccaccaccatgcgtggctaattttttgtatttttttagtagagacagggtttcaccatattagccaggatgctctcaatctcctgaccttgtgatccgcccgcctcagcctcccaaagtgctgggattacaggcatgagccactgcacccggcctgaatgaattttttaaaaaggataggtgatttatttttcagaactttttagttttcctatattcagatgcctttttcaactttgaatgtttatgcaaagcttgggaatctgattgttgccccaatataaataaatacactgttgtagtccattgaattagaacaaaagtgtctagtgaatttgaattccatccaatcactacttttcactttgcatggtttcaatctgcattaatttcaattctcgtattttagttaaataaaaccagttccccaacgtcacagttcaaatcttagttaccatagtatattaactgtaattaaataaagtgcaaacctcatagttaggtcttcattccccaaatcactctgtaaatagcaggtgctcatcatgatcaatgaccaatcatgccccttctttccatgtctgctggtgatggttctgtgcacatttattattcagttttcacacagacaggaaaggttgtccttgtgttgcctccccaccaagagtgataactcatgtggaattttacaaaaatagatttaaaagatggaattagtcaacaaagatggaaacacagcagggcaatgaaaagtggcagtcaaattagaatcaagcatgtgtagaagaaatagctgatggtggggatgttgacactgctcgtgatctgggaggagactctggataggccaacaggaacccagggaaggcagacttatcagcataaatgaggaatggggttttgacagaaaggacaaagatatcccataggaagtgatatcatcaaaaagctttacattaaaggagttctcagaaagcacaaaggataaaatgttggaagctgacccaaacttacaaagggcagttagccaaaccataaaaaagatgctcacgccatactgtatgctgtgtgatgagatgaagtcacacaccattcagactactcctgatacatttttaaaactgaaagactgaaagtctaaaacctcagtgtgtttatgttgtcagttactgttttatagtgttcatttcccttcacatttataactgacgataagcgagttttaacgctttgacaaaaagttttaaaaggtcacagaagagtcataatttttgccgttgattattaagtactcattgcatggttttgggttatatggttatttgtacagccataacctcacaaagcagggactggcggtggtaaaaaaaaaaagtagtcaaaccactactgttgccgtctggattttatgttactgaaaaattagttaacacattctcaatattatcaatagtttcctagcctgttaaaggcaatttatgtagtaatagatgccttattgattacagaacttgactttctaatatttgctacttttaattttcaaaaagtcctgaaattaaatattcagactcacatttctgtggtacttttagtgaaatatttttgcaacattaaagttttttgttgttgttgttgtccttttcattttaaaagaaggcccaccgggattctccatcagcaaacagccaacccactgcattatacatagcaagttttagtgacagttctagtctcttgggcatgagaaatacagtcttgtttgctcgtttaagtcaacaagctgtgggatttattgtgtgttttgtagtatgcatgcagaatgttttgatttttaaaagtctaaaataattgaaactgtcttgtgtcattcaaccctgtaataagtacctatagtttaaaacctcaaaattggttggttttgaaagatgtttgtataatgcataataataagcgcctctggattatttttaatgcatcagatcctgtgctatggtctgtgtaagagaaaggaaccctgattacagttttggagagtgttcctggtgcccccagcatgcccatggtggataccacatcattatgctgtgctctgaggggcctcattctgacagcatgcttggttacataccgtaatgaaaagccttgtttggggaacatttgtgcttttaaatattggtttcatcatgtccagggaatgaagctgatttaaacatagctcacagtaaatctgagagtggaaagtttgattttacccactagtctttctaattttttactaatgtaacgtcccaatccattgtgtagcagagaagctagttgaatttgttcttccaggggaagagggcccttcttatacatgagtttatatgaagtttttcatgtaatgtattttatccttcatgttcatcagctttacagagaaaaacttaaagagttcttactccaaaacattttgtctgagcctggggtgaagattactataaggaatgattgagcaacaagatgccagtgatggtcaaggaaaaagtcaaaaatgttgattttgaagatcctttactaattcacaaattctggttgtttttattttcatctatgaacaagggcaatttcaagaataggaagaaggaggaacatagagcctcagccagcattgacgtgggtgacaccttcagaacggttgtaggagcacaaagagtcagcctggtgtcacttgctggcaggccttcacttcagatctgacctgaaacaacacacagaacctctcctttggcttagatcccatgtgaggcttcctggcatgttcggataaatggatggcttggatcgaggctgctcctgacttcaagttgtagaccagcctcctggcctggtctcctcagctctggaggctggcctggaagctccagatgattccaggagcacagcctgctccatgaccgtcctcaggcgccagctcctgctcctcctgtctcatccgggggcggtgaattccccatattcatgggttatgactgggctcagactgttccttctgctcagagggcctgtcccggtctcccacttttccatgttgtgaaccatggtgaaaatgttgagaattccttcccatacttcccaggagcttcattcctccttcatctgggttctggaagtaatttattctcaaccatggttcctcctgtttgttgggtgccctttatgtacaaggcatttgacaagcacagtctcaacccacccaacaaccctattcaaccctatttattacagactctaatcggtgaggaaactcaactaccttgctctgggcttagccagtaaatagtggaatttggattgaaacacttttcctcttttacctcttacagcacgtcgcacattgtgtcagtctgccgacttcatttctgtcttccacactagactaggaactcttacgtgtcttatctgttgatgacttccactcccatcccaagcatccccatacttggcccacagcccttgttacataaatgtttatcttgcaggaccaatgagtgaatgaaaggaagtttgaatcaattaccaactagctgcagagtaagaacagaagcctcaagaaagatgaaaaaccaattttacaaatttaacataatatttacaggaataaatttttgctatacaaatctagccatcacgagaacctgtgtaaatagaactcataaagaccccagggcttactttttggtcttcaagaaaaggcacagtagctgtttttattagcggcacagaaaaatgattttgtttcctatgatactgatcctgcacaagtttttttctttttttcttttggttactggctaggggtatatggaaattctggggaggaaggcttgttgatgttcctgtggcttatacacctgcccaaagctgtgctccactgacacaactgaagaaggacagacaggaaaacgaggccaggaatcctggacaggccaaagtgcctgggatacccacgggggatccaaagggccaccaggcatccccagtgacatcggaaacacgaaaggctgtagggtggccagagccatcagcctcccaaaattgtccacccttagactaaacaacatcctgctgccttcccatcattaacctgcccttttatgcaactgattttttatgggagaaaacagtttattgcgggttattcagtttacttattcagaagctgtagagtggctcagcgacagggacaaatgaaaattcggaacatcatactctccatgtttactgtgatgattcttctcttccatcactgtctataaacaacactgtgaggacagaattctctgaaaagctaagatatgggacaccacaaaggcctgaagcttccatccaaaagaagtaatctgagttggacctagtggggattaagcatgctattgatttagtattcattttttatatttggactgtttaaaattacttatccaagaaatcctccaaggcgcatgattatattatcatactcatttgttggggagggtgggggattgtagttattagtgtaatttgccccagaccagaaagtactactaaatgctatgattagaaaaaggagaaggaaatctgtatttatatggaaaagaatttacttaggatgttattctgcattttaaattgtacagaagagaaaggaaagaaaccgattaagatgcttaaaatttaaatttcttctttggagaatcaatgactaaaatgtctcagaaggtatgtattaggatcatagttgaaaaaaataaaatattccactgattatatatagtgaaatctaattaagttttaagtaaaagtaatagtatttcaaagatactttacctgctagcattctttttatcatgatctttattgaccgtaaatcagagcccttggctaaggatacattttattccagaaaaattatttcagaacttgatttcaactgtattattggtcaactattacatttccttttttatttcaaatgtcgatcaacagggtgtagccatttataatatttataattatttatatctacaattacaggcatttaatttgtcatttgaacaatgatatgacattgtgctaaatacttcaaggagagacacagaaggggaaatattattggttattacttcttaaatataaaagtttgtctttaaatagctgtgaaaggtgttataggagcatagattccgaattacaagccaaacataaaatcttctaaatgttattttggaactatactttcctcaagatagcgttatttttaaatctgtgaaactgacttgattgaatattgtttgttcattatagtaattcatacatttaatgttaagaaaaatattggacttcagaataatatgaatgaattaatccttataaaaataattgtatgttttgtatttatgtacaagcctgtgaatctcttttcccaaacataaagcaaacttccaaatacacacatttattttgtaccagcccccatgctcatctgcctgtatatttgaaaaataattctgagctcagaaaatcactctccatgtgatgggtatgaaagtatgcacttcactgctaaattttcactcataccttatttttggcttatattcctgtgaatttttaaaatttcattttctgttttttaaactcagtagattcaaagcaggaattgtgaagtggattataaatacaaataattgtgagaggttggggaacttctggacttgtgaatgatggcaagacattaatagctagcagcctggttccatgtgggaacactggaagtctaaaacattagacatctacagaaggtgtttatgtgtattatagtagctaagatagcagccgtgaatcatcaataaatgaagacatgtaaatatataaactactttttaatttaaaaaaagaaaaaaaaactacttttaaaagattccatcagaaatgctgatttaaacagtttccatccttacataaacatgtgagtgaaaagacataagctgctattttctaggtcccccacgtgtgtgcaaacccctccttctctgaccataggaagtaatcgaagaattaatgctgtattctcttacccattcacttcacacctagtttgtgcctggcattgggctaggtactttctataccttacttaactaatataagtgaagtaaattcacccaatgtatattcatagtttgggttagttacacttcaagcaaaaggccactggtttaaaaaaagacaaaagttttttgggttgtttttagtacagtttacaattataacaatattaaagtttaaaattagtacttttggctgggcattgtggttcatgcctgtagtcccagcactttgggaggccaaggtgggcagatcacctgaggtcgggatttgagactagcctggccaacatatagtgaaaccctgtctgtactaaaaaaaatacaaaaattagctgggcatgatggtgcacacttgtagttccatctacttgggaagctgaggcaggagaatcgcttgaacccaggaggcggaggttgcagtgagccaagattgagccactgcactccagcctgggtgacagagtaagactccgtttcttaaaaataaaaataaacataaattagtatcttcacatcaacagcttacctaataatttttacaaatatgctccacctcacatttgtttgaaaaatcatgtacagccccttgtataaagcaagacttctgaagtctgagtcattgcagtctttaccttgagcatatgtttgtaacattagtaacaacccccactcatcctgtagctgaacttcacctgggtgatgatttgacttttccacagtgcaagatggtgctgagggtccactgggccacgcccctgggctctcctggggtttgtcaccccactttgttggaatatagcttggccctgtctggtcctgttccagttgagtgctggttctcattaatagcctctgggagtgatttttttaaacaatatattcttaagattcccaaaggaaatatgtctggttttatgtttttaagggatcttttaaagttttctgcatagtaagtgtcttagtccacttaaggactaagggctaaggacttaaggactaaggacttaagggctgctgtaacaaaataccatacccttgagtagcttaaactacagacatttatttcccacagttctggaggctgggaagtccaagaccaagatgccaacagatttcgtgtctagtgaagccccacttctgggctcacagatggacatcttttcactgcgtcctgaagtcgtggaagggaagaactcttttctcttcagccccttacaagggcaccattcccattcatgggggggggctctgccctcatgatttaatcacctcccaaagatcttgccttttttttttcattttaccagtttaaaatgaaaattctacatatgattactttatgtctgcatcttttcaattgtttcttccttgtgtttgccctttctcttgcctgcttgatgagatttggctttctgtccaaggatctttctttggtctctgttcactttcagcctagaagtaacagctggagtgaatgcccatgtggacagttgtgccattagccttttcccactgcacctgctcagtgtagatgacacatttcttcctgtaaaccttgactgttttgccagtttgctgacatttatagtgtcctcacacagcctgaacttcatcatcctttcagatgagcatggatcaaacactgtacttctgtgtcagctctttggaaagagaggaagacgtaatcttcctgcgaatgtggaaaggtgccttgaaatgccattttgtggttcttgcttcagtcaaaagtcacaaagggattaaacttcgttttggccactaccagttcagtgatagccacaaaagggaagacattcttcctcttaatactatcacattgaggattaggtttcaacatacaaatttggggggcacattcagaccacagcgatagagaaataaatctccgactggaaatgattcattaataaagaagtgtttgctgggcacagatttttaatgtcacttcataggttttcatttctgtaattgctttagattcatgtcttagctgaaacttcataaagcaaggaaagaagataaatggcaaagcagagtataagtgacttcttggtattacatcgggccttaaaagtcttatgcttacttactgtcctttgtccctttcttttggtaatctgtgttttaaagtaactgactgccctgccattgtcatctgcacatttgataggtttgctctagcttaacctctgggtctttaatgagcatgccctctctcttaagagaaagaacaatcactcaagggctaatatttgtgcagggagatactatttttccagctattgctatgatgtgaaacagaatcagaagtgttgatagatctgtccatgacttgtctcttgtccatgggaagggcttgtactggtctggtctgagagggttactactagaagccacagttgctattcctcgatagtctaatagatttatattaaataattatttttctggtaatgatataagaacaaataatatacttccctgaattctcagaattttctttaaaagctgtagttatataacactcagaaatctatactggctttcccaagtgtattcaccctacccagggcgtcatcgtctcagccagcctcatgctgacctcagtagttttgtgatcttgaaattgctgctccaagttcacctctcttgaatcccaggcattctatgcaaggcttctttttctgtattcaaacactgacaggcgagttcccttcttaattacctgaacaagttggggaggatttagatatctccactggcagcaaggtgagagaccaaaccacgagctgaaggtacaagggttgaataagcatcagctatcaatgtgagcgctaggccctgttctaaatgggtcccatgtggagattcatttaatcctgacttaataatcctaggagatgaataatattttatctctttttgcagatgaggaaactgagaccaagaaaatttgagtagctgctgaaggacattcagctagttacatacagtatttaaacccagcaagttatctcagccccgtgttgtgttgccctctgatgaagggcagcaagggagatggtcttcgctggaatcagaccactagaattcccgagtgctttggggtcaccagtcctctctattggaaagttgttttttttttttttcttaattagtagttggatcactgtaaattctaggcaaatcgactttcctcagaatatgtgactcatcttgactaacaatcttttccaaaatatttcattgctcatcggcttgtacccacccccatgccccaccctggccaatttcttaaagactactttcctggctcaattttccttttctttagaatgacaaaaagtaattcctcttccatatagtttgtttaactaaagaatactattaatacaccatcttccccagacaacgaattctatacacagcacaggtggacgtgagcacacacgtgcagagacatacatacaaacacacacacactagtcaaaagcggagcctgaatcattttttttattttttattttttaaattttttggagacagagtctcgctttgttgcccaggctggagtacagtggcacaatctcggctcactgcaacctcctcctcctgggttcagtcgattctcgtgcctcagcctcccgagtagctgggacttcaggcacatgccaccacgcctggctaatttttgtatttttagtagagatggggtttcaccatgttggccatgctggtctcgaactcatgacatcaggtgatctgcccaccttggcctcccatagtgctgggattacagcagagtcttgaagtatctaagagcaccttgggacttttgcccatccctggcctttatcttccagacatcggtactgtacagcagatggctagtgatacagtgtaccttattctggtgttgagaaatgtattatgctgagtataacttaggctaggaaaaaactttattcctgataaaaagtagtgttagcagaggtagaatagcatagtgatgataatctgggatttggaagccagagaaaggcccagattggaatcccagcccaaccacttggaagcactttggaccctggccagttcgttcacttgtttaacaggatatttgtaaactctgtgtaccaggtcctgttttaggccctgggaatgcagaacacaaaacagatcaagactgcttaaatactagtatggaagacatacatacgtacatacatacatgcatgcatgcctggtaaccaattggctgtacttttaaaatatattcagaaaacaaccagctttcaccactgccatcatggttcaaacccctcggatcattgcattagcctgttaactgtttcctgcttctgttcttccctcttgcagtcttttcccaacagagcattcagaaagctccctctaacccgtgagtctgagccctctctcctggatgcaaaacctcacagtagagtcccattctccttgaagacagccatggtccttgacaggttgtgtccattatctctccatctccttcctcccatgccagccacacctgtcctccaggcctctgcacttgtctttcccctagcatctctgtggttactcctttaccttcttcataactttgctcagatatccccttttcaatgaggcttttcttatttgacagatagaacaatgcctgaataaagaaggagctaacccacctatttcatatacaaatatgccaaccctaatattcagaccagatatatttcgtaatacttttaaatcttctgtaacacatctgtggaataagcctattttgaagttcttgggagtcctatttctcccaggcactgaaacttgaatgtgtcatgatagtaaaccaagagattataaatgaatgaacattcagtttccaggaagagattaaaaaaaagacaagtaaattaccttatttgttttgtccagaatgtattccatttaaggcttataattctcaattcttgaggctggagaacagattgtagagcatcaggaatggtttgctaactcaaaaccatttcaagcttcttaacgcgatgcacacagcatttgggggctgccttcaggagtataagcctagctgctccctcgagacctaaagaaagcaagtgagaaggtgagtgcatatctcaggatctgacaggatggctgaaagcaaagagcctctattgtggcaggtttattttatagcatttttgtgccgatctgtccagaatcccttaaccggtgtgagggaaaaatcagtattattaggtaaaccaattagggaatctcagtgaggtatttttctctgaatctaataaagcagaagctaactgagctctacctgagaacagttgatgtgattcgatgtggtgctttcttgatggcagctggacacagatactttattctaatttacatcccagtgggatgacccatgaaccagtattcgagaaaagagccagaagaaaactgcagaaaaagcttcagaaacctcagctttgatacataagcacagagcaacagaactactgccaaaagtggggatggcaaatttgggggaggctttaacctctcagcacctcaatttcttccttggccacatggtagtcatgagaagcatctatagtggagccagcctgccttgttcaaattccaactccatctctctctagctaaggtagagcgagggttttcttgggtaaagtattgaatgccttagcatctttgggcctcattttcttcatttgtaaaatgaagggtagtaatagcccctgcctcatagagtcattgttaagagttaatatgttcgtatttgcaaaatgccttagagtggttctggcacatagtaagcacggtctgagtgctatttctataatcattattattatgtagtatgtgcctaatgaatatgtacataaataaacatagtctataaccagaaggcatttttgcaatttctttatttaatttgcattaaacttaatagagtggagacttagttctctgttaaactctttcagaaaactaacggacattaaatacaagacagcatgtttaaaattaaaattaagaagtatctgtctttatagataattatacaacactgtcaaatcagcttccagaaaatatcggaaagattctagagtaacatctttggatgtgaaaaagataaatcctgtgttcacaaatgtcattagctttatgtttagctttaagttttaaaaatgtttaccccattgtcattaatctctttattgataataatgctatttccataatcccaagggacccaattcaatatatttcttctcttatttctcctttctccactgaccttgttctgtgacattactttccagacatttgttgaatgagcatggtctgtcctggaaatgccaatgcagattgatacagccagagattaagcctcagtcaggtctcaagagccagaaagctctgcagatttactaaccatgagaatggaaactagccgcattccaggacattaggatttcactcttcccatcccaaaacgggttatcttttttgaagggggtaggggagaccaaatttccggttgggtctgggtgcttaccggaagattagcggtgggaagtttcttcagactagcttaagtagaaggcttaattgcagatgcttacttctaaggcagggtggggcgtggtacctggggctgagctgctgctgcttccaaagtgtctgtgctaaggagactgtttaccttcagtgccttcacacttttagttacaaagcagcagcaccttgtagcagcatcagttgtgagcatcttccaggccacttatggattaaaaactccaaaaatccccttttgaaaccataaaagcacagtttgaaaagtacctcattcttagtgatataacttcagatgttattttggtgcagcctggggaacactgtttgcctgaaacaggtagcagtcctcataatgataagtttaaaaagccactcaaccatattcgtgctgctggccttacagtctcatttttagattcttgttttaacattgcctacagacattattcttatattacttcaaacattcagaactaaaattattcatgattttctgaagaaatgagataatggcatcctttagaaaccaaaaaacaaatactctgaaaagtacctgttcacttgccccttactggaggtggctggactgaaatccagaatggagccaacccaaagcaggcagcattcctgaagaaagttcgtgtgcatgccctcccttttctcccctcataacttattttctcttaatttgagtttagagggtaacttagtctgagctgctatagcaaaataccttggactgggtaatttgtaaacaacagaagtttatttgctcagttctgaaggctggaatgtccaagttcaaggcaccagcagatttggtgtctggtgagggctccgtccccacagatggtgacttcttgctatgtcctcgcatgggggaagggacaggcacacccccgtaagcctcttttataaaagggcactaatcctattcatgagactgatgccctcatgacctaatcaccacctaaaggctacactttttaatactgttgcactgggggttaggtttcaacatgggaattttgtgggggacacattcagaccatactagggagaaatagtggtgcgtaaatttatccttgtgactgaagatctaatattccaaataacttggttctaactggcaagggtacttatagtcttgttgcaatcactgtaggatatatccagacccctctgatagctttagttcttcccactgacctgtctgcagagattcttcagggttgtactgcttcccaggctggcctgtggaaagagagtatatgaccactctgcttgtggcagttctttggtactgactgcactcggcatgccgctaagcgctctcttcagattatctcattctacatcctcaacaatctggtaaggttggttattatcattgctcttttactattgagaaaaccaagactcaggtttgagtaaataacctgcttctgggaaatgtagccagtaagccacagagcccagggccaagccaaggtcggtccgacttccaaattcataccttcagtcaacatttgtacatcccagaatcgtgtcctggacttagtgactctgaggacaccttcctcaagggcacatggtttctacctagagtgaggaaatatgaaccacatggctggagcatatttaaagaagataggcaaactatgtttgcacataatttttttttattatttcaaatacctggtccacagcgtacagttttcttaatgagattgctttaggaatccctctttatgtagaaagagtgtttttcatcttcctgatctagcccctctcatctgaattatccactgaactatccactttttcatcttcctgatctagcccctctcgtctgaattatccactgaattatccactttttcgtcttcctgatccagcccctctcatctgaattatcctgtagactgtggcacactaaggaataatggagaatgtaggaataagagaataactccaccaacagccattatctacctggagaaattccaggcagggcatttcaggaagtacctctggtatttcaacaggtgaacatctttctgtgtaatttatttttgtgttggaacacgagcttatggattgctggatcccatcccagaagtggctacccctccactgcagataagaataagagctccgagggtgggactgtcagcccatattgttgaggttttgatttattacccaagagttgtgttctaaagattccctcatttaaagtacatgcctctgggatccatgaaattcccaaggtggagaaacaagaatggatgtaactaggctagatggaagactgggagaataggtgatagttactgaaaagcctggcagggttggggctggcatcagaatcccctgaggcccattccctcccagagccaacatccaagcaaggcggagtgtccccataagaaacatgggagaaacatgccactcccttcagttacaccctttgttctttcagtcatttaaatatttgaatataaagggatgtaacggtgaataatggatgcagtgatgtcctctggagcttgctcagttccagtgcaggagacagacaataaatgtagattttagtcagtggcaagttcatgcagaaaaatcagcactgtaataggatgaggcgcgatgagcctccagatgctgtgtggctgctaggtctggggaggtgccatgcaaacagggaagccagaggcccattgatctctgttgtccacacgcaccactgtggatgcagcttcaatggtctcactgatagaacaacataataatgcttttgatgtattctcctgtgggtctcagaagtctagtagagctcatgaaagtaaagagaagtatttgggtttcagtcaatcttagcttcccagattccaagcatccatatgagaatgcttcatttagtaagttttgaatctatgaaatttactctgtactgtacggaaaacctgtaggaatgttttaaactcattttttgtttgtctttccccttgaattgcccagggactatgccagatagcagaaattatataacgttgggagtcttcataattagtttactttttaagttaattttattatgacaatgtaatatagctacacattctgcatagtatcctttaaccatgcctctttgcttatagacaaagtcttctttttatagagttaatgacctcctttttgtctttcgccgtattttctaatatatctggagttagattattttcccaaatgttccagcattcctgccatatgcctttgaataatatttcatgtgtgctcatacagacctctttcctgtatctctattccagggtcatttcagggccagttgccctctaagctgttccaacagctgctgtgctgtgacttctcatcaacagaatgtgggaaccgcctttggctgcccttctggatggaatcccctcttttcttggatctcatatctctttctttgtaggtttattctctcaccttactgaagcacaccctctgtaagcctcctaagtaaaggggcctggaaagtatatttttaatctctgcatatctacaagtatctttattctatccttctgcttgaagaaggattctctgagcataaaactgtaggttaatgattattatctcttaaaaataatttccctcaattttgaagacattaaatgctctttttaagtacagcaccattttggttcctgaatgtgcccagatttttctctagaagcttttaagatcctctctttgtctctggtgctctggaattttacagaaacttgccttactgtggattttttgtttctttattctctagatattccagccctagaagtacttgtatcccttcatctgattaacttttaatattatttattaaacaatttctccccttcaacatcttctattacccttgcttataattgttattacttgcttactgcatctgctgggatggatcctctaatttttatgatcttttctttcctgttttctaacttttgtcattttactttctaggacacttctttgatatttcttcaagcccacctattgaatctttaaattttaagtatatatttaatttccaaagtttatttttgcctttttctgttgttgggttttttaagtgcgtttgctttttattttagggctgcactaacttcccttttttctctatttcatttcctaggccttttgaagttctctgcaaatgtcctttgcatatcttgttttccttcaggtcgcttttgttctgtttgattatttgagtagtctctgcctttcatgttagaggtttggctgcccattaccatttaaaagggagttcctaaaactcagagcggaatctcagcgtggaggtgggagttgctgatgatggagtgtgctgtatgaaatcacatgcagagctgactttctccaaattagaacccctaacttcagcaggcgtctcccccagatcataccttcctagggctgatcagtttcttcagagggaaaaataattcctttctggaaagcatcctgtgttctgttccttgccttatgagagctcagcagagcggggagctaaaggtcccaccctttgaaggctccctttaccctagtcctcctgctatcaaactgctcccgcctgccaaggaccccctggatgctggcagaggtggcaagtggtgtgggagcttgcctcactgccatattagggtggggtttcaggagcccactactgctctatttggtgcttcacaggctctgtcttttcaactttgtttctgagcccacactctctcagttcctgctctttggggggtggtgccaggcaaatgcactcacttctccctgggatcttccccagacacttcgaatgattgccaccgtcctgtgagattagttccaattcatctgtacactttgtgtctctcttattctttctgctgtgtttattattttcattttaacagggagttgggaataaaaagagataaactaaataaatcttgctaccattttgaaccaaaagtaaccttaaggttactttttaatcactgattttgtataattacacattatttaaatgatagcagtcagactatttatctaatattctgtgtatgatgctataatctttagaacccattatgcagaaaatgctaaattctgtagtacatgaacatgatatggtaaagattttatacagatagtaattataaattatttgattaagcatgacttctcctttataaatactcatcgagaaaaaaatctgtcagctatgccagacttgttttcgtagctgtcgtgatttagattctgaggtacactttcccgctgcgcatacttcctttggaagacagaataaaagcagatttctgagttaattaagagtgtttgtgacagggatttgattttgttctatttatatagaatatgtgtttttcggattctttacaaatgcaaaggataagatatccatgtaggacaaaggtcttgttaattttatatcttttatatctctgctagcctactttaccctgtttcccttttatttgtttctgtttctgattatttaataaaagtgtcaacctagtgaaggagacaaagtggaaggctaggttccccattaacatcttactgttcaataggttgaattaggattgggctctattttactgactagaggccacatatactggcagaacattcagtactggattcgttgggttactcagtcagcccacagtaagatgatttgtactagagggagctcttcacgtccctaatgacaatgaaattgtgaaaccctcagcttctctggtaacaaagcacagcagaccattgctaagaggagttgtagtggatcaattcttgggttgcactgtctaccagaaatgcttccatctcaaagccaaacagatggaacagcctagttacaaatagagattgggatttcatgttacgctgcacaggcaacctttttcacttgagcttttcattatccttgtttatagtccttaaatctcagaaatgctgtcataacccatactctagtgatgtatgtgaagagaggtggaaggtaggaaggcgcatcctaaatatgcctgatgcattttggggagatgctaaaggatgagaaagccaccctgtttgcatcactgatactagaactgacttgcatatttaggtggaacttaaacctagaagcgtatgttgttttcaaaacttttcccatcactctacactcatctctattaaaatagtcacttaaaatgtagaattcatgaaggagacttaggaaatgtcaaatatggtatctctgactctagttcctctaaatagattacatgataatgaggaatttttaaagaaaaatgattctttttacgtttggtagaccgcaacgtcaactctgccccaaatccttgttctttggtgctgatttttttaaaatctcttatcaaaatataactttaaagcacttcagtttacagtaagaaatcattgaaatctagaattgttctgcttagattattgtaatttgtacatgaaaatattattgaggccaggtgcagtggcttatgcctgtaatcccagcactttaggaagccagggtgggtggatcagcttgagcccaggagttcgagaccagcctgagcaacatggcaagacccttctccacaaaaaatataaaaattagctgggcgtggtggcgcatgcctgtagccccagctactcaaggggctaaggtggatggatcacttgatcctgggaagttgaggctgcagtgagccatggtcccgccagtgcactccagcctgggtgacagagaaagaaaaaaaaagaaagttattgagaaactctttcaaagaacactattaatgtgttaaatttcttttgtttcttatctcatcttctcaatgcagtgtcaatttaatatcctcatagacatgaatcgtttcatatgattgtgctttattgccttcagtactatttaaaaaacattttaatccatggcatattctgaaccataataatggaaaaagactttttgttcaaaaagagacttcattttaaaattttggaacaatttaggagatagtctcatttttctgatttttaggccaaagtttgaccctaggttattttctcaatattaaaatatgacaaatgtgagagcccatttctccatataaaatgtcttatgacctgagaaacatgtcaatttacattgtaattttaacctcttgttattttttaaaatcatgattgttcctttatttgggaagcagattatggatctctgtctcttcccccagctgttttctttaaacattttactttgaaattacagattcacaagaagttgcaaagatggtagaagtttcatgtgtcacccggtaccctcccatggctatatgtcttatataattatagtacagtatcaaaccaggaagttgagcttgtatgtatagttcattttatcacttgcatagatttgtgtaaccaccaccacaatcaagatcctattctgtaccacagagatcctgtgctttacaagcaccctcatgactcctcatccttatctcctgaaaaccactaaatctgttctccatctctctaattttgagaatgttatatacatacagtatgtgactgtgtgacattggctttttttcatgcagctgttcctcagatacatcccagtcgttgcatgcctcaatagttcgttccttttcattgctgagtatcagccattgtatggatataccatagtttagttaaccatttgcccattcagagacattttggttgcttctagtttggagctattacaagtaaagctgctctgaacaactgtgtatagtttttgtgtggatatagttttcatttctctggaataaatgcccaggagtgcacttgctgggttctatggtaagtgtatgtttagtttttcaagaaactgcccagctatttaccagggtgtctctacactattacattcctactatcaaggcatatagtgatagagtttctctgcattcttgccagcatttattgggtggtgtgtctctctctctttttttttaatcttacttgttctaacaagtgtgtagtgatagctcattcatgaatagtgatagattttaatgtcttataatgttgacatcttttcatatgtctatttgccctttttatatgccctttgttgaaatgtcttttgcccattttccaattggattgtttggtttttttaaagttgagttctgagaactctttgtatgttctagatatgagccctttgtcagatgtatatcatgcagatattttccccagtctgttgcctatcttttcatccttttaacagagcccttcacagataaaaagtttttgtaattctaatcagtcaaatttatcagttttctttcatggatcactcttttgatgtcatatcaaagaacccttcatcaagccacagatcctaaagattttcttctttgttgtttcctaataataacatttttttattttacagttgactctatgattttgagttaatttttgtataaggtatgagataaaaggtatgaggtcaacgtttatatttttgcctgtggatatccagttgctccagcaccatttgttgaaaagtccagtcctttttctttgaattgcttttgcacctttgtcaaaaatcagttggcttaacttgtgtggggctctttctgggttatatgttgtgctccactgatctgtgcatctgtccttccatcataccacaatcttgattactgtagctagataatgtcttgaaattgagtacactgattcctcattctttattcttttatctcagaactgttttagctattatactcctttgcctttccatataagttttagcataatcttgcataagctcgcaaataactgatgggaggttttgcttgaccttctccctcattttcatctggcccacttttcttacacctgcttcttctttattgtctatcttgtcttatatgattgtctacatagaaaatctcaaataatctacacaaaaatgtaaataaaaaaccctagaaccaaaaggtgagttcagcaagttcgcagaatataagatcaacagacaaaagtcaattgtatttctcaatagtggtgagtatgtggaaactcatgttaaaaatactataccatttacattggctcaaaaaaaatgtaatacttaaaaataaatctaataaaacacatctagaacttatatgctgaaacctacaaaacactgatgaaaaaaatcaaaagtctaaataaatggagaggaagatccctatttatggacaggaaggctcaacctagtgaagatgtcagatttcctcaaagtaaacaggtttagcgcagtggttctcaaattccataaggggttttggagattctcttttaatccatttcatttttacaagaacatctagaatttgcatgtgtttggatggattgaccagggaagtgatttttctcacaatacacaagtactgtcagtatgtccaattaaaaataaccgttttactataaaaatatagttcacaccttctgtatgacagacaggccctgtgctcagtgtcttccagccttcacgccatatcaccttcactatcaccctgtgaggaaggtgctgttattatcccatttaacacatgggaaaagggaatcacacaaatggaattctcttgtccagagtcacagagctaaaagacagggaagcaggattcagactagaccaacatgagtcctgcatctgctctgcgttcagtgttccacggcctcctaggggtcttagggccttctttggtttcatcaggattctcacatcaagtgctctcagagaattctacttttcgaaaaatcactgtaatccttacatcacttccctcaccagcaccctgtgaggccctgttttgagtttccccagtctactctaggatttcagtttcagttagagagctgaacccaaggattatttaaattgtccagccatagggaaacatttgatagatacttttcaggaaaaaaaaaattaactgtgttttgagaatgttgattaaaagagcccttctcatctgtcagagaaggatggctgtataagtatttgtcttttgccctgcaagtgggggaaatggatttggggatgacacatcacttttctgaggtatcagaggaagtaggtcacattttgctgttgatcataatgtttgaaaaagctggcattgaaaaatgagaaattgcattttgagtagttctttgtccaaagactagaaatattttctgagacaaacaataagttttatatttttttttccatcatctccctaggataacttttcttttgtggtcagttttagcctgctaaaaggaatcattggctcttcatagacgtattggctgcatttattgaaatgtcttttcaagtatccttgtaaacacaggaaagcttcacctcctgagttctagaaacaacgctgggagtgatccagaatgccttagtaaataaaatagatgaaggtttaaaagactccgtctatctttagagctattaaacaaaagagaaacattcaacatcttccctctaatagtcaataagaaagaagaatgtcacaaaagagttcgatcccctctaggctaatggaagggaaaccacctgagtcagagttggtctggagaggcaagcattacacccagtggtctctgatgtcatctcagctctgagccagtggcctcaggggtactgtgtcccaactggagaattaacaaggtgattactgaactgtaattgctggctaaatgtcttccaaagactatcataatctcagaaataagctgacacattacatgcaaatataacatgaccttttagcacagtttattgcagaaacatccacctctcgataacattagaagctgcctccgttctccagtcagccacccccttcggggcccctgttggtagtattttagcccaataaatggctcctgtccagtggttcccttggcctggaggaaaggaaggcgctgctggaggcactgtacacattctgtaccttctcatacatgctgtatgagaagtatgtgaggctcgaggctcaggaccataaaggatgtgagggatcaaccctggcacagattgcggctactagaacagggaggaacaaaaggctgacagcttaccaaggcagagccacacccatgcagggtctccagtgcccacggctgatgagatgccccgcatcctgctccttctttcttccgctcttacttttttcatccagtctgcttaaacctccctcttctttactgtctttttttttcttagatttaatctacttatcaaaaacattcttgtcactttcttaatatattgcaatgatttttttaatgcttaaattcttattacagtttatctttaaaattctgccttcatgttctgtcttcatgttcctttcttcttgctttgaaagtagaagtttcaaagaaacatagaacctattagaaaggaacttgacattcacctgcctcctccttacacccattataggaatcccctctaaaatttcttgaacagatgttaagtctacctctgcatgaagcattcctaggataaaaagctagcacttctttaaaaaccaatgaattctagttttgaacagtttgaattgttcaaaaattcttccttctgttaatctgcaaattgcctttatagtctatgatgttcatctgataatgttttctccagttcgttaaaaagaacagtagctaacatatattgccgcctctacgatcatgagtcctggtatcagccccatggcacagctaaggaacctaaagttagagagacgattcttcaaggtcatgcagtggtaaatgggggaggggactcacatgttctgaccctaggacctagaacctgcggtcacaccagcctttcctccttataggcacagtttacattttcccttagaatccaactataaaatctcctccatctctaccctgaattgtgcaatctgttctgtggaatgtatgtgaatgcctgagcatgccacaaaaacagggaattgtgtctcttccattcatgtcaatacctccagtgctagtaacagtgcccagcgtgagtataaattgaatgattgaatcccttccttagctattatattactctatgaattcttagctgttttctcctaggatctgattccctgttgataaactttaagttcacagaagcagtacgttcttcctctgtcttacagatgatgaaattatcactcatcagatgatttgcttctgccagatgtctagcaaatggagagttgcagcaacctgtccctattaggttttgcctccatgaccatgaggccgttgtttacacatcagcgtctaagaatattcccacaacagtatcactgtcttccttttcatgctctctgccttgtgcccaccctcagcctccaacagcaatccatataggcacaggccccatcccacagaagctctcttcactgccactcctttagagcccttatgattaaaaaggccttctcctccaacgccaccgaccagttaagaaaaatcccatataaccgcctgacacctataagtcattattctctgggttcaaatttttggtcacattttaatccccctgttctcagcattagtgtaaagtctttcctgtatcaatgcatttttctttctgttgtgtcattcccaacatgctgcctttttttttctctgttgcccaggtggagtgtagtggcaaaatcatagcttactgcagcctcgaacccctggtctcaagcattcctcttgcctcacctcccccgcaaccccattagctgggattccaggcatgagccactgctcccagcccatgctactgtttttaccattgaaaaataaatatcctctcttggttctgcttaccagcctctaactattacctcctctccaaactcatgaaacaagccacctatatcaccgtctcctgttttattcttcccatctctcctgaaaccctgccaatcactttaccaaaacccttcttatctaagtcaacagtaatttccaccttagtaaatccttgctctgcttttcttttcagcacccatgcttgtcatactacatactatattgatccattgattaattgattgattgccatatatgtgagctccacatagtgtttattttgttcactgcctggcacatttgtagatgctcagtaaacacttgctgaatgaacaaatactctagtgggggtgtcctgccttctagttcttctgcctatataaacttgattaaacaggttccctttgaagtgattcccttgagggcagagcttaggggaaagttgcattgcgtgggtctgcatggttgaaggatctgtcgccagagatgggctcaggcttcaccaggataagctgatttttatctaatcaggtcatgactagactgttggttttctgttgcccagaatatattctaatttccttagaaagatattagaatacttattttccacgaaggagggtgtcgccacattttgagatccccttggagaatctcaccaaagagcttttattgtcactgcctcatattggattcattgggcctattttttatattttatgaatgcctctcctcaaaaagttttcacatcatcttcctgcctctcactccccctcactgatgtatcctccagcacagcaagtactcctaaccgcggcttctccctgtagtaggtacacactcttccaccgtagcaggaaggagttttgctgtgaaagcagcatggggcttggcatcgtacaggctgggggtggtgaggggggcgctggccagtatttttttttttccttcctggctgatgttcaggtctggcccctcttcagtccttgtggccacagatgtttccatgaccatccagagcagtcttagggcacaggcttagaatacagatggccccgaggtggacagcagctccttcagctcactgaccgcaggcaagtcattgagaccctccatgtctctgcttccccatctgtcaagtgggagaatgacaggtgctgggcagggcaggtaaataggagacatccaccctgcctggcatgaggtctggctgctgacaggcggccaacaaatgattgctgctgtggttcctcttcttaaattgaaggtgcctgtgcccaaaatcaaaagcttaagagatcatgaggcaccaaatatcagcaactaccttatactgcaagcaaaattatgctctttcttgttaaaacgtaggagaaaacttcatttctaactcaacaacaagaaagctagagactgagaataaaataactgtttctaaaagccaactccctttttcactttggggagttatttttctttagtaaacaagagtgagaagcttaaatgttaatcaagatagaagcaagtggtatcattttaacataaaagcatgatggaatcatgtaaaaaaaagtacattttattttaatgtatattgaaggcaaagttttcatgtctaatgaaagatgtattttgccctcccagcaatgtctgtaattttttaaagtattgatcagattacttttaatgttggttttagattattataatccttagagagcctcttaagtgagctcgattttgttttttttttttttctttttgatagcaggcacaaatggggaggccggtaagtgaacaaagccactttcataatacattaggtgaggtttttagatttgtattcttttatcttggggcaaaggcacatcctgaactaaacacatgtcacacgagaatctctacaagggattccaaactctgctgtccgccagtatctgctgttctgggcaggcaggagccaggcagctgccctccggtgtcccatccttggggaaggagggtcagtaccaccactcaccattcgggaatgaggactgtaaggcaagagcccaggaggaaggatgggactcagagggagaggtcagaaaagacttccctgtagttttgttaactcttttttcagcttggaagactcaaggaggggaggagattccaggagagagcgcagaatgtggaggcaggcatcagagagcctgggaaggaggagggcatcttggtcaggggaggctggatagaggggacagagcctgtggtcacagacccacatccccctgacaccagtctctcctctccctcctaaggcagtgtctacctttaggcacagctggacccaacctagctctgcccagtggagcccacgtctgctgctttcctttcaaggagcttaatggcagagctgaactgggcctgggcaaggtggatgaacttattagtcattgctgagcttcctgtcacttgaacccaaaaatatatttcaagtgcaaattgtgatgaaaccttacctttaacattctaggcttgaaaatgattttatgtaagacacgttaagtgctggaaagatgaaaatatgtgctgcaataaataggtgtctatcgtcttacgtgtcttattttgaagattatttatcccacagttcagtctgaatccacagaagtgaaaaataaactgttcttttcagaatatacttaaggcaaagaactagttgttctaacaactgctatacaaagaactcttcaagagatggaaaataattctaggtgttttttgacaaatgagatcaacaatattcactatttttttaagtgaactcactggttctgctgtaaaattctaccttgtattcatttccttttgccccttatttgtgctctaagcagaattcagtgctaatgtgtttcttaggtggtgaataagcagtctccatgtatttgccttatattggagattactccaatcaaaaggaggtacttggagtatcgtttcaaatatatacacattcccaacttcacttcccaagattttatctgacattttcattgggcctttacaatatgaaagggtgtgctaggtattctactgaatgcttaacattttagttcaactctgggaacatttgaaataatgcctactatgtgcatagctgagggctttactaaaaatagcagtaaaattaggtgatctctgctcttcatatgctctgtgcagtaagatagaatgaaaccacagtcttatgttactgttctttttcaaatctttcattattttcttcaaagttcagccaactttgacagatccacagtcagcagcgtaaagaaggaaaatttaaaatgaacagaactcagtttataaacattttaccttcttttttgtgcatttaagctattaacaagtagcatggttatttggtttaacaaaaaatcaaggctttttttcgtccttcaccctctggaggaagctggtattaatactaaacagtgaatggtcaaaagagtagattttcagaagtaaaatataattagtgtgggtgcctgagccatattactttaatataaagcatttaaaaatacatttggtgcttcatacatatctctttaacagctgaaacaacactgtgataaggtggggtgggccaagccatccttgtacccactttggtatgaagcccttgcccctccatagctgaacatcttagacatcctctttaaatgtctctggacatcagtttcctcatctgtaaaatggggataacaacacttggtttagggatgttcacgggatggaactcaaaaatgtgtgaaaggcattattacagttctggggacaacatatgtgcctaataagaaatggtcattactaatggggcattattacagttctggggacattgtatgtgcttaataggaagtggtcattactaacaggtaattttttaacataatttttgtagcaatttatctaatacactcacagaggaattcacccaaaatactgctttttctcccttcaaatttaaatgtttcataattttattataacacacattttatttcagagtaaatatcatcttctgccctaaggctgtttactagaaattaaaatatttttcaaaaataaatgttctgtatatattggcacagtaaactttatcatttgtgctagatttgccctagagtacaagtttacacagctaaaggagaaagcagtaacatgcaaagtgcggacccttaaaatggaccttggtagaagcactgggcacggctccccaaatccacaccaccctgggttctggtctgggctctctctgccactcaccagtactcaccctctcctctatacaaggggatcagaccgccttttaaggaggctcgctgagatgaggtgtgggaactcacagcacaaagacttataaactgcaggagttactaccagagtttataatcaccgagttcattgagttgttattactgctggaaggtgtgcctggttcacccaaaatggggaatccactaactctcagacttacagtagccagcaagtccttttttttttttttttttttttttttagacagagtatttagctgtgtctccaggctgaagttcagtgatgtgatctcggctcactgcaacctctgcctcccaggctcaagcgattttcctgcctcagcctcctgagtagctgggattacaggcacgtgccaccacgcccagctaatttttgtatttttagtggagacggggtttcaccttgttggccaggatggtctcgatctcctgacctcgtgatctgcccacctcggcctcccaaagtgctgggattataggcgtgagccaccgtgccccggcccagcaagtcttataaactctgtgactggagtagactagtctgtaaaaaatgacagtggtcccttgaactccacattcatttaatatttggtcatggcctcacacattgtcacaactgagcatgaagccacataaagctctccacaggagaggaaacactggcagaaagggggatcattttatgtttgtttggatagggcggcattcttattgtatttgcgtaaaggaattctagtggccctgctttttaattacttaaagtaattttcatcaagcaagtcattatatttccaagtgattcttggcactggttatgcgcagcactgatttctgtaatcccaggtaaaaggcaaggctccccctcactgatgcaagttaggggccctcttataataacacattccttaccttaggccaaggaagaatgtcgaactggaaatgtgaaatttttttctgactctctatttcattgtagttgtcttaaataggacgaaaacattttaaaagaaacttctaacatttttgttaatggctttacttacaaatgaaaatgaagcatgtggatgacttctctaaatgaccttggagaatgacattaaagtaaagaatccatcgtggattgagatttgaccggctatttttctcctaccaccagatttcatttgtaataatggctttattgtttactctagcctgtttcactcacataactgtttgctttgaaatttgaaactacatattttctctgtaactcaaataaaaatggggtcatacaagtgaccttttagccagaaactgcatggtcaatcctctttgacagaaatagcacaggccgtatcacttgagagtaatggaatccttttaagacaaaagatcattcatttaccataaaccttgaaatctaatgatggtgattatcaatgccaagttgcagacactggggacagcatttaataatagcttacattggccaggcacggtggctcatgcctgtaatcccagcactttgggaggccaaggcaggcggatcaccttaggtcaggagtttgagaccagcctggccaacatggtaaaaccccgtctctactaaaaataccaaaaattagccaggcgtagtggcaggcgcctgtaatcccagctactcagaaggctgagacaggagaatcatttgaaataggaggcggaggttgcagtgagctaagattgcgccattgcactccagcctgggcaacacagtgagcctccgtcttaaaaaaaaaaacagcttacgtttactgaacaatttctgggctgagctcctgaccaagcactttcatgtgtcacctcaaggaattctcaccccagccagtgaagtgtaggaatcatggttatcaatgttccataaatgaggaaactcaggtacactagctggagaaacttgctcagggtcaagtgtcctgtgttctttttccgtgccctaagcatttgccccactgaattctcatttctttgcctggatgaaatctcagacaggacctgtagccttttcagttcgtcttcaataatttagtccccagatcagtttcagacctggaagagtgctgcctcacatcaagatcaaaactccacctctggtccagttaaactggtttctcttctcccagctcagggccgcattggcttggagaccctgtgaagaagaagcatcattttcccctttacttgctccagctcctctcctgctccttatcagacggctctaccagcctctactgggcagaccctgcattgcgtaatgagcaagggacggacagagcattcagcggaagtgacaaggtttctctccctggctcttgcagtgggaatcaatgtcccctgggcatggcacatttcagagctggttctctctgggagcttttgggttccgtggaggcagccacgcctctgctcagctagtggatgcccccagccttctcagaggagggctttgggcagacattgttttctgttggcctcctttgaggggacttctttgagaatactcctagaccacctttccccggcacatgtgtgggccgagcaaaccctcatttttgtgcctgtggaaaggcagcttcatcctgcctgtgtgatctggttagagagtccattacagactctgcccttagacttctcagactggaggtataagccagttcccaggctcctcagctccaaggggcctgtgttgggcttttttgggtggccttgaattcagccccagccagtgtgagatgagaggaggctatggccaccattgtgtaactgagcaccgagtgaagggctttaggcaaagctattcccattccagtagacttgctagcttgcttcgcccacctgacatcctgtgaaacctttgtgggtaacaaactgtacccagtccactccctcctgacttgccacttggaggatcctgtcacaacgtagtgcatattcacttaagtcaaaataacttttccgtttgatcaacacgcctgtgtgagttttgtgctgttgcactagtattcctcagcacacctcaggagcaccactggggtggacattccttgacctgtatctgtaaaaacgttagaaggtaaaagttggccttccctgcatctctacacctggttcaacatttgcttcccatcctctggtcatatagagtagatgtgtcaaaagaaacaagactttaaaaggttgctgaaaaagtggagaaatgatttactcatcttgtcgaaaaaattaaagtgcctaattaaaacaaaataatggaaacacagagcaagaggatactttattaaataacattggaagacctactgtagtcagctgaaagaatacgctaaaatatgactagactactggaatgagaagtttaaatattattaggaaaagtctgtggttttaaagaatttataacatgatagtgttgttgtcaagaagattattttacttgcaatccggagctgattgctgatggcaatgctaaggtcagaaagagaagattcaggcatcagaattatagatggtgagggatttcaccatggagataagaaagaaaaagacacagcattcagtaattggaaaagtgcaggtcctgaaagggtgatggttttgacttaatgtttccagatggttggccctctgatttcatactttctgtccaatttatagtgtgcaaagtcagtcttttttggtcagccttttactcctccattcgctctttcacttttctcccttacttttgcattctttacaagttatgctcacagtataaaaggggttaatgaaagtgatgatgtgcttggaagagaaggaaaagggaagatgttgaaaagcatagcatatattatgaattaaaatgaataaatacttggggaggccgaggtgggtggatcatgaggtcaggagatcgagaccatcctggctaacaacggtgaaaccccgtctctactaaaattacaaaaaaaattagctgggcatggtggcagctgcctgtagtcccagctactcggaaggctgaggcaggagaatgggatgaacccaggaggcggagcttgcaatgaaccaggattgtgccactgcactccagcctgggcaacagaacgagactctgttttaaataataataataataataaatgtctaaataaaatggataaaggaagcaatggaatggcattgctgttggttaaaaatggctcaggcagacggagcagcaggaatggacacagtgggtgtggagggaccactgtagttgtagttctgtttggcttaagcccagggtgcagaggaagaagggaacaaggattggaggggagagtgtatacttcctgccaaccacttctccgtagtcaagtgggaagctgggaacgactcatcctcaacatgtacctcctcaccctctgcatcctgtctgtctcccagttcagcccagcgtgcctcttaaacatctcttgaaactgtccactcttttctccaccctaaagccaccctcctgctaagagtgaagtgaatgaaaatgcctgtgtgctcttatttaacccactcaaaaagccctcaagaggtaggtactattgctatccccattttccagatgggaaatctgaggcacgagaagataaagtgaactgcccaaggctactcaaccattacggggcagaaccataggcagtgccatattgggcggtgctcagagcccagctgccatgaccccttccctgggaagctctgactcacctctgtgcagccacacttaatccccactcatcctgtccccatactgcagccaggggagtttaaaaaaatacaagtatgaccatgtcaccaatgctcaattacccaataaaatccaaagtcatctgcctttccgctacacctagttggcctctgaccgctgtcccctagcactccataccagccactggagtgtcttgaatgtaccatgaactcaaaagctgccctgatgagggatgccctcgcctcctgggtctttattggagtttgtctcctccttacccttcctttaccttcaagtcctttgccacagtcctgccaaatttattttctacatcattcattcgattcacatttaccaaatgcattttgaatcttttttttaagttcaggatttttctacgtcttacacataattgctccaccaataggtactaattaattgaacacagccataattcagtcagtactcttgtattgtaaatgaatctctcttccatttgtaaagaatccaaaagttcacattgccgtgggaaactgcatttttacttcaaagacaaggatgcgactgttcttaaaagggaagccaagagtatagatatgagagtgatcagagtcaagttggaacctgatgcttaaagttagtaagcacaaatactattaccagaaaaatcaaaaagcagtgttccagagaacagttttacacatattgtaaacgttttgttatctggcatgttaggaagctagaagaatcagttctagaattcttaataacttcaaaggtaaattgcttcttttatttgctcccaagaatgtttgagctaaagacatttttcagctcaccagattgaacacatttgtttttatagataagaaaatcaagacacttagatgttaggtgacttagagctgaattactcagccttgctctttcaataccccccttttcctgctgtgagacacaggggaattactcattctcacatagaaacttctgtgggtgaatccaggttgtgttcagttcccagggcccttgctctaactccagtgctttctttcctacttaaaatttaaagactaattaggcattaactatccttttctttttcattaccagaagcactctttaaagaggaagtaacaaaacagcagcccaaatgtggccaacagtgtttttaatattgaatttttaaatcgggagagtttgtgcagagctctggatttgctgttgcgtcaacaatgagccacattccccatggcagcccgtagcggggggctcctttccgaaggccacacactctcccattatctgcctggcctcagaggctttgaggcacaaattgcccggattacaggaactttggctttagcatttttttcaaataaactgtgtatgaggttcattctctatatctaaccacctccaggattgcaaatgttcttgaggtctccccaaggttatagttcagctgagggtcctgttcacctgactgcacctgttcacctgactgcacctgtgaggagctggcagatgggaagttagaaaggttcaggccactttggttttaaaaacttggaattctctgagattgctatttctgtgcctaaaaagctcagacttttgctcattcagagacaagtaactttggcctgtttcctctgtgctggaggcatttgggttctaatgggatgctggctagcacagaaatgggcttcccccctttcctgttgctactcaaaggcaacaaacagcatcacctgggatctggtgagaaatgcgtaatctgggtctcacccgaaatctaccaaatcagactgtgctttaaggagatccttgaggggtctgcaggcccattaaagtttgagaagcaccactagagtgagtagtgggagataacattgctcttccttgtccttgggtcctttgtcccccagctggctctatgtgccacctgttctccctgcacaaaccaggactcccccacagatgatgtgctcccccaccccgacccctgccaccatcacccccaggccagattgcttttgagttcacatttgagttcatatctgctctgattcagcgaaccattagcaccttggctctgccaagtttcttttccccagtcctttttatcccttcatgaaattttcaaatggatgttaaacagggtagaatgtagccaagatggtttatgaatcgaagtttctcccaccctcaggctgtgttctctgtcctgagtcataagtcaaggatcaggcaaggctatataattatttttgttgatgaaaccctacggggccaagatctaattttccttcctcaaaacaacacgaagcccctctcagcctggcggttggcctatcccatcagtgcctgactgcacctcagggggcctgttcaggacatcagagggctgacagcaaggccacagccagtagagtatcatgtgccacagtgctctctgaacagacgtcatggttatctcgtacaaagtctacactacaaaactcagagtatttctccagcactgtatagctctgtcccagcccacactgtttcacagtaaaaaataaaagaaccagagttaaggattaagtaaatattacaagagacagcaacctaagtcacctgcttatttttgaagtaggtttactttgttggctaaaccaggtagaaaacttggagtatgccttagtatcccacaacaccccaaacagtatctttagtttgttctgttgcttttgggtcttccaataagatgaagttgttttttttccttcccagagttcacatcaaaactataaactctaaccatggtcatgtcaaaacatcatcactgtgttgaaaattattagggaaattgggaatagcagaggaggagtgggaaggggtagaagccaaaaggaaatgaagtatgaaatacttgcagataattgctatgtgtgacataattctttcacacagattttaagattagtaattgttgaggggtgtggaacaattgtgagtgctggaggagccgtcttgagggtgtctgccacatgaatagagaaagcagtgtgcaaggaagacaagcagctttctggaaaatgcttcttagaagatagactggtattcctcactcttgtgaatcgacagtcaggctttttattcagtgttgccaacagtaccaaagcctaccttaacagacacgcaggtgtgcatggaaggccacgccagtggtgtaggtgttttaggcttctggtcctaatatgatagaactagaagagaagatggttagaagagaagcacaggcctgcatgaggaggaatgttacatgagaactacaactcatcttcagagagcgttggcctaagaacagtcagtgcgggaccatagaaaaattcagtcattcaccaatattccaacacgccattttgaaactggaagtaattccttcattcttagatcctcagaacctcacgattttacagtacgaagggattgaaggaatcttgtccaactaactcgtgccccaggagaagggagatgaactttgtctcccactgcccactaggtggtattcccactctagtcctcaggcacaaagctgaaggttgcagatcttggtcctgcccctcactgtgcccccaaactttctggtattgtcctggggtcagccctctcccaagggtcccgggtatgatgacctcggagttgcatcctggcccaggctctgctgcctgttctggctctgagtctcttctgtaaagaggatgagattgtgcctccagaggaatcggggctcccttctggcatttcattcaaaatgtgttcaaagaaacaatctcatttcatcttaatgggaggaggtgttttttgttttttatactaaattgaggtatcaaaatagaaccgcacaattaaaggaaattgttaatgtaggtattgccttggggtttctcaaatcttgcacaggaaaatatttttattagaacaaatcccttcacagattactaaaattatctctaacaaaacatggtgatgggttgcatttacagatttaagaatttcaggaaattataaggagaaataccagcagatgtggttgtaatatgactttatttattttgtaaattagttatttggcatgttagttgaataggttactctcttagcattcctaattataaccaaagatgctgttaaggtcattagccccttgctttggagtgctgatgcatttgtaaatgttctctgcctgcagtaacaggctatgggaggaattgtttccaggggctgcagggtaagagttacattatatggcatatgaaataaaaagactccttacagaattacagtaggaatattgataaacgttcaactattgacaagtgggttttattgttgttgttggcttggtagtcaagttgtcccatgaaagcttacctattacccaagttttctatagtattaaagtaacatatttttaggtatgattggacacttttaagactttgttcctagtactgtagaggatttgggaatatacataccatgaagaaacttttgatttctgctcattaagtatgaaaaattatggataacttagggacaatcaaattatctactcatatggtaaatttggaagtatttctatggatcttctaatgttaaaaaaaaataagcttgtgtttaatgggtggaactccatacacatttgtggttttcaggagaaagtttttaaatatattggttggccaaagtaagataactgaaacgtgttgaggttttttttttttttttaaactttgtagctttgctgccaatcccatttcttgcccttttcagtttatgaagttaaaaaagtgactgttgcaagtattcctgagaaattggtagtacagagggagaagttttgcttcattgcaaaagagataattcacgacgttgcaaccggggggcatggaagggattcgtaggaactcagtggcatgtaatgagctggggaacagggcttggctaagccctcattcctacgttcatcaagtatttgctgggttttgagctgagaaatgccaaccgggcgtgttcagaaggcggatctcaccaatccggaggcagctggaagagttcgcgcgtgggaaacctcagccctttctttcttcccggcacagcgttgtgctgccgcgcgtcggcgcaggcgggggcgcaaggcccgggtcgtccccctcgcgcggtcgggaaaacagctactgagctgcggcccacgaccctcggccgcgcaggggcggggcgggggcgctgcggggtttctctgttgctagagccgtgatgtcacccgcccctcctaacccgcggttggttgttttgtgtttcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggc

SEQ ID NO: 38739 - DNA, 122213 bp, Homo sapiens; identical to SEQ ID NO: 38216

SEQ ID NO: 38740 - DNA, 26797 bp, Homo sapiens
ggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccggggttcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccagttagtaggatttggagatgtgaagtcggctgtgtggagcccttgatgtctggctcagaggcggtgttatgaaccctgttgagcttttagaatctaaccgtgtgtgttgttaactgccagaaatagcctcgttccaccagagctgaagcccagggatggcaaagaaatagcgtctctgcctaagctgtttcccacgtccgttttgcaagggtgtgttgattccttgctgggaactgagctgctaggggatggcgaagtcgaaaccccattccggtgggaccggcccgctccgctgtgctgcgaacctggcacaccgtgatgaatagatactctgaagccaggagaggaagcgccacttgatggactcctgatatttatagttacttttgggttactttttattccccctttttcgagacagggtcttatctttttgtttttgttttttaaagagacgcagtctcactgtgttgcccaggctggtctcacgatcctcctgcctcaagtaaaccgtgtaactcatcaagatatgtagaatcaagaactagctttattttctctaggaacaaagtacagtctctttgcacacagcgtgtgttttacgactgtagttagtggagtcagcaccaggaggaggtgtcttggttcttatccaggactctcccctggtcaggcgatctgggacgacaggaatagaattatgccaccactagggaagggaaaagccctcagccatgttcagaaaatcaggccgggtgcatggctcacgcctatagtcccagcactttgggaggccgaggcaggaggatcacttcaggtcaggagttagagaccagcctggccaacatggcaaaaccccatctctactaaaaatacagattagtggagagtggaggtgggtgcctgtaatcccagctaactgggaggccgaggcaggagaatcacttgaacctgggaggtggaggttgcagtgagccgagactgcaccactgcactccagcctgggcgacagagtgagactctgtctcagaaaaaaaaaaaaaatcagacatgagcccctcacccagggtttccttccttgggggaactcaggcttgtacccctcttggtttgtggcagactgcactgacttcaggaccactttcatggcggccccactggtgtttctcgatacctggaggcagcattttttcgtttaatattacccagggtagcattcgttgagcgcctactgtgtgcaggcagagtggcaggtgccagaacagtgaagctgaataagacggccacagaacaggagtctcagtccatgtgtgttgagggaacagctgtgacatggcggggcctcagcggcacccgaaaggacccgcaggtgtttgccggaggggcagactgtgaaaggagtaggctcgtgggtgagaaggaccccgagttccctttgggatacatgaggcatgaggccctgtgagcccctgcttcccaccaggactggccacgcctcggacggcaggacagacttctgggctcctcggccttggcgttcgctcgcgagtgtgggcaagggcacatgtgtgtaatacgtgcatgcgtgagtgtggatgtgtgtgtgcacatctgtgtgtgggggttgtgtgtttgtttgctgggaccaggccctgacgccctctgcacttagggttggctgtcttcgcaaagcctggtcagtcggggggagagggggagcctcctgtttcttagtgagaagctgaggccggggaggccacatgacttagctaaggtcatagatctcaagaatgttcaagtcagggtctggagagtgaccctaaccccatgggtcagtggcatgatgccaggagggacagagccgggccccacaggaaagctgtgctgcaggtgttgggcgatggggacaggttagcccctggaggtgctgacagctcgagagagagatggaaagacggagagacagggctgaaaactcagtgtctgtaaaaaaaagaccgggcacagtggctcacgcctgtaatcccagcacgttgggagactgaggcaagaggatcgcttgaagccaggagtttgagaccagcctgagcaatacagcgagacccgtctctacaaagagtaaaataaaaataaattactgggcgtgggggtgcacgcctgtggtcgcagctgctccggtggctgaggcgagagcatcacctgagcccagagcatcacctgagcccaggagttcgtggtcacggtgagctgtggtcaccgctgtactccagcctgggtgacagagcaagaccctgtttctaaaaataaagaaaaaaacaccacgtgtggtccggagaaaacaaatgccacgtgtggtccagagaaaacaaatgccacgtgtggcccggagaaaacaatgccacgtgtggtctggagaaggcagtgccacgtgtggtctggagaaggcgatgccacatgtctggatcctgtgaatcgaggatatgtttcatgttgcaggatagacgtgcttggggaagtctttgctgagtcttgctaatgatgtgtctgtgtctctctgcagactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaagtaggtgccgccatgtgcccagactggggggctgtccgcgtgcgctcgcctgtgtgttcctatcctggctttgcgcggtggggggcgccgggccctgtgtcgggacctgccgggctgggaagacgtgccggtgatgagcgccacttccagcctgctgtgtttgcgcggaggcctgcgctggcagcccagagccgctccttgaatgccctgggtccgccgggggctcagagggccagagtgggcctgtgtggccgtccctaggacagcctggaggagcccacgcggcactgcagtggtcagcgtcctccatgctgaggggcagacgccggccacgggcagcctccgcaggctgcagccccagttggacgaggcctggctgaggagtgaggggctgccacaggtggctggagagctggtacagggtgctctgggctcctcctgacacgccctctaccctgtgtgtttggggtccctgtcacacacgggccgcgtatcacacgcaggctgggggtgtgtggggttggcttgttttgctggcctggtcgggagcagagctgtgctgtcagtggcccatccttggccgtcactgcccccaccctgctgagtcccgagaccctcttgctgcctctgtgcctagtgccgagctttctcccccgaccccatccctgagtctcgagagcctgttgtgaggggtccaagatgggtcaacctgaccactcacccacaaggagccaggtcctgcacgggcgccttactccttacggcacggccggggtgccctgcggtgtggccctggaacctacttgcactcagcgctggcctcacccctggaggcagagcagggtcagggcgtgcccgtgagtcccccaggccagccagggtgccgggcagggagccgaggtgcaggtgagagaacaccctgggcctcctgggacctgcgagacctgggcacaaggaggcagcccccgccgcagggcctggccacgagctcaccttcccgcagggcctggccacgagctcgccttcccgcagggcctggccacgagctcgccttcccgccgggcctggccacgagctcgccttcccgccgggcctggccacgagctcgccttcccgccgggcctggccacgagctcgccttcccgcagggcctggccacgagctcgccttcccgccgggcctggtgctccaggaccagtgcagaggggcaggtggcaaagctggtgagcaaggggattgggcagggctggggtcctggggtgcaggagcaggtaggaaaggtgtgaggactggtctggctgtgccacggcccttgggctgagggccaggcgggagggccctgaggatccaggctttcgggcggagcacaggtgagctggtgggacggaggcacggtgccagctggaggacctgggcaccaggtgtggtgtccccttgcacctctcctcagatggtacggttcgggggtccttgcgtggcctgagttcacttggtggtgagctgaccaacccacgaagaggctgctggtgcccctggggcctgtcaggttcaccacccctgagctcacgaaggcctggctcgcggcatcacaggggaagggtccccgtccctgctcagccggtgctgggggtgggctgcacgcctgggcgaggggagttgaggcttctgctcggtgcgtctccagctggaccggggtttctttttggtgcctgtaacgaaaccccaagctgtctcgtttgaggaggtgggcatggggagtgggaagtaacagcaggtctccgggtctccctgactcctgcgccgagcggcgacagcggccgctgtgggtgtttagacttcccttcccacacgcgggtcccttctcgcccttctcctgcgtagggccccgtccctccaggacccacgttcactcagctgtcctgtctcctctgtctcctctgggctggaacggtgtctcagactctcccgtttttgtgaggacgtaacagttctgagaagggctgggtaggaggttttaggctgtccctcagtttgggcttgtgggatgtgttttctcctgaccgtacagggttgagggtttctggaaagagcccccagaggggaggtgccatgtttcctcctgaccgtacagggttgagggtttctggaaagagcatccagaggggaggtgccctgtcctaggggcttttgagcttcacttccttcccgcttccctgcaccacgagatgctccaggctttccttcccgcttcctggcacggtgagatgctctgggctcgcctccgtgccacctgccccagtgcaatagctgccgcctttccaggaagccctgtctcccgtggctggagctggaagccagggtctgggcactgggcgtcttgcccttgttctctcaggagccagaacttgataacatgcgtgtgtgcaccagcccagtcacatctgtgttctgccagccctgttcacgtgtgtgtgctgtgtacacgtgggtaccggcctgtgcacttgcgtgtgtgcgtgccagctccatgtacgtgcaccgccctgcagccgtgtcttcaggcacctgagtttggatgagtgactccttgccgacatcttgactggaatcctgcgccatgtggtttctttccacctttttgctttttgctctgcctcgtgtgtgtctgtgtctgtggagtgtgtagagcgtgtggagtgtgtggcccgtgtctgtggcatgtggagtgtgtggcccgtgtctgtggcgtgtggagcgtgtggcctgtgtctgtggcgcgtgtggagcgtgaccggagcattcgaggatgcacgtgtccacgtgagacccaccaggtgccccacctgccacatggccacccgggtggccccgtccccagccggtgtgttttggggactgtggagctgagggtgcctcccaggcccgtccacctctgggctgctgcggctgctgagggaggggcgcgtgtgagcggcagcctggccttcttccatgaggatctctgcccagtgcttctgagccgtgcctgcggtgtgtgcaccctcgaagcttgcctggcccaggtcccagaggccacacctgcctgacgagggcctgcttgccacctcataacgtggccgcggctgcccctgagcggagcatagaggcaaggggccagggcaccctactctcggggatgcctccggcaaacgcaccagccggggtctcaagacctcgcacctctggaagccctgcctcccagtgctgttgccctgggggttaagtttccaacaggtgagctcaggacacgggcggctgcagcaggggtaggagcctgtggcttccacaaagacataatggtgaagccgagctctgaagctgggacgggagtgacctgtcctggggcctgtggcctcctgacctggcctgcgctggccccgtgtccccagtctgtgtccctatcccccaagtctgtggtctcttccatccttgcacacaatgttaagtccccacacggtcttcttcctaaatctcacaacttaaatttatatgaaggattttgttttgtcttgttttgagtcagggtctcggtatgccgcccaggctggagtgcagtggtgtgatcacagttcactgcaaccttcgcattccaggttcgggaggcctcccacctcagcctcttgagtagctgaaaccacaggtgcacgccaccgcgcctggcgaattttcgtaattgtttttgtagaggtggggtctccctatgttgcccaagctggtcttgaacttctgggcttaagtgatccacctgtcttagcctcccaaagggctgggattataggtgtggccactgcgtcctgcctatatgaaggtttttgtgtagccatacctgaagcatcgaaaataaaacatgggccgggcccagtggccacacctgtaatcctagcacgttgggaggctgaggtgggtggatcatttgaggtcaggagtttgagactagcctgcccaacatggtgaaaccgtatttctgttaaaaatacaaaaattagccaggcgtggtggtgcacccctgtaatcccagctactcgggaggctgaggcagtagaatcgcttgaacccgggaggcggaggttgcagtgagcaaagattgcgccaccacactccagcctgggtgacagagtgagactccatctcaaaaaataaaataaaacgtgaagagtgtgacttttggaagctgtggttggagagtggggtctggtggtgattctgtgtgacagagggggagggtccatgtgtttccccggggaggggaccgtggcatccaccttccccagtgtctctggcgtggcccggcaccccacaagccccacgtcccggacgcttttcgcgttgcctggtggagcctgtcgctgttggtggcaggttcacgcagccatggagtcctgggccggcggcatccgtctggctgttcggggtcctgggggcccagtctgacggccacctgcccatttgctgtcttgcagggtggatgtgaacactgaccggaagatcagtgccaaggagatgcagcgctggatcatggagaagacggccgagcacttccaggaggccatggaggagagcaagacacacttccgcgccgtggaccctgacggggacggtactgtggctgggccggggtgggtggggcggtgggcggggcgggcagggccatgggccttgcctggtgcctggagggcagacaggccctgtctgagggacgggcggtggggaagtgtcagccggagaccccgaggtgtggtggggtgcacggaagctgggttcatgatgccagaatcctggtgacagaggtgtgtgtgccaagcactgggcgtggcccatggagggcgcctcttatgtcttcggggccttcatctggtggtgtctatgcctcttggtggccccgaggcacagacgttgccggctggcctcacaggtgaggaaacgggtgtggggtgctggccggggccctggggctccagacgctggcatcctgccgcttccagcctgggcagcagagcaagaccccatctcagttgagaaggaagttcagctcagtatcagaggccctgacaggtgtgatctgctcttccaggtcacgtgtcttgggacgagtataaggtgaagtttttggcgagtaaaggccatagcgagaaggaggttgccgacgccatcaggctcaacgaggaactcaaagtggatgaggaaagtgagtgctcagccaggctcccgccaccggtctcaggcatcctgtgtgtgcgcgcgtgtgttgtgtgtacatgagtgtgccgtgtgtgtcgtgtatgagtgtgccgtgcgtgtgctcgtgagtacgtgtgtgcgtgccgtgtgtacgagtgtgctgtgcgcgtgctcgtgagtacgtgtgtgcatgttgtgtgtacgtgtgctgtgtgtgtgctcgtgagtacatgtgtatgcgtgtcgtgtgtacgagtgcactgtgcatgtgcttgtacgtgtgtgcgtgtcgtgtgtacgagtgcgctgtgcgtgtgcttgtgagtacatccaggtagctgttcatgtaggctcgtgagtacatgcaggtgagtgcgccctcacacccgctgtgtgcacacgtgttcgtcttaacagcatggcccaacctggttggtggtggctgtcaggagggaagtgggtgaagccgttgctgacctaggcgccgcccaggagtccggtggggagcgtgtgagctgtgcctgggcagctttcagctctgctggtcacggcaccttcacggccgttactcagttaggtcctgcagagaatctgaggctgtgagtctgggttggggcctgccccgtactctgaaggccacgtgaggcagagtttcctggggagagggcacagcctgtgcctgagggcctggccctgaggcctgggtctgctggagacatctgtgtggccgtcaggtggtcaccagagagcggtcaggtcccagggagaggctcttccttgggtctggggtgtggccgttggccagcagggcagcctcagccctgggcgggtccaagctggtgcctctgcgtgaagagggtggggccgggtggggcccggcacccgggctaaggccaggtgaggggagagccgggccaccctgcacggggccaggtctgggagagccgtccaggcagaagcccctgctggcccagttgtgaggcacagctgagcgggtaccgtggcgttgctgccaccctggggctccgtgtgcccttcccggtcatgcccgtggtctggtttggggctttgaggagaacgtgcagagtcgcctgctccgtcgctgcccggcatcctggggtgggttctctgctgccctgcagggcgcccgtgtcgcccacgggactggtcacgtgatacggggctgctcctggcaggctgggtgtatcttacacctttattttttgtgcctgcttaacttatcagtaacacacatttcctcaccagagtctcaaggcaaaccacctcttctttcttttttcatgagacggtctcactctgctacccagcctgcagtgcagtggtgcagtctcggctccctgcagctgtaccttccagggctcaggcgatcctcctacctcagaagctgggaccacaggcaccatcaccgcgcctggctaatttttgtattttttgtacggatagattctgccgtgttggccgggttggtctcaaactcttggacttaagtcatccgcctactgcagtctcccaaagtgctgggattataggcgtgagccactgcgcctagtcttagcctctttctttttttaatttttaatttttaattgtttaagagtgagggcctcactgttgcccaggctggagtgcagtggtgcgatctcagctcacctgtagcctccacatcctgggctcaatctatcctccttggaggacagaaaaataaaggtgtaagatacgttcctgccaggaacggcccatatcatgtgaccagcccccatgggggcggcctcctgagtgactgggaccaccagtgtgtgccaccatgcccagctgattcaaaaacatatattttgtagacacaaggtctccccatgttgcctaggtaggtctcaaactcttggatttcagagggttcaagtgacccgctcggcctccccccgtcctggggttgcaggcgcgagtgacccgcctgccttggcctctccccatcctggggttgcaggcatgagcccctgtgcctggccttgaccttctagaatgacgcggagacttttgagcctgttggctctgcctgctcttttcccagttcacgtactcttatctggagtttggtcctgtccgttctaaatcctgcaaattggacattaaaaaaactaaaagtaagaggatctccctgtgttgcccaggctggtctcaaagtcctgggctaaagggatctgcctgccgcagcctcccagcatgccgggattacaggcacaagccccagtgcccggccaaattggacgttattacttcctttccaaaagagtggtttacattttcctccccacacacggttcgtgcctccaccccggtcccgcgttccctgctgtcctgactgcgtctttaagcttcatcccgttggtccggcctgttggcgatgtgcttggggcaggaggccttgcccgtgcccgccccccaactctgattgtgtctgtctttccttggtgccactttatttgggtcttttctgcccaggacatggcccacctggacctagagctctgtgacatttctgtgaagcctccgtctacctttgggactcagcagaggtgtgtttagaattcactctgcgttttgggggtccccatgcatgctgaggtgctgttccctgcccacccgtgtccgatccgtcttggcctccccgacctcagggtgcctaggaccccccgacctctttgggtatttggtttctggctcaggaagagcagctgccgggtcctggaggaggggcctgggaagcgctggcaggcgtcactcctgcgacctcccacccctccctgcatggctcctgcgagggtcaccgcgtgagtccgggggctgctgtcctcgcgcctcagacctgattctggggaccgcggtgaaggcgtggcaggcgggcatcactcccttcccccgcctccatcgctgcctctctctgggtctgcgtcctcttctcacagggacagcagtcgttgactctccctgatccaggagggtctctccagatccttccctaacagcagaggcccggctcgtggggagggactgggactcaaggcttcttcaccagcctgaggttggtgctggggctcggcggcggctgtgagaatcctgtgctggagaaagcgtctctcggccggcctgtctggggcgtctgtgcctctcctggatgggtctcagtttggccccgtccatccatcccaggagctgcggtggagcagacagggaggggtgccccaggaaccacagccccgtcactcctgtcttcctttaagtgaaccggtcgtgtagatggaggttgttcagaaagggataagatgggacggcagctgggcctcatcccgcagtgagcgcgacgcagaggctgccgggcttgtggcaggggcttcggccagggcagagtcgggcctcacgtgcagggggctgagtgtgggcctcaacactggacttggccactgactgcagtgagccccaagatggggcaggaggtggtgtttctgtcctggagacccagggtggcttgggtccttgggatgtgtggggacctcggggtgagggcccgttggggccgggtgggcacggcaggagagcgggggccacacacccagaggcagtgccgtgtcccggctgggagggttcctgggaagctctgctcagccccagtctcagtcatttctagaaactgtgttttcctccctgtgacgtcacacgtgaaggaaacggaaaagggcagtgagtccttcgccccgcggcgccgtgcgcacgtcagccttcagggtgattccgctcctccagaggggcaggcgcgggtgtggggggtggggcccaggcccatcctgaggggtcccaggcatgaggggctctgagctgtgtcctggggtggtctgggccatggggaggttctggatcatgtcttgagaggtctgggctgtgtggggggtccaggccatgtcctgggggtctgggctgtgtctgtggggagtcagggccatccatgtattgggggtctggggcaggggggggtccaggctgtcttggggagtccgggctgtgtggaggggtccaagctatgcctttggggatcaggcctgtgggaggctctgggttatgtcttggcgggggtccaggctgtgtcttaggggctgggccatgttctggggacgtgtgaatcctggagggtggggccccggtctcgcgggtggctgtgtccctcgagttcaggcagcacctctcggaactttctggatttgcgtgctggcgtctgtcggcctcgatacccacaggctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctgggtgaggctgggtccagcctggccggcacgccaggacccaggaccgactggcaggggccgggcatcgtcgggaggtcggggcaggtcctgcgggagccccagcctgggtgtgggctgacccattcccgtctcgcagaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggaggtgagccctggcgcagccgtgtcccggagccggccctgcgaggtgctgtggcgggaggggctggtggatctgggcctgaggcaggaagctgtgctggtgtctggcctgagactccatctgggctggtcactggggcgtttgctcagcggtgtccaccaggctgcatggccgttgttggcgtttaggttcagacggatcagagacaggcgagcctggccgggctccatcctcagccccttgcggaggcgtcagggttctcacagcccctttttaacgggaccacaaggggaagctcatgctgggcccagcatggaggcaggtccaaggcccagcaggtgcaggtgggcggggcggcctgtgccacatggctggaatttaccaccttcctctgaagcgttttcactggtatcatgtgtaggcttgtttttctcccactgctgagtgagtcatcttgtttttatgtagaatcctgtgattcctggcgacagccagtgggcccggcccaggttagggatccttcagaactggggtccaggcctgtgtagcccctgtgccccgttacccctgctggccccgggcaggccttccggggcccccggcttctccctgccctgtgttttcatttgtgccgcctcccttcgggaaccttccagaacgtgcccacactcccgctgcagccaataggcaccttaaatagccacttcgtgcggctggccgcggagctcggagggggaaaggcgacgctgacctgtgccccgctcgcccgcagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttcattctttgggcgtgaaacaaaacacaacagcagcgtgctaggtttgtggttacagtttccactggagcgctggaggctggtgctgggtcacgtggagggttggaggtcatggccggttcgaggtgattctcctggcaggtggcaacgggcaggggctctgggaggacggagggcagcgctgcgtttgtgagtaggggtcagggggcagcagacgtgcccactgagtttggggtttggacatttaaggcaggagacagagccgcctgggggttttgggtggaggatggcaaggtctttgggtgcagtggggcaggcctagccccagatggggcagagaatggggtgtgttaggacggctggtgggggtcctgctctgtggcgtgtgggggcccaggctgtgtcctggctctcccagtgggagctcagggaagccgggagtgtgtcctcttcagtctgccctgtggtgcccatgtgaccggcctctgccctgagcccacctgcccaggggcccctgtggggccgagagggcgggttggcacctgggctggttcccaggcaaacgagattcacagagccacggccagcgcaggtggtgggaggatggtcccacgccctgctctaaggggctgtaattccctggagccaaccttcggtggcctggactctgtctttccccatccgtggccccaggccacagccagggaccatcatagctgcagcagcattcgacgccctgtgctgagggccgtgcacccagaggtgggaggtgtgagctgaggccatgctgtgctggacatgaaggcggggggacagctgggtatgtggtggcacctggcccttcagaggccccagccagctccagtctggtactggaggagcagtggccactcatgggctgccctgtgccgcccgcgacactactgtgtggagcggggagcccagctcctggggatgtggttcgagctgcaggctgccttacagaccttgggggtcctgagctctgggtcagtgtccagcctcctgtggccacgccacacccggttccatggacacagcagggctttcttggacctgtgaccttaagcccaggacaaggagacctgagcttcctgggcagcttcaagcaggaggggccgtgccccatcctggggccattgcagttgccagcaatatgctgggggtgccctctccatggtgcacgggccccactcactgcacctgtgggcagatgtggccacttaggccccaggagagcagtgttgcccaccaagacccccagttcacctgaacctccaaggaaccaattgcaaatgtaagctttttctcactgtcagtgggaaacccttgtgaacgctgggtggaaccttccacaaaatgccagaactttcctcctctgcccacctgggttggggtgtgcacatgcaggtacacacactgtctgggatgctctgagcccttccagggtcctctctacttgtggggacgtggggagggtgaccaacttagggaccctcagtccgagggcgggtggcctctccctccactccctccctctccagggccagcgggctccacggctgggaatttccccacgggtgggccgaggacaggcagctgtttcctgtgctcctgggaggaggggatttccagccccttccctgctgctctgttcctagaggcccctctccacttgcaacttcaaaaatgaacttttggataatcacaggctggtcacagttatttgaaaggtgcagaaagggcccagggagcccccagccccgcacctgctccccagctctccgggcagttcgcatcctctgggcaaacctggaacctgagaactgtttgcatagaaggtggaaacctgcctgcgtgcccgtgtgcgccaggccatccaggacccaccctcaccacctcctcagaggcctgtctccaaacactgccacatgggggttagggcttccacgcaggaatttaaggggcacagttcagccatagacacctgccgtgctcaggcacactcagcgtgggctgtggtcacgggtgtctttttttttttttttgagatgagtctcgccctgtcgcccaggctggagtgcagtggcgccacctctgctttgcaacttctgtctcctgggttcgagtgattctgctacctcagcctcctgactagctgggattaccggcgcccgccaccacgcccgaataatttttgtagttttagtagagacgggatttcgccatgttagccagactggtcttgaactcctgacctcaggtgatccacccgccttggcctcccaaagtgctgggattacaggcgggagccaccgtgcctggccatgggtgtctgtcttaccatggctgtggtcactgctgctcagagctagtcttgggcatacaagggggaccatgcttcagcagtgccacagccctgaaggtccagactgaggagttgcctctcctgactcagtgctgcctcagtttacccacgtgctccatggacctttttgctgagggtcgagccgcaggccaggccctactgtgccctggggtctgaacacggtggtcttgggcagaagaggtcagaaggcagaataagccaatgctgggggtgcccagaccccgcctttgtgcccagcccacagccagggtccccggcctgccaccttcctcctcccgcctcctctgccctcctcccctctcccctcccctcctccacagtccttatagccacaccccgcaaggaaaacccagactctggcgacagcagagacgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggtgaggcctcaggaggggtcgccacgcacgggcactccagggactgggggctggggcagggatgggccagccaggaggctggtcctggggagggggcgggtgaggggccggccaagcctggcagaggagccgcctgggggggtccacgggcgcaagcctggggcctgaccgctgcctgacgccggcctctgctgcaggcaacgggatggtgagccgctgcagccgctcccagaacacggtgtgccgtccgtgcgggccgggcttctacaacgacgtggtcagctccaagccgtgcaagccctgcacgtggtgtaacctcagtgagctcccacctggccccacagccccacccagcacagggggcggcagcctggcacccacattcccacgcagcagcatggggctcccacagccgcagaaacgaacctcaaaccacagcggggtctgctccgccacaggggtccttcgaggagctgaggcgtctcccaggggcaccccctctccctccgggggcccagactcggcccaggccacgtggagtcggggagaccacgctggccatgtggcctggccttgctggcctgagcagtgaggctggggggttgggccatggagaccctgccgcaggcggggctggcggctggaggcggtggaggggtagggaagggtggctggggctgccacggaaccagccccaggttgtggccaggaagggagggcccaggagcctcgggggctgcaggggctccaagtctcaggggaggccgcagacccctgcccacggccctctgtgtggtggggaggccaacctgtcctccagtgcccacgcttcctgaggaccctgtccacagcccccacctgaccacccccccatccggcccctgctcaggaagtgggagtgagcggaagcagctgtgcacggccacacaggacacagtctgccgctgccgggcgggcacccagcccctggacagctacaagcctggagttggtgagctcggtggctgcggccggcggttgggggtgtgcatagcggctgtctgtgacgcagatgggccgtgggccgcagggacctggccccaccggtgcctcctctggcatcctcaagaccgagctcccgggtcagggcccacgggtgggatgtgggcagggagggcttccagaggccaaacccaccacccagccatggggggcaagtgcctgccccacaggctctgccccatgtccccagcacccggggcctgtgggcagcccctgaccaccctatctttgttgcagactgtgccccctgccctccagggcacttctccccaggcgacaaccaggcctgcaagccctggaccaagtgaggggcctggccaggggctgggaggggctgggggggggttggggtggttaggagggcggaggagctggggagctgggaggggctgggggggcaggtggggtgggggcagttttgggggaaggggaggtgctggtggccctgggggcctggctatgtggctggacctggttggggagcaggaagctgctgcctgggggcagcctttccctgtgggtggagctgggtgtgtgggaccctcaccctccgcagctgggaggccctgggggcacaggacagggaggtgctggtggggggtgtagatgtgggagaagggtgtgtggccttggaggcccctgtggggggcacgtggggctgggcagcgtccttggctgtcactggcctggtgtctgtggtagatgctgcctgtggctggccagcgtggaccctgttatccccaccgcatctcccgggtcccagggggtttctggcctgagcaacacctcctgttccccaacagctgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggtaagggcgcctggcccagcccagcggggcccccaacccgaataggagaaggggagggcggcatgggggcccctcctgtggaccccacccagcagaccccttcctgcaggccgtgcggttgccgccatcctgggcctgggcctggtgctggggctgctgggccccctggccatcctgctggccctgtacctgctccggagggaccagaggctgccccccgatgcccacaagccccctggtgagtgcctcatggccctgccgcactgctcctggcgggtgaggcccacccaccaatctctccttttttcctccccagggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagacgggagtctccgaccggcactgtgggctgcacacctgtggcatggaggcttgggccgtgcccgcctctgactggagaggggtcttgggaggcttgggccgtgcccgcctctggctggacaggggtcttgggaggcttgggccgtgcccgcctctggctggagaggggtcttgggagacttgggccgtgccaacctgtggctggaaaggggtcttgggagacttgggccgtgccaacctgtggctggagaggggtcttgggagacttgggctgtgccaacctgtggctggagaggggtcttgggccagggtggaggtgagggtagcggggtcaagtgggaccctggaggttggtccctgggtgcgagttccagattgagtggggagcggggggagagactgggaaagctcaggcccaaggctgcctggggtggaggttcctggccaggcgctgacaagggcagctggcccctgagccccgggttgcccaaggagcttgggagtggctgacccccggggctctgtgtccttggaggaggagtgtagagacctgcccctcttcccctccacacctacgcccaccccttgctgcacctggaagggggtcccagggcccctgagcaccccgaggagtccctgcaaagggcccacacggcccctatgtccctgccataggtgtccagggggacagtcaccttggaaaccacagtttctgcttgagccaactttctgtccaccctgggccccggccgtcccactcctgcgcacttaagagtcctgggatctgaatgagaatgaccacagcgacttcatgtaacgtggccccacagtggagaaacccaggcatccgccagcagcgtggatgcgcgagtgctggcgtgttcagatgagctcccagctcctcggcccacaccacaggtgtccacagacgctcccaaggccctggggccgtccccggccgtgcgggaatcttctcaagctggtgtctgggagtggggtatccttcgagcagcacagagcctgctcccgagcgccagtcacgcccgaggccacagctcgggaacaaggcgggagcagccctgcaggcttcccgcagggaagacaccccgggcgtctaagcgacatctgtgtccctcgggaggcggaggtgcctgttcgcctccatggtgtcaggggctgaagagaaacactcccgagggctaagacgtctcactgcacttgttttttctttctttttttttttttgccggagtcttgctgtgtcacccaggctggagtgcagtggtgtgatctcagctcaccaacctctgcctcccgggttcacgccattctcctgcctcagcctcccaagtagctgggactacaggcgcccagcaccacacccggctaatttttgtattttattagagacagggtttcaccatgttggctaagctggtcttgaactcctgacctcaggtgatccacctgcctcggtgccctggagtactgcgattccaggtgtgagccaccacgcctggccctcactgcactcatgagcaagaaacacacagccgaggccggtcacggtggctcacgcctagaatcctagcactttgggaggctgaggccagacgatcgtctgagctcaggagtttgagacccgcctgggtaacatggcaagacccttttctatgaaaaatagaaaaaatcagccgggtgtggtggtgcatgcctgtggtcccggctacttgggaggccgaggtgggaggatcacttgagcccaagagatggaggctgcagtgagacgtgactggaaaaaaaaaaagaaatttaaaaaaattacttaagaagaaacacatgaagcctcatggaaggttttgctgagggcctggcacagcctggacactccggctaccgtggctggtgtggcccagccccgcagctgcacccgctgccccacacagcgtccctgggccagccttccctctccctgcgtcctccaacagcgcacgctgcccacggctgtccaggcctcctgtgcctggcggatggctcccccctgccggtgtcgtggaagtggggaaccggccccgggggtgcacagtgggagcgccacgcgccactcacaacagcccaaggtgccgggaccacaggtggctgtaaggaagacgcccatctctggcctcgggctgccctggacccctcctgcctctgcagctggttttctcccctgggtctctctctcctcaaacctctgtcttccacccactctctgctaaccacaagcctccccccccgcagcatagggaagtcagaggccgtcctgtcccccatccagcaccttcaccgagttccccgggttcctgcacacggttcagcctgcaggccctgcacagggttggggccgcgcctctgagagccccccgccccccgccccgtggggcaggcgaggccagacctccaggcaggatggcgggtgggtgggggaaggggtcaggtggccgggactggagcggccagatcctgtggggcccgcaggtcgacggctatgggaaaggggcctcctccccaaacctggcgcccatacccatcgcttcctgtctcctcccctctgggcacagcaccccccaggccccgtgggacttattccccagcaggaccccttgccgcacccccagatggacacggggccacctcctcttggtctccatgctcaccctccccgccccctcgcctgacgccatctctgctggcaactcctgtgccatctgtgccgaaggccctgcctgaactctggctcagtgcccatctgcaccctccccgtggggcctcacagctgcccttctggacgtacgcaagggctgtccctcgcccggcccgtgggctgctctgctgtgtgaatgccccgtcatttgtgtcaccggtgagctgctcaataagatgaacaagtcacctccagcctcgcagcccaaggataggagtcacggggagccggggaggggccttctgcggcgagagggatgggagggtggacgtcacacccctgcagcccctccggggaccaccctgtgtggcaagctgctctccggctgttcaaagtgtcagctgcgccacggggcgggggggaggggctcctctgcccgctggccgcctcccacttggccccataaactgctcgctcctctaactctgtccctgcctctagatggatgactcacaccgtgtggtctgatgagcattctttattttttgtgatggagtctcgctctgtcacccaggctggagtgcaatggtgccatcttggttcgccgcaacctctgcctcccaggttcaagcaattctcctgcctcagcctcccgagtagctgggattacaggcgtgcgccaccacgcctggctaattttttttgtatttttagtagagacgggctttctccatgtgggtcaggctggtctcgaacccctgacctcaggtgatccgaggcccacctcggcctcccaaaatgctgggattacgggcgtgagccactgatggcgcctctttctatccaggggcccagaccccctcccagcctcggggctgaagatctccaggcctctcaaaggcccccaggcccagctggccccacccctttccttccgagcgtcggggcggcctggagctgcagagaccccttccttctctgcagtgtctgagggctgcctctccaaggcaggctcctacatcttggatttgagaactccggggtgtcacaaacagctaattcctgtcatttaccttggaaaaggaggaaccgccttacggggtgaggcggtggctgcaggtctcaaaagggtgttgaaccacatccacgctcacgttcccgagagcccccacccccagcattcatgggggtctccacctgtgctggacggcgcagaagcagggctgggcaatccagggaggcttcctggtggaggcagggtcccagaacccctcggtgcccacaggggaaactgaggctcagaaagacataggacagtctcccaagagctctgcgaggggctcctcctcaactccctccgggacctggatctgtctggtgtgacggatgaaggtggctctgagagaccgggccctgggtgcccgcgggggcggctgacactgtcccgaggaggcgccagcaccctctcgtctccccaccagctcctcctggtgcccctcccaagccccggggaacttcccaggttggcctgaggggggtcctggagagctgcaagcaagggggaggggagcccacaggcctgcagcccatggtgagtttcacacctgaagccagccaggtggggtgtgctgagccgaggggtccctgtccccattctgtggggttccccagcacggggctccatggttgaggctctctgggggtggccagaatttgtggagacctctcggggactcgcagataccacccggaggcagtgggatggaggagtgattggctgacccccgccctccaaggggcccccatgggacaaggtgctataaacgccgccccctgcactggggacaccaatgtggccgcagactttgcatagaaaacctttctgatccccgccagcctggtttccccgcccctgccggcgacctgcgggggaccgggctgtgtccgcagtgtctacaccccctcctcacacgcacttcacctgggtcgggattctcaggtcatgaacggtcccagccacctccgggcagggcgggtgaggacggggacggggcgtgtccaactggctgtgggctcttgaaacccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggtaagtaaaccgcgtttacttaacgcggaccggccaaggcgtcccgcggaagccgggatgggtgggcgccccccttcccgtgctcagaccggcgttgctgaggtctaaggagggtgggcacagagccgccagcagcgggagccttccggagggaggcaggatcccagagggaggcggaggtgtgccagctccagccagtggccccggccgggagcaggggtgagccaggtgggagcgccctcaagaggggtctggggtctggaggtggaggacggctgttccaggtcctgctgggcgggtcgtgagcccttggccatcgcccagccccctcctgcccagttgagggcccccctgcaccaccgtctggcctgctgcctgcctctgacctgcacctggggatgagggttcagctgacacggctggtctggagaggaagctggcagggaagtcaccccagagcttcttcctccagggcctgtgggttgggaagggaggctctgtccggaggcccagtgtggctggtggtggggacagcagcgcccagacaccaggcaggcggcctctgaggtgtcgacgggcctccaggggactgtgcactgttgggggccacccctgggtcctgcaggggcagctcctggttgcatatggagttagcacctgggcaggggcagctgtggggcgcaaagggggagtagccaggccacatggccccaggagaaagagacagctggataaacccagggtccagactcccagccaggagccctctgctccctggagccaactgtgggtggagaacggacaacctcactcccctggagggccgaggggaggcctggggaggagggggcctcagcccagctgctggggggctggcctgtctcctgcccaggcgaggagtgctgttccgagtgggactgcatgtgtgtccagcctgaattccactgcggagacccttgctgcacgacctgccggcaccacccttgtcccccaggccagggggtacagtcccagggtaagtcctggaggtgcctctgggagtccacacaggccaggggttccactagggcccgaggcagagctcgtgggcacaggtgtccggcgaggacatgtggtgtgtggggtccggagtcctgtgaggccgggcagg

SEQ ID NO: 38741 - DNA, 8759 bp, Homo sapiens
atgggcagccccgagggccgcttccactttgccatcgaccgtgggggtaccttcacagacgtctttgcccagtgcccaggggggcacgtgcgggtcttaaaactgctctcagaggaccctgccaactatgcggacgcgccaaccgaaggcatccgccgcatcctggagcaggtgggccagggcggagcgggtggacagggaccccacggccagaagccccacactgaccacgtggtccccaggaggccggcatgctcctgccccgggaccagccgctggactccagtcatatcgccagcatccgcatgggcaccacagtggccaccaacgcactgctggagcggaagggggagcgggtggcgctgctggtgacacgtggcttccgagacctgctgcacattggcacccaagcccgtggggacctctttgacctggtgagctccatgttggctggggaccaggctgtgtggtgtacaccccccagggatgccttgaccctgtggggagagcagttgttggattagtgatggctcatgggcaccagccgacaaagaggaagctcccgaattcccagtgggaccccaagttctcctagccctcggagtgggcacaggatgccctgttcctgcctgccgccatgcccaccctggatgctggtgtggggccacccaagctaccctgttcaggcagaggaggggtggaaccccgcacctactgctgcgtttccggaagaagctgccttcgtgggggtggagcagttggctgcactcagctgcctagggggtggagagctgcccccttggtgagccttgctggggctgccaggtatgactctcctgggcctgccgaccggcctgttgggacacagccactcacctgtaccacccactcacacaggaccccggcctggaccctcaggcctgggcctcttctgagtctctgcccgcccccaggccgtgcccatgcctgaggtgctgtatgaagaggtgctggaggtggacgaacgcgtggtgctgcaccgtggagaggcgggcaccgggacgcctgtgaaaggtgtgtgtgccgccgctgctgtgggatttggggccggagggtcctgctggcctttaacggggcctcctgggcttttctggaaggccgcacgggggacctgctggaagtgcagcagcctgtggacctgggggccctgcgtgggaagctggaggggctgctatctcgaggcatccgcagcctggctgtggtgctcatgcactcgtacacgtgagtgaggtggggctgtgggctgcgggagcaggtgccgggcctggtgggagacgaggtgccactgggtttttgtcataggtgggcccagcatgagcagcaggtgggtgtgctggcccgggagctgggcttcacgcacgtgtcactgtcctcggaggccatgcccatggtgcgcatcgtccctcgggggcacacggcctgtgccgacgcctacctcacgcccgccatccagcgctacgtgcagggcttctgccgtggcttccagggccaactcaaggtgaggctgtgaggcacccccactgcccactcctgggcctgggcctgggccttggcctgcccctcatggcccgcctgctgcccgctcgcaggatgtgcaggtgttgttcatgcgctccgatggcggcctggcgcccatggacaccttcagcggctccagtgctgtgctctcgggcccggccggcggcgtggtgggctactcagccaccacctaccagcaggagggtggccagcctgtcatcggctttgacatgggaggtatgagggccgagggctggggtctcggggaggctcagctgctgggcccctgggtcttcaagtgacccaccagcaccccacccctgccaggcacgtccacggatgtgagccgctatgctggggaattcgagcacgtcttcgaggccagcacagctggcgtcaccctccaggccccgcagctggacatcaacaccgtggcagcgggagggggttcccgcctcttcttcaggtcagctctcctgcttcccaggctgggaccccagccctgtctccctcctcgtgtccaactccaaccccagcccttccttcccctaggtctggcctctttgtggttgggcccgagtcagcaggagcccacccaggacccgcctgctaccgcaaaggtaagagtcaggatctggccggcctggccttgccctccgcttgccgccgcaggcccagcccctcctgtcagccctatccctgctgcctactcctgctcccctgcctccagcccccaagccccacaccctgtccacctcccagggggccctgtgacagtgacggatgctaatctggtcctgggtcgcctgctgcctgcctccttcccctgcatttttgggccgggagagaaccaaccactttcccctgaggcctcccgcaaagccctggaggctgtggccactgaggtcaacagcttcctgaccaacgggccctgcccggcctccccgctgagcctggaggaggtggccatggggttcgtgcgcgtggccaacgaggccatgtgccggcccatccgtgcactcacgcaggtacgtccacctctgctctcccgcctgtcctgcccccagccctgctccctgccccaggcctcctgctcaggctgggggctggatggggtagagtaggagagcccactgaccccttctgtctccctaggcaagaggccatgacccctcagcccatgtgctggcctgctttgggggagctggtgggcagcatgcatgtgccatcgcccgggccctgggcatggacacggtgcacatccacaggtgggcctgggtgtgggtgcacggaggtggtgtgatctgcgccgggcttgggaggtgacctcccattgccatgctgcccatccctgcaggcacagtgggctgctgtcggccctggggctggccctggctgacgtggtgcatgaggcacaggaaccctgctccctgctctacgcgcctgagaccttcgtgcagctggaccagaggctgagccgcctggaggagcagtgtgtggatgctctgcaggcccagggcttccccaggtgggctcccagggtgccctggacagagggcttacgttgtcctcaccacgcccttggtgggtgttcctcctgatgacttcccaggtggtcccggggtgtgcgagaagcagaacaggtgtccttgccgggcgctgggtggggtggggtcagggcagggggtttggtgtgagtgcccccaaccacctgctgcaggtcccagatcagcactgagagcttcctgcacctgcgctaccagggcacggactgtgctctgatggtgtctgcccaccagcacccagccacagcccgctcgccccgtgcgggggacttcggggcagcctttgtggagcggtacgtggcttcctgactccggatccctggcaaggggccctcctgtctggccgcctcactctgaccactccttgggtccccgcggggagtgcaggtacatgagggagtttggctttgtcatacctgagcggccggtggtcgtggacgatgtgcgagtgcggggcaccggccgcagtggtcttcgcctcgaggatgcccccaaagcccagaccgggcctccccgggtggacaaggttggtggtcctgcctgtgccagcctgacagcacccatggggcaccgggatggggaccaagccctgtgagaggcatcggggagggtgctgggcccgggcgctgtactcacccgcaccctctgcagatgacccagtgctactttgaggggggctaccaggagacccctgtgtacctgctggcagagctgggctatgggcacaagctccatgggccctgcctcatcatcgacagtaacaggtgggctgaagtccggccagggtggaggatgtggacgggtccactgcggggcccctggtgcagggttctctggcccaaggctgcaggggcctgcaggactctgtatcccaccatcgttggggtggcccctggcctggggccgtggcatctctggttggaggggtgtcgcctggccccatgcagccctctgtgccctctgctccccagcaccatcctggtggagccaggttgccaggcagaggtgaccaagacaggggacatctgcatctccgtgggggccgaagtccccggcacagtgggcccccagctggaccctatccagctgtccatcttctcacaccgcttcatgagcattgctggtgagtggccgctgccaggctccctgtgggatgaggcgccggctgtgtcatggggtagctggcagggctgtgcccaaagggagaggcagaagcaggaccccctggcgacggggcgggcagtgtggccgcagcactggtgtggtgcagttggccatgagaacaaaccttgggcagggaggacaccttccccccttacctgcagccatgtgatccagagagtgccctcctagctaaggaagggatactgaggacagcacagggaacccatctgtgcagggtcaggccagcggcttgctgggagcccagaggtcaagagcctaggaaccaggttcttgctgtgccaggcagggtgggagggtcgaggggtggcactgggttcttgctgggggctccaggcagggctggggaaggtggtgtcctttacataggctaagacgtggccaagtgggcacaccgtcaacttggtcttccccaggaaaaagctgctgggtttttcctgggtcctgggtttgagtcctggtgggtcctgttcctccctttcctggggccaggctgtgggtgggtggggccagcgggcctggtcactttgtgctcctagagcagatgggccgcatcctgcagcgcacagccatctccaccaacatcaaggagcgtctggacttctcctgtgccctctttgggcccgatggggggctggtgtccaatgccccccacatccctgtgcacctgggtgccatgcaggagacggtgcagttccaggtggcccttcccccgcctcacccttccatccccctccctcaccctccaccccccccccaccccgctctggcccctgctcccctgtgcccactctgcacccatctcctggtttcagattcagcacctgggggccgatctccaccctggcgacgtgctactgagcaaccatcccagtgccgggggcagccacctgccagacctgactgttatcacaccggtgaggggtgctgcccgcctgcctctgctggggcagtggtggccgatgcagctgaccgtggctctccacccgctaggtgttttggccgggtcagacgcggcctgtgttctatgtggccagccgagggcaccacgcagacatcgggggcatcacaccaggctccatgcccccccactccaccatgctgcaacaggagggtgccgtctttctgtccttcaaacttgtccaggggggcgtcttccaggaggagggtgagtgggagtggggtggggcaggccttctgtaggctgggacacatggccactgctggcaagcaggcctggctggaccgtgggatgcagcccataggcccaggcctgccttgaggctgggaggagataggtggttaccccaaagggcagctgcagatcggatcccgggagctgagatgaattcagcctgggcccaggaaggcctcccgaggggtggttttgcgggtggagagttagccaagacgtggagggtcagggtgctggagagagaagcctgtttcaaggtgggtggctgcttgtggtgtgtgcagtcatactgggtggggtccgcagagaaacagcagggcaggggcagggcccaaaggcccctgtagagttttctgggcctaggtctgagtcactgggtggtgggtggccgtgaagggctttcagctgggcctgcgctgagctcccactgtgcccacgtgcagagaggattcggggtcttgagagtggcctggaggctggggggcaaggtggggggaagctgcagttgccctggatgatgctgatgtcttgggctgagtggagagcgagggcggggggtgggggacagttttagaggtggaggtgggtatttggagggatttgggagagggggccaggggtcaagtttgggcagctggaggtggagggcctggcactgagcagctgcagggaaggggggatggaggctgcaggggtgcctgtggtgggggtgggggtaggagagacagggaaaaacagccctggtctgaggctgcaggtctgggagcccaggggaagtggcgtggccagggtggagggtggtggcagagggtgggtgtaatggaaccacaggctgttctgggtgttgaggacacagatagggtggcccattgctggctgctcccttggtcaatgtgagctggggcaggggttgtggaccacagagggacatgcacaggcacactgcagagggccttgtggctgcctcagaggggaccctgagccaggctcaaggagaggggctttcctgaggtgctgagcagtcccaggccaggcctcggtgctttctaggggccagagaccttgtctggatctgggaaacctgggttgggggtgcagacagggttggccaggggctcagtgatgacactgtccatccagcggtgacggaggccctgcgggcgccaggcaaggtccccaactgcagcggaaccagaaacctgcacgacaacctgtcggacctccgtgcccaggtggcagccaaccagaagggcatccagctggtgggggagctcattgggcagtacggcctggacgtggtgcaggcctacatgggccatattcaggtgggcctgggcacaggagtgtgggcggcagggccatcctgcaggtgacctggccaccactgatcctgctccctgccaggcaaacgctgagctggccgtgcgagacatgttgcgtgcctttggaacctcccggcaggcccggggcctgcccctggaggtgtcctcggaagaccacatggacgacggttcccccatccgcctccgtgtgcagatcagcctgagtcaggtgggccgtggggagagtgcctctaggcggcaggggcacggtgcggccgctgacagcctctcccttccctcggggcgcgcagggcagcgccgtgtttgacttcagcggcactgggccggaggtgtttggtaatctcaacgcaccgcgggccgtaaccctgtccgccctcatctactgcctgcgctgtctggtgggccgcgacatcccactcaaccaggttcgcaggggtgtgtgcgcgagggggggccccagcccgaggtcaccctgagtgcgcctcctgggcccagccacggtctgaccccacgggtgctggggcggggggtggggtgctgtttctcccggagcccaccccaagagctcctgagagccgcccgccccgcacagggctgcctggcgccagtgcgcgtggtcattccccgaggctccatcctggacccgtcgcccgaggcggcggtggtgggcggcaacgtgctcacgtcgcagcgcgtggtggatgtcatcctgggggcctttggggcctgcgccgcctcccaggtgcgggggcggggtgggcgcagctcgggggcggactgggtgggcaggctggagtaggagcgggagggcgaggtggggacgccctgccccagcccagcgcagcgaccaggtgccctcaccagggctgcatgaacaacgtgaccctgggcaacgcccacatgggctactacgagacggtggcgggcggcgcgggcgcgggtcccagctggcacgggcgcagcggtgtgcacagccacatgaccaacacacgcatcaccgaccctgagatcctggagagccggtgagcggcgtgcgcggaggctgggggcacggccgggtgggagccggggctcgggccacgctgagtctttgccctcgtcctcgccctcgcaggtacccggtcatcctgcgccgcttcgagctgcggcggggggctcggggggcagaggccgcttccgaggcggcgacggcgtcacccgcgagctgctctttcgtgaggaggcgctgctgtcagtgctgaccgagcgccgcgccttccggccatacgggctccacggtgcgcggttccccagccctcgcggccctccccgcccccgcccccacccccgcccctggtctctctggactcctcgcctccctccgcagggggcgagcctggcgcccgcggcctaaacctgctgatccgcaaaaacggccggacggtgaatctgggcggcaagacgtcggtgaccgtgtaccccggggtaagggccgcggcctgtcctgtccccctcccctcccctcccctcccggccccatcccacagagggggaacagttgcagacctgaccagaggccgagtttaatttggccccggaaggaaagggggcgcgtaccgggcctccgtggtccatgggggcgggtgatggacgctgcccggtggggaggggactgcgcaggtgacagggaggggccacgcctgcactgagcccgcctccccgcccccccccgcgccaacaggatgtgttctgtctccacacgcccggcggcggtggctatggggacccggaggaccccgccccaccgccggggtcgcccccgcaagcactggcctttcccgagcacggcagcgtctatgagtatcgccgggcccaggaggccgtgtgaggatcccgcaataaagatgccttaagtctcccggttctggggacgcagct

SEQ ID NO: 38742 - DNA, 17877 bp, Homo sapiens; identical to SEQ ID NO: 37064

SEQ ID NO: 38743 - DNA, 13901 bp, Homo sapiens; identical to SEQ ID NO: 37602

SEQ ID NO: 38744 - DNA, 13226 bp, Homo sapiens; identical to SEQ ID NO: 37347

SEQ ID NO: 38745 - DNA, 4675 bp, Homo sapiens
gttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaaggtacttgttttcatctctatttgtagttgtttatataaaatgtaaggaaaaagtaaaagaatttgaaagaatttcccaaatggcaagaaataacaacagaatagggggtggaaagctggcatggaactttagaatttttccatctggttgggcccaggaacatagaaacaggctggacaacagaaaatacagaagatcatgccagagcctggtactgtgtatcttcccacctcagattccaagataaactaatttgggtctctttcccaaccagcatcacttataaggaagaggaggacttgacactccagccccgttcctgcctccagtgctcctgagtccctagtaggcctccaggagggcaaaagcaccgagcagggtaaccacgaccagcttaaagaactgtattcggtaagtggactgtgagctagtgctgtgacagggcaacccttttcttgcataccttgcagaggagggacattagcaagttggaagatgaattacagaggtagatggaatcttggaacgcatgtgtaaaagctacttgctatatagacaagcattctggcccacagactgtaaaatcaaggtcatacagatggtagtgaaaatcaggattgggaaaagagggagtggggacaaaggtaaaacaaactctgtaggacttctgggacataaagctgtttatgccaagatcctgcttaaagatgctaagcaggatctggaatccagaacttgcccacatatcatattgcaataacaagcctggttgtaaccatggcattttaaatagaagaatttagagaaaacccatataatgaaaaaagtggaaattattagtgagaaaggaagcacattataaagctttgtttaaatcctaagctctctgatgtaaacatttctaagttcctaaatggttattgtactcctgggttgaagtcaacaggcagtaatactgcctcagctggattgtttgatataaaggagaactccacaataggcataggctattagttcctgggactaagggatattattgcatctttaagatcttggctccaattctcccaggctctccccatcaatgcccaccttgcttcaacggacacacccccatctgcctgaggtctgatttgaagactagaggagcatttttactccttttccaggctgggaacttgacggtgctggctactgaccccctgctccaccaggacccagtacagttagactttcacttccgccttacctcccagacctctgcccattggcacggccttctctgtgaccgtcgactcttcttggatatcccatatcaggccttggatcaaggcaaccgggaaaggtgactgagcctggatgggagaatggggagggaataggtaggggatttcacccttctatcatgtcatagtacataaggctaattctggagctagatataagcaatccattcacctggcatgcagacaagcctgtgagctgagccaggatctggggttcaagggataagagtccatgggaagctggactcagatccagaaatagttgaataacgggaagtactttctagctgttcatctcagtagtcctttctccccagaccccttctgtggcttacatccagtgatgtgcaatctcttggcttccaagaaaaatctaccaaaactagtttagcaactttcatttcctggcttgggtgggtggagggcagaaaacgaccaataatatttttactgctccaagtaggtgtctttctggattctgagttggccaaatttttttttcccagtatttattgatcattcttgggtgtttctcacagagggggatttggcagggtcataggacaatagtggagggaaggtcagcagataaacaagtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacgtttcagagagcatggggttgggggtaaggttatagattaacagcatcccaaggcagaagaatttttcttagtacagaacaaaatggagtctcctatgtctacttctttctacacagacacagcaacaatctgatttctctatcttttccccacatttcccccttttctattcgacaaaaccgccatcgtcatcatggcccattctcaatgagctcttgggtacacctcccagacggtgtggcggccgggcagaggggctcacttcccaaaaggggcggccgggcagacgcaccccccacctcccggagggggcggtggccgggtggggactgccccccacctccctcccagacggggcggctgaccgggcgggggctgccccccacctcccggacggggcagctgccgggcggagacgcccctcacttcccagacgaggcggctgccgggcggaggggctcctcacttctcagacagggcggacgggcagagatgctcctcacctcccagatggggtcgcggctgggcagagacactcctcagttcccagacagggtcgtggccgggtagaggcgctccccacatcccagacgatgggcggctgggcggagacgctcctcacttcctagacgggatgacggccgggcagaggcgctcctcacatcccagacgatgggcggccaggcagagacgctcctcacttcccagacggggtggtggccgggcagaggctgcaatctcggcactttgggaggccaaggcaggcggctgggaggtggaggttgtagcgagccgagatcacgccactgcactccagcctgggcaacactgagcactgagtgaacgaggctccgtctgcaatcccggcacctcaggaggccgaggctggcagatcactcgtggttaggagctggagaccagcccggccaacacagcgaaaccccgtctccaccaaaatacgaaaaccagtcaggcatggcggcacgcgcctgcaatcccaggcactcagcaggctgaggcaggagaatcaggcagggaggttgcagtgagccgagatggcagcagtacagtccagcttcggctttcacaactttggtggcatcagagggagaccgtggagagagagggagagggagaccatggggagacggagacggagagggagagggagagggagcggccaaacattttaactgtttttctgtggctcctagtttgactgcaaccctggagtacgtggaagagaagacaaatgtggactctgtgtttgtgaacttccagaatgatcggaacgacagaggtggggatctgctgttcttccttgcttttcgcgctgaggcagctggataactccttttcctttataggagaccctcttcccctgtctttaaaaatgcaccctcaggcatttcagggattcttttcttcccacctaccacgaaggtgggaagttgtaacttgttccatcaagttacaactggactctgaggaagcccctgcaggtggtgttaggggccagactgaaggagcactggtgaaattacacagaatccattcaagggatgtggccagcaggacaaaatggatctcaaacatatggagcacctacaatgtgaaagggtcagacataaggccaagggaacggggacatatttaaccggatgcctggagcatatgttacagaaactatagcctcttgcctcaaggagctcaaactctgttggatataagggatggtgaataaccattcataagtgatagatactatttcagagcttactatgtcatcattgtattagtatataggtagacctcactaatctctagtgttaagcacttcatgaacatctcatttcatcttaaattctgtgaggaggaaggttctatgatttataaatggaaaattctatagatggaaactgaagttctgcaggactaactcacagaacaagtgttaaaaccagagttagagcctaggtctgttggactaaagcacatcctatatgcctgcactacactgcttcccagggccactccctagtggaagaaatcaaatctgggggcatacatgtattgagttttaaagcatgttctaatcatttgttctatcctttcacaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatc

SEQ ID NO: 38746 - DNA, 50936 bp, Homo sapiens
atggagtttcacaatggtggccatgtgtctggaattggtgggttcttggtctcactgacttcaagaatgaagccgcacaccctcgcagtgagtgttacagcccttaaagtggtgcgtctggagtccctcccttctgatgttcagatgcgttcggagtgttttccttctggtgggttcgtggtcttgctggctcaggagtgaagctgcagacttccgccgtgagtgtcgcagctcttaaggcagcgcgtcaggagtcgttcgttccttccggtggcctcgtagtctcgctgggctcaaaaatgaagctgcagacctttgcggtgagagttacagctcataaaagcaacgtggacataaaaagtgagcagtagcaagatttattgcaaagagtgaaacaacaaagcttcaacagtttgaaaggacacccaagctggttgccaatgcgggcttgggcagcctgcttttattctcttatctggccccacccacatcctgctgattggtagagccgagtggcctgttttgtcagggggctgattggtgcgtttacaatccctgagccagatacaaatgttctccacgtgcccatcagattagttagatacagagtttccacacacagattctccaaggccccaccagagcagctagataaagagtgtcaattggtgcactcacaaaccttgagctaaacacagggtgctgactggtgtatttacaaaccttgagctagatacagagtgccgattggtgtatttacaatccctgagctagacataaaggttctccaagtgcccaccagactcaggagcccagctggcttcacctagtggatcacgcaccggtgctgcaggtggagctgcctgccagtcccgcgccatgtgctcgcattccttagctcttgggtggtcgatgggactgggcgccgtggagcagggggcggcattcgtcggggaggctcgtccgcacaggaggccacagagggggtgggaaggctcaggcatggcgggctgcaggtcccgagccctgccccgtgggaaggcagctaaggcccggcgagaaatcgagcgcagcgccggtgggctggcactgctgggggaccctgtctcggccttccaaagtgctggtattacagacatgtgccaccgcatgcagtttggtgtcttcttttttttttttttttttttttttgagagacaagtctggctctgtagcccaggctggagtgcagtggcgtgatctcggctcactgcaacctccgcctcctgggttcaagcaattctgctgcctcagccacctgagtagctgggattacaggcatgcgcgaccatgcccagataatttttgtatttttagtagagacggggtttcaccatgttggtcaagctggtctcaaactcctcacctcgtgatccacctgacttggcctcccaaagtgctgggattgcagacctgagtcaccacactggcctttgtttttgtttttttttttttgaaatggagtctcgctctgtcgcccaggctggagtgcagtggcgtaatctcagctcattgcaacctctgcctcccgggttccagcatttctcctgcgtcagcctcccgagtaggtgggattgcaggtgtgcgccaccatacctggctaatttttgtatttttagtatagatggggattcaccatgttggccaggctggtctggaattcctgacctcaggagatctgctgcctcagcccctcaaagtgctgggattacaagggtgagcctccgcgcatggcctgttttttttcagttaaagtttacaaagcttttatgtatggtttgtatggttttcgggacaagtgaagggctgaaacttagttgtgcggttttgtgggataagtagaggctgaaatacagcctgcaatccactggccaggctctcctcctcatccagaggaaggggcacattttttctttacacaagagtaccgttcctagaaaacctgctttttcccaaaagggcacctttgcctaatttgcacaaaagcaatggaaaagctagcagtggtactgaaagcatgtataccagataatagacagcagaaattaatccctggaagctacttaaacataaaaaaattttcttagatgtcaacttaaaaatgtgtaggggaaatacatagtttttgaaaattattatggggaataaacaagcctcccccccaccaaaaaaaagactattgctccaaactctcttccaatgttgctctggtgccttttcctcaccttgcactacagatcttcacatctcccctctctctttggttcttccttttggctgcttctttctttaaacaactgataattaatttatgaaaacagttgatgccgggcgaggtggctcacgcctgtaatcccagcactttgagagaccgaggtgggtggatcacttgtggtctggagtttgagaccagcccgaccaacatggagaaaccccgtctctactaaaaataaaaaattagctgggcatggtggtgcatgcctctaatcctagctactcgggaggctgaggcaggagaatcgcttgaacccaggaggcagaggttgcagtgagctgagattgcgccattgcacttcagcctgggccacaagagtgaaactctgtctcaggaaaaaaaaaaaaagttgacaagtaagtgcagtggggagcagcctcaattcctgactcaatactgatggaaacaatctgtttaacaacctcagaaggactgtgtgaggcagtgagtcatctgtggattctcatctggaaatgatcccaaatcccagaaccctcaccataaggcgtttttcttgcagtgatttatggagtcttggcattccaactggtccttcatgctgggattcttttcctttgtgcctctgatccaatcagcgcacaccttctccaaggatttcccgctgtggctggttggggtaatcctcattcagtgaattatcacctctggttccaagagtgtatttccggagttttgtaaagcctagggcagcgtggctatcctgaccaactagttcctaaaggaatggccaggaggacatggctgtccctccaagagccccctactactttttagacctcattatactctcgccctgaggcaatttcctttccttttatcttctgcctgatattttccctaaatgttcccaaatttatcctcttctctgagggctttgcttcttcaggcctaactaaatacacaatccacaagccactgatctcacctcagctgtacctgtgctaattctcacttccagtttttctccagggccagtactgggagggatggcgcaaagatatacactgccacctggtggccaactgctaaccagctctggtaataccaaggatgttactagcaccacagcaacgggctctggaggcggatttgcaaaagcaccaggcgtgggtggagcagtgtcagctctttggttggtaatagcatctctctgcctggaattatctttccaagtctatttctctcaaaattcttttcatctttcaaggtccatataaatgccacgtttcccatgatccccttcttgatctttcaagttagaggatctcacttctctgaaagtactacagggtaggttcagcatttcgtttgtaactcttatgatgctgctctttgcctacttcaaactgttgctaatcccttaaaaactcagcttcttttcagtgcatgccatcaggatattgtaataatctactgaactcctgggtcacttcccccacattctctgaaaatttagaagcctgattcattctcttggttttcaccattcctactgtcatcagtcctggctattccatgatgtatggagacaactggccctcagtttcttgtccactcatttccaatcatcttgttttccagtccacctcagtcatttattcccatggttaataccctagccctggtcatgtataataaatgggctccttgcaaaacctgtatattttgcacctcacattgactatcacttcctttccaaaatttatttcctttttttttttattttttgagacagcggagtcttgctctgtcacccaggttggagtgcagtggcaccatcttggctcatcgcaaccactgcctcctgggttcaagtgattctcctgcctcagcctcctgagtagctgggattacaggcatgcgccactacgcctagctaactttttgtatttttagtacagacagggtttcaccgtgttcgtcaggctgatctccaactcctgacctcaggtgatccgccctcctcagcctttcaaagtgctgggattacaggcaccagccatcacgcccagcctgttcaactgatttttgacaagggtgccaagattattcaatgggggaaagaatagtcttttcaacaaatggtgaagggagaagaggataactgtatgccaaaaaatgcaactggacctttacctcatactgtatacaaaaattaactcagaatggatgaaagtgctacaaccataaaactcttagaagaaaacataaatgttaatgtttgtgatcttggattgggtaatgatttcttagctatgacaacaaaagcatgagcaaatgaaaaactgggtatattggatatattcaaaatttaaaatttggggctgggcagggtggttcacgcctgtaatcccagcactttgggaggctgaggcaggcagatcacctgaggttgggagtttgagatcagcctgaccaacatggagaaactccatctctactaaaaatacaaaattagcagggtgtggtggcacatgcctggaatcccagctactcgggaggctgaggcaggagaatcgcttgaacccgggaggcggaagttgtggtgagctgaggtcatgccattgcactccagccttggcaataggagcgaaactccatctcaaaaagaaaaagaaaagaaaattaaaatttttgtgtttcaaaggatacccaagaaagtgaaaagacaacccacagaatgggagacaattatagcaaatcatgtgtatgataaggggcttgtatctagaatatgtaaagtccttttacaactcagtaataaaatacaacccatttatatgaacaaggagagaatgataggttttgtcagatgttgagtggttgagtaagaaggctcgagaattgaccattggatttcataagatagtgtttgttgatgactgacaggaatggttcaaatagagaaatggggcaaatgccttactggtataggttcaatagggaattatttaaggaaatggagaaattttgtttttgttttttttcagataagagttttgctgtgtcacccaggctggagtgcagtggcacgatctcggctcattccagcctccacttcctgggctcaaacagtacttattgcctcagcctcccaagtggtgggattaaaggtgcaagccaccacaccaggctaattttaatttttttgttgtttttagtaaagacggggtttcaccatgttggccaggttggtctcaacctcctggcctcaagtgatcctcctgccttggcctcccaaagtgttcatgtcaccatgcctggcctggaattttgctttaaaaaggaccatatgggccaggcccagcagcacctgcctgtaatcccagctacttgggaagctgaggcaggagaattgcttgagcccaggagttcaagaccagcctgggcaacatagggagactctctgtcaaaaataaataaaagggagcgcagatatagggtactgttctatcctctcaagctgaaggtaagatcaagagaactatttaatttttagaaaggaatatatgtgtttgttttgttttgttttgagatggagtttcactcttgttgcccaggctggagtgcaatggcgcgatcttggctcgctgcaacctttacctcccagcttcaagtgattctcctacctcagcctcccaggtagctgggattacaggtgtgcaccactgcgctcgggtaattttgtatttttaatagagacggggtttcaccattttggtcaggccggtctcaaacttctgacctcaagtcatccacccaccttggcctcccaaaatgctaggattacaggcgtgagccaccgtgcctggcctatatgtgttttatgaatggtttttgtttatgttttttgtttgtttgtttgttttttgagacggattcttgctctgtcacccaggctggagtatagtagcaagatttcggctcactgcaacctccacctcctgggtttgagcgattctcctgcctcagcctcccgagtagctggaactacaggcacgtgccaccacacccagctaatttttgtatttttagtagagatggggtttcaccatgttggccaagatggtctcaatctcttgacctcgtgatccgcccgccttggcctcccaaagtgctgggattacaggcgtgagccaccgtgcctggcccaaccatcttcttaattctaagacaaatatactctggaaattagggtttgtttaccaattgatccttctaaaactttgcattccaacctgagcgacagggcgagactctgtctcaaaaaaaaaaaaaaaattagcattcattaatacccacttcaaaggcttgttaatacagatttcctgatcccactctgctgaaattgtgactcagcaggcctggggtggagccgagaatttgtatgtctaacagcctccctgaagatactgatgtcattcatccatggataatcacacttggataaagtagggtggtgctccgtttaatcatctccatcgatgccgtcaatagtgctcttcctcagcagctatgcactcttaaattgtgcatcttgcaccacagtaaaagtttaacatgggttagagatagcttttcttttgcaaagtagaagaaagtagcgaaaagtagaaaagaaaaatgagcaaaccacacacattagtttttgagacaggatcttgctatgttgttctggctggagtgcaataactggctattcacaggcgccatcccactgcggatcagcacgggacttatatgggccatgctctgtggagaagctagttcacttctccttaggtaactttgtggtcccccgctcgtgggagattatcatactgatgccaaacttagtgtcaacacctgatgtgcaaagcacacttcagcccagaactgctggcctcaagtgatcctctcgcctaagcctcccaactacctgggattataggcacgcaccactacgactgggcaggcacattcttaagaaaaccagttttaggaaacaaaacccatgaaagctgaagttttggaaaatgactttgttaaatacgtgtaatcaacttagtcagaattttacatgtctggttttgcattaaaaatataaaaatttttacaatatgatatggctaattataattataaaatgattttttaaaagtctacttcatgttgtgaggctggtgcattgagagggagcttttgtaagccaggcgcggtggctcacacctgtaatcccagcactttgggaggctgaggcgggcagatcacgaggtcaggagatcaagaccatcctggctaacatggtgaaaccccgtttctactaaaaatacaaaaattagccgggctggtggagtgagcctgtaatcccagctactcaggaggctgagacaggagaatcatttcaacctgggaggcggaggttgcagtgagctgaagccgtgcaactgcactccagcctgggcatcagagtgagaccctgtctcaacaaaaacaaagaaaaagaaaaaaaaaggagcatttgtggaagaagcagtggtacatgtgtaaacgtttcgggtaagggtggcatcacactggttgaggagaacaggcagctgcaggggtagtaatggcctgtttagatttcttcttaagctcccaactttgctgatacagccatttggggagcaagggggtggtcatcaaaaaacaaacagagagttgggcgcagtggctcatgcttgtaatcccagcacttttggaggctgaggcaggaagatggcttgagctcaggagtttgagaccagtctatgggcaacatagggagaccccatctccaagaaataaaaatgaaaacaaatagaggaagcatgcttttgttttacctgccctccctgaaaagaaattgaaattgacataactgtcttaagaggatgtaaagatggaatgcctaatgtccagagtgggaatcaaggggttactctgggaagtgatgaagactggacagatgatgctcattgatttcccaagctatatataaagtgcgatacctggctggatgcggtggctcatgcctgtaatcccagccctttgggaggccgaggtgggtggatcacgaggtcaggagttcaagaccagcctcgccaacatggtgaaaccctgtttctactaaaaatacaaaaattagctggtcgtggtggcagacacccgttatcccagctactcgggaggctgaggcagagaattgcttgaacacgggaggcggaggttgcattgagctgagatcgcgccactacactccagactgggtgacagagcgagactccatctcaaaaaataaaaaataaaataataaagtgagatgcctgtaatcccagaatttcgggaggtcgaggtgggcagatcagctgaggccaggagtttgagaccagcctgaccaacatggagaaaccccatctttactaaaaatacaaaattagccgggtgtggtggtacatgcctgtaatcccagctactcaggaggctgaggcaggagaattgtttgaacccgggaggcggaggttgccatgagccgagatcgcactccattgtgagccattgcactcgtgggccattgcactccagcctgggcaaccagagtgaaactccatctcaaaaagcaaacaaacaaacaaaaaacaaaagaaaagagaggaatcagtgagactcattaggagactacttcagtagatcaagggacagtttataatggctttgacaagtatggtgtagcagacatgtgcgagtggaaggaatctaagagtattttggagataaaggtaacagtttttgttggtggattagatatggaaggtgtgggaaagagaaaaatcctgaataactcctagcttttgcaatttggtgaacagtgataaaatatttactgagatgtaaaagactagagaaggaaaagatttgggagtttgaaagataaacaggacttctcctttggctatgcttaatttgagaggctttttgaccacccagatacaaataagacaggctatagatatatgactctaatcacttctcagtcttttggccaagatcaagtgatattgactctggaagtcagggggaaagccatcattgaaaaacttaactaacttacgagacaacccattatattttggatagctctagttatcagaaagttcttgcagttacactaaggtgactataaatgttatataaatttgatgctcatttccattcagggttcctgaaaagtacacacttttctaagcacattcaatattggaagaaagttatcacattctccatcttttattttctgagctaaacaatcaattctagtttctccagctgttcttcatgacctgtttctagacatgtcatcatcctggttggtcatatgccatataaggtaggatgccaaggactaacgtgaccagaataatcatatacaaaatgtaagactgtcatccctcggatttgccattctttcagaaatatgtttgccttttataattcatctgttttctttctttttcttttcttgagacagcatcttgctctgtcacccaggctgcagtgtagtggtgagatcttggctcactgcaacctctgtctcctgggttcaagagattctcctgcctcagcctcccaagtagctgggactacaggtgcgccaccacgcctggctaatttttttttttttttttttttttgaaatggagtctctctctgttgctctggctggagtgcaatggcatgatctgcaacctccacctcccgggttcaagcgattctcctgcctcagcctcctgagtagctgggattacaggcgcgcaccaccatgcctagctaatttttgtaattttagtagagacaaggtttcaccatgttggtcaggctgctctcaaactcctgacctcatgatccatccacctcagcctcccaaagttctgggattacaggcatgagccaccatgcccagccctgttttctttcttattgtcattagtgtgtcagtgttcctacctgtggcatacaatgtctcttcttattttcatctaatccgttgttggattcggaaatcaaataaccaattgaagctatcagatattaacattttgctttgtatgtttgggatattttgtaataatttaaaaggagagagagagtatgtgcttcctgagagagaccaaagcctttctatgagttgtgctttgaattttagtgagaaaacctttcttttttctctgtttcctcctgcctatatacaaaataaatgagtttcccaaacagttgagtgtcagatgggtgaggtatttcagccttttgcacaggatctcattggagattttctgagatgtcttgctgaaatcaaggtgcatggtgtctaaggcagtggttctcaaacagtggtgacttgctcccagtggacatttggcaatatctggagatatttttgttgtcatgattacaagaaagggattacatatttctagtggggagaggccagggattctgctaaccattctgtaatgcatgggacaagcctctgtaacaaagaattgtctggccccaaatgtcagtaatacctatatttgggactatggtatttctctgattttattaactttatgggaaaaagttagaaaagttttaaacttactgaaataattctacttccaactaatcactgctctcttcttttattacatagaaatcatctgtgaataatctttctagatggggaaaaaatgaagcactgcttttttccacttttgtaaaatggaaaagtttacatttttctgtcaccattctcaatctacataatttttttaatattaacagtgcccgatgattaaatttggacactatgttcatatactgttatttaaagaaaaattatactttcaccatatctcattttcctttctggccttctgtttctcttccccacgtttattcatttgttacagttgtaaggtttttcttgaggaggtaagtaatcctgtttttcttctgtcatctctaaaaactaagtaaatacaatacaacttaaactagaagctctgttcttatcttttaggacccctagtgagacatgtagctattttggaatgaggctatactaatcatgttgactagctacttattagtgagagagatgggggcagaagtcactgtcccgtcaccaggtagataagaatgtgggagacaaagaatgatgctgtctctgcacgtcctccacgtggggacattggaatcttttcctggggctgtggcatttcttttgtattgactgcagctgtcaggatcaaagaagagctaatgagacaaaagtaaatagcttcattctcaggctacctgagaggagcaatgtctaatggagattaaaagatgaaaggggagaaaaattctttctcagccatacccagatacaactaagtcactgttttcacatgcttctgattcttcaaattctatgttaaccacttagaatctagtggcaaaaataatcttttcctaatgcttttttacttattacattttcattattttaaagatagaggacagtaatgtttcctgatctcaatgcttttatatttagagctagagatttattcagtcagctagtcatttattaaattattattgactatgtctatatgttccagacccaaacatgaaccagggaaaggctccaaaaacttggcagtttcaagtatatatttgaaagaggattgataagtgaacacctgatttgtagttgaaatatttatataatttttcacctttcttccggggtgatgactacttcagatgcattggtcaggaagtatttgttagggctgtgtatttgtagaacccttgagactgcacagaataaaatagctagtatccttcttcagccataagaccaccttctagaattagagaactgagacacaggtttaatgacttaagttttcagcacagtctgtagcgtagtctgtaccacagtctgtgctgatacttacgttttctaacttccaaccttgtctttgttctaaaaacacaggtgagggaagattgcttgcagaaaatgctttctgctgttgtaccaagggtgtttctctccagaaagcctctgaagcaaccaaattggggttcagggttgaggtcgaggaaaacaatggaaaagcaagagtgaaaaaagcacagaccaagaaaaaacattttaactgaggcaaagcatctaggataaaagagacacatttgatgtatgtggaacacaagtagtatgtaggtgctgtgacagagaaaaaaagccctaagattttccttcatagctggtctaaatgcagtggtccttacaaccaactgatcacaaccagtaacaattttctttgttccttctccactctcacagcttcacttgactagccttaaaaataaataaataataaataaatggcctggcctggcggctcacgcctgtaatcccagcactttgggaggccgaggtgggtggatcacgaggtcaaaagatcgagaccatcctggccaacatggcgaaaccccgtctctactaaaaatacaaacattagccgggtgtggtggtgcacgcctgtaatcccagctacttgggaggctgaggcaggagaatggcttgaacccaggagacggatgttgcagtgagccgagatcacaccactgcactccaagcctggtgacagagcgagactccgtctcaaaaaaataataataataaataaattagttcattcctcacctgagggcttacacttgaagtagaactactggtattcaaagactgctgcagcatccccgaacttgcttttccagcattatctcttcctagactcctgtaagtgccttattcctcagctaaactggactaagcaccattccccagccttcccacaaactgcccaccaccagacatgtgcccaggccattccaccttactgaaatgctcttgtctaatctttatctcttatctcttagtctacccatcttccaagatcccttccaaataccaacttcaagaagcctttctgggtgtttccacgtgaataaaatctcgtgattcttggctcttttttttttttttagcactttcttgtcttgtcccctccagcaccacattgtaacttttgaggtcagggactttgggttccctgcatcgtacagcagagtgttgtgcattttgtagactttttccttttttttttttttttgagatggagtctcgctctgtcacccaggctggagttcagtgccctgatctcggctcactgcaacctctacctcccaggttcaagcgattctcctgcctcaaggcctcccgagtagctgggactacaggtgcccgccgccacacccggctaatttttttttgcatttttagtagagacggggttttaccaggttggccaggctggtctccatttccctacctcgtgatccgcctgcctcagcctcccaaattgctgggattacaggcatgagccactgcacccagcccagactttttcaatatatatccacatacattttaatttttttcatcacctttaaaaaaaagctcattcaattctttctgggtttagaaagctgttctttcttgatttacttatgtgtgtaacagtcttgctgtcttgcccaggctagagtgtagtggcatgatcatggctcactgcaacctcaacctccagagcttgaatgatcctcccacttcagcctcccaagtagctaggaccacaggtgggcgccaccacacctggctaattatttgtattgtttgtagagatgaagttttgccatgttgcccagggtggtcttgaactcctggactcaagcaatcctcccacctcgatcttccaaagtgctgggattacaggcatgagccaccacgcccaatgtatggatgtttttatcaagatgttatcttgcccgaagattgagaggtccaaataagaactcagtgaaagcgggcgcagtgtctcagaccagtaatcccagcactttgggagacggaggtgggctgactaccctgaggtcaggagtgccagaccagcctggccaacatggcaaaaccctgtctctactaaaaatacaaaaattagccgggcgaggtggcaggttcctgtaatgccagctacttggaggctgaggcaggagaatcacttgaacccgggaagcggagtccagtgagcccagatcgcaccactgcactccagcctggaaaacagagcaagactctgtctcaaaaaaagaaaaaaaaagaggccgggcgcggtggctcatgcttgtaatcccagcactttgggaggtcgaagcgggtggatcacctgaggtcaggagttcgagaccatcctggccaacatggtgaaaccccatctctactaaaaatacaaaaattagccgggcatggtggcgggcacctgtaatcccagctactcgggaggctgaggcaggagaattgcttgaacgcaggaggtggaggttgcggtgagctgagactgcgccattgcactccagcctgggcgacaagagcaaaaactctgtctcaaaaaaaaaaaaaaatggaattggaaaaagcagaatttgtggctaggatgggcggggacaaggatgactaggtaatagagactggaaaagagaatggaatagacgtaaggagcattaagttagtggctacctggggtaaatggaaaaagaaaaacaaagaacaagaaagggaattgtaaaaaataataataaaaaaaagacaatctgagatacaaatattgaagagatggcaggagaacagtcaagacataagagctgtgtctaagggacatattcctggcttttggttgtcctagggaggttcctttctgtgcacgtcagaagatgacaggcaagaaaacaaagtggaaaacaataaggaagtgaaggtaacccctttataacctcccactgcttcattccttggaaatagaaatgactcagggaggcagatgaggataaataaaacgctgccttgaaacagtctctatgcttagctagattctgtctgcagctgctttctgcagaatcctgcaaattgggtttgtcatctgaccgtgtctctctcctcctgtgtctctacatctatttcaggtccctgggtttgctcgtgtctgttgccttggttcctctgctgtgttcctctaactgtgggcaatgcctccatccatttctagaagtaaatgtgttgatggcattttatcacctgtgtagttcctcttttgactctctcaattctcacctatgtctgcgcctgttgtttttaccttcgtcttttatttttctttctgcacccttttgtttctgcttctgtcactgcttctctctaccagctggctttctatgatgatgacatccccatagcaacctctctctggggaagaatgaggggaaggaaaagagagagctagaatagatgggctaagagaagccagattggagctggaaggtgaccttttggattgagtcctagaacagagtacagagaaactatgaagactgataccagccaagttacacaaaaccctaagaaaacacaaattgggagcccaaatccagtccctgctggcaaaactcattcagcaaatcctttctgttgtaaattaacctgtcatctgttttcccttccttgtgattcagatgaactattcttcctttctttgtttctaggtctcatgattcttaaacatgtatagttctttttttcttcttaaagctagtcaagtgaagcagtgtgagtggaaaaggaacaaagaaattcataattggtacagtggtacaaacaccactgtactcagatcagccacatgtatattttctttccttttcttttcttttttgagacagagtttctctcttggtgcccaggctggagtgcaatggcacaatcttgggtcactgcaacctctgcctcccaggttcaagtgattctcctgcctcagcctcctgagtagctgggattacaggcatgcaccaccacacttggttaattttgtatttttagtagagacagggtttctctatgttggtcaggctggccttgaactcccaacctcaggtgatccacccacctcggcctcccaaagtgctgggattacaggtgtggccactgcgcccggccgccacaggtatattttcttttaaaatttatgaatattcaggaccagacgtggtggctcacacctgtaatcccagcacttcgggaggccagggcaggtggatcatgaggtcaggagttcgagaccagcctggccaacacagtgaaaccctgtctctactaaaaatacaaaaaaattaggcgggtgtagtggcgggcgcttgtaatcccagctactccagaggctgaggcaggagaatcgcttgaacccaggaggcagaggttggagtgagccaagatcacgccattacactccagcctgggtgacagagcgagactccatctcaaaaaaaaaaaaaattatgaatattcacattgtaaccacaaggtctttcttttgatatactatagttttttcactaagattagttctggacaccatactttaagtgatacatgaaatacacttggaatgcccttagaaaaagaccaataaagaaaaaaaccaacatgaaatgatattatccactcttatttaggaccagaatgttagataagagatttaataaggataaagttttttttttttttaaccaataatgagatttgtttcatgtagggaagggttgttgagtgagttaaagcaatggaataattctgctcagagatctttaaattatataaatatccaaatatctgtaaataaaattggttagatcagttttccctcaaactttagcttcctttttccaccgtttcctttgacctccacctggagagctggttagacacaaattcctgagctctactctcagtaattctgattctgtaggtctggggggataggaggggcttgagtttgcatttctagttctttttctttctttctttcttttttttgtttagacaaggtctccctttgtcaccctggctggagtgcagtggcaccatctcagctctctgcagcctcgacctcccaggctcaagctattcttctgccttagcttcctgggtagctgggtttacaggcatgcaccaccacgcccagctaattttttgtatttttgatagagatggggttttgccaggttgcccccactggtctcaaactcctcagatcaggaaatccacccgccttggcatcccaaagtgctgcgattacaggcgtgagccaccacgcctggccttgagtttgcatttcttttttttttttttttgagatggagtctcgctgtgtcgcccaggctggagtgcagtggcgcgatctcagctcactgcaagctctgcctcccgggttcatgccattctcctgcctcagcctcccaagtagctgggactacaggcgcctgccaccacgcccggctaattttttgtatttgtagtagagatggggtttcaccatgttaggcaggatggtctcaatctactgacctcatgatccacccgcctcggcctcccaaagtactgggattacaggcgtaagccaccacgcctggccttgagtttgcatttctaacaggatcctgggagattctgatgttgctggtccccggaccacaatttgagtagcactagtctagatgatttccgaagtcaagcaatacagttgacatacatagtacataaatgtgtggttattttattgttccttgattaaaaataactttcctttgggaatggaggagcatgaatagactaaatcaagttggttttgtttttctctgccatttgcaagctgtgatatccattgacccctttctttgttttgtaaaatgaccaaccatagaggtttgcccaggtactttcagtgctaaaactgagatagtcctgggcaaacgggatgattgggtgacctctccattcacgaggctagtgaaatagaaagaatgtataaggaaaaatgaacgtggctagggatcagaaaatgcagtttctagtcgtaattcacaacttattaatattctgaccttaaattgatcatttaaattctctttcagtttttgcacctataaaatggtgataatgttaactactttacttacttaccacaaaagttttgaggatcaattgaaataatggataaaaagattattaaaataccatatacatattaagacaaagatgtagctcacttgtttttgcttagaatttacgatttacagcccggtgcggtggctcacacctgtaatcccagcactttgggaggccaaggcgggtggatcagctgaagtcaggggttcgagaccagcctggccaatatggtgaaacccctctttactaaaaatgtaaaaattagctggatgtggtggcatttgcctgtaatcccagctactcgggaggctgaggcacgaaaactgcttgaacctgggaggtggaggctgcaatgagccgagattgtgccactgaactccagcctgggtgacagagtgagaccctgtctaaaaaaaaaaaaggagtttactatttactggcaaaaaatagcaacccagcaatctcattcctaagcatacaacaagtatacaatcgagagaaaagaattcatacattcagcaaatatcaggaatgtttataatagctcgaactggaaacaatgatgcatacatcagtgggagaatagataagtaaatgttgtcatagccaaaagtggaatactactcagcagtaagaaggaatgaactaccaacaccaccacatagtactcgtagacacgatgctcagtgaaaaaacatctgagcacaaaagagtacatactgtatggttccatttaaaggtcaagaacaacaaaattcattgatgatggcggaagtaaaaatagcaatttcttctggagaaggaggctatagactggaaccagcactaggaaactttttgaggagcaagaaatgttaaagaatctagatcttgatctggttaatggttatgcctgtgaatacagatataaatattcacccaactgtaaactccagattagtgcatttttatctgctttattgcatgtgcccttcagtaaagtagaaaaaaataaaagaaaagacaacaataaaggaaggaagaactcaccctcaattctatcaccactagaaaacaatgtgtttttttcttgaaatgtttgcattctaaccgccccagcactaagaagaggttcagttttgtaattggaacgtctgatgagcatctgatgagtggatccagaggttatcccctcatgtcgagttgatgatgatatttcagcttctagacttgagcaagatgacagcaaagggaagcggaaaccctgggtcactggttcaggaagacggccaggtttacatcaacgttgcaacaaatctggtggctttttttttcgtttcgtgttgctgtttcttttcttcctcttcatctttgggtccgtttgctacttttcttggattgattttccactctaccccactacacaacgtactctttggggaggaggggggtctttacattttcttccactctccgactttcccatattttctcatgtgtctcagtgaattcaatggtatgtgctaacattttcttttatgagtctattccaggggctcacatcctgtcccctgcccgaggagccttccagtagcctttacagccgcattctcaggctttcatccactctttttgaaacagcgcctgtgacattcccactcattacagcgtgcccctcccatgcctccaggaaattctctgttttcccaccggctttctactcagcagctattctcagtctaatgcgcttcattcaccgtcagccttcctcaggaagacataaaaaagggtgaaaaagaacatttatttctcaggaaggattggtcagctgactaagttgtctgagggtctaaaaagatgagggggtaactcaaagcataaatgcttgaggagatggataccccattctccatgaggtgattattttacattgcatgcctatattaaaacatttatgtggccaggcgcggtggctcacacctgtaatcccagcactttgggaggctgaggcgggcggatcacctgaggtcgggagttcgagaccagcctgatcaacatgtagaaaccctatctctactaaaaatataaaattagctgggtgtggtggcacatggctgtaatcacagctactcgggaggctgaggcaggagaatcacttgaacgcgggaggcggaggttgcgatgagccgagatcgcaccattgcaccccagcctgggcaacaagagcgaaactccatcacaaaaaaaacaaaaaaaaaaaaaagagaaaaagaaagagtagatgtgagtcagctaagcacttcagtcatcatgtagctgttttcctgtgagtggggggaggggggtggtagcctggtgattgtgtcccactgatagctacacagagaaagaaggacatttatagctttagagcactgctagagaaaagttaaggaactcaaagaactgtcttcacttcatgcaagcaattatctgtgttgcttatatattggcacttgtatagaagaagtcttttcccgcttctcggccttttggctaagatcaagtgaagatgacttttaaaacccttgtctgtgatcctgcaatcaccctccttggtacttacataaatgagttgaaatcatgcatctacatgaaaacctgcaaacgaatgtttagagcagttttattcgtagttgctaaaacttaccaagatgtccttcagtaggtgaagggataaactgtggtgcatccaaataatggaatattatccagtgataaaaagaaatgagccacgaaaagacatgcagggaccttcaatgaatatcactaagtgaaataagccaatctgaaaaggctacataatgtatgactccaactgtatgacattctggaaaaggcaaaactatgcaaaaagacagcaaaaagatcagtgattgccaggggttggaggagtagggaagggaggtggaacatgggatcttttttttttttttcttttgagacagagtttcgctcttgttgcccaggctggagtgcaatggtgcaatctcggctcactgtaacctctgcctcctgggttcagtcaattctcctgcctcagcctcctgagtaattgggattacaagcatgcaccactacgcccggctaattttatatttttagtagagatggggtttcaccatgttggttgggctggtgtcgaactcctgacctcgtgatctgcccaccttggcctcccaaagttctgggattacaggcgttagccactgcacccagcctggaacatgggatttttagggcagtaaagctgttccgtatgatatcatacatttatcaaacctatagaatatacaacacaaagaatgaacttgaatataaactatggactttatgtaataataatatatcaatattagcccatcaattattaacatgacagatgtggctcggcgagctggctcacgcctgtaatcctagcactttggaaggccaagtcaggcagatcttctgaggtcaggagttcaacaccagcctggccaacatggcaaaaccccgtctctactaaaaatacaaaaattagccgggcatggtgatgggtgcctgtaatcccagctgcttgggaggctgaggcaggagaatcgcttaaacgtgggaggtggaggttgcagtgagccgagatcatggcactgaactccagcctgggtgacagagtgcaagaaaaaaataataacaataaataataatgataataatataagagatgtatcacactaatgcaaatgttagtattaggggtgttaagggagtacatgggaactctgtgtactttctgctcaatttttctgtaaacctaaaactgcccacccccaataaatcctattaattaaaaaacaaagcgaaacacttgtttatatgtctctctccatccgcttcaccaccatgagaacttaaagggaggaacatgttttttatctttatgttcccggcctctgggatgaaagagaaagggaacactatttttagtgcattaccctagcatcatcgccgacttagcgcatctaaaataaaagtcttgatttgaccctcaggtctctgtctgctttcctgactgaggtaaatggcaactccagttctccagttgctccagccaaaacctttaggatcattcttgactcctttttttcttttgtgctcaacgtctagaccgccagtaggttgcaccttgaaaatatatttcaaatccaacagcaacccactctatgctcctatccctaccctctgtctaagtttgttcatgctgctataacaaaacaacacaggcaaggcgcagtgcctcacgcccgtaatcccagcaccttgggaggcccaggtgggcggatcacctgaggttaggagtttgagaccagcctgaccaacatggtgaaaccctgtctctactaaaaatacaaaaattagctgggtgtgggtgtggtggcgggtgcctgtagtcccagctactctggaggctgaggcaggagaatcgcttgaacccaggaggcggaggttgcagtgagccgaaatcacgccattgcactccagactaggcgacaagagcgaaattctgtctcaaaaaaacaaaaacaaaaacaaaaacaaaactgagtaatctataaacagtagaaatgtatttctcacagttctgaatgctgggaagttcaaggtacccgcaggtttgatgtttggtgagggcagctctctgcttctaagatggcgactgttgctccgtcctcattagggggacgagtgatgtgtcctcacatggtggaaggcagaagggcaaaaaaaaaaaaaaaaaaaaaaaaaaggagcaaactctctgaagtccccccaccgcactttttttttttttttttgagacagggtctggctctgtctcccaggctggagttcagtggtgcaatcatagctcactgcaggcttgacctcccgggctcaagtgatcctcccacctcagccacccgagtagctgggactacaagtgcaaaccaccatgcctcactaattttttgtatttttttttttttttttttttttttttttgtagagacagggtctccttgtgtcgcccaggctggtccaaaagggggaaataagaactcctggactcaagcgatcctcccgccttgacctccaaaagtgctgagattacaggcatgagccatcgagcctggcctccgaagccccttctgtatgggtattactccctccatggaggcagagccctcatgactcagtcacttcccaaaaggtcctgcctcttaatatcactacaattaggattaagtttctgcattaattttggagggaacacacatttaaaccacagcaccctccttcagcatcttctccattcaacagcacatacttttttaaaaacacgaatcaactgatgtcatgcttctgctcaaaaaactaaaatggcttcgtagcttcctggctgtctgtcacattcggaatataaaccagaacgttcatgactgcttacagcgtcctgcatgagcagactcctagctgtcttcaacatcatttctcctgccactctgcccccgcttcactccactcctgccaaatccgccttttgacaccctgccaagcacgagtcctccttttggtgtctgcgtttgaaatgccttctgtttgaaatgctgttttcagatactcccaaggttgactttctcgtgtgattcaggtttctgtgcaagtatcatctctactgagagaggaaccctaaccactctatcttaatcttccccagccccaaccctttatcgccttaccttgatattttcttcttcaaaatgctcccttattacttgacagtatatatttattgtctgctaaggctgccataacaaaataccacaaacaggtggcttaaacaacaggaatttgttttctcaaagttctagatgctggacatccaagatcaaggtgccagcaggcttagtttctcctgagacctctcccttcagtagcagatggctgtcttctcagtgtcttcacatggccttttctctattcacaggcctaatgcctcttcctcttctcataaggacacctgtcctattggactagagccccaccctagtgacttcatgtaatcttaattacctccttaaaggctccatctccaaatacagttccattctaagttactaggggttagggcttcaacatatgaattttaggacacaatttagtccataacactttgccctctggccccccaaaatgtatgtcctcacatccaaaatacatttatctctatccctgtaggccctaaagtcttaacccattccagcatgagttccaaatccaaaatttcatctgaatatcatctaaatttggtatgggtgagaaaagaggtatgattaatcctgaggcaaatttttttccaaactgagcctgggaaaccagacaagttatgtgctttcataatataattgtgggacaggcataggctagacattcccattgcaaaagggggaaatgggggaaataagaaagaagaaaggggtacctggtcttccaagttcaaaattctagtaaggcaaattccattttttaaaaaaaattgtggaccgggcacgttggctcacacctgtaatcccagcactttgggaggccgaggcaggtggatcgcaaggtcaggagttcaagaccagcctggccaatatggtgaaaccctgtctctactaaaaatgcagaaattaaccaggcatggtggcaggcgcctgtagtcccagctactctggaggctgaggcaggagaatcacttgaacgtgggaggtggaggttgcagtaagccaagatctcggcactgcactcctgcatgggtgacagagcgagattctgtctcgaaaaaaaaaaattgtggtaaaaacacataacaacaacaaaaaaggtaggctgggcatggtggctcacacctataatcccagcactttgggaggccgaggtgggtggatcatctgaggtcaggaattcaagaccagactgaccaatatggtaaaaccccacctctactaaaaacacaacaattaaccaggcgtggtggcgtgcacctgtagtcccagctatttgggaggctgagacaggagaattgcttgaacgcaggaggtggaggttgcagtgagccaagactgtgctactgcactctagcctggacaacagagtgagactccatctcgaaaaaaataaaaataaaaaattagccagtcgtggtggtgtatgccagtaatcccagccagagtgagacttcatctcaaaaaaaaaaaaagaagaaaaatggttaccatgtgaaccatcttttttttttttttttttgagacgaagtttcactcttgttgcccaagttggagtgcaatggtgcaagctcggctgactgcaacctccgcccccaggttcaagagattctcttgcctcagcctccaaagtagctgggattacaggcttgcgccactatggctggctagttttgtatttttagtagagatgttgtttctccatgttggtcaggctggtcttgaactcccaacttcaggtgatcctcctgccttggcctcccaaagattacaagtgtgagccactgcgcctggcccatgttaaccatcttttattactttatcttacatttattttattacagtttttaaaatatcttttcagcttcactgaagtataattgacaaataaaattgtatacatttaaagtatgtgcacatgatgttttgatatacatgtatattgtgaaattattaccacaagttagttaacacgttaacttttttttttttttgagatggagtctcactctgtcacccagggtggagtgcagtggcgtgattttggctcactgtaacctctgcctcccaggttcaagcgattctcttgcctcagcctcccgaatagctgggattacaggcatgtgccaccatgctcggataatttttgtatttttattagagatggggtttcactatattggcccggctggtcttgaactcctgatcttgtgatccacctgcctcagcctcctaaaatgctgggattataggcatgagccacggtgcctggccaatatgtttctttttatttttttaatgtggctactgaaattttcttttttttgtaaaattgaacacttggtcacccaggctggtgtgcagtggcatgatctaggctcactgtaatgtccgcctcccgggttcaagtgattctggtgcctcaggctcccaaatagctgggattacaggcgtgtgccaccacgcctggctaatttttttgtgtctttagtagagatggggattggtgatattggccaggctggtattgaattcctgaactgaagtgatccatccgccctcctcagcctcccaaagtgctgggcttacaggtgtgagccaccatacccagcagaaaaatttttaattacatctgtggttgggctgggctcagtggctcacgcctgtaatcccagcagtttgggaggccgagacaggcagatcacaaggtcaggagttcgagaccagcctggctaacatgatgaaaccctgtctctactaaaaatacaaaaaattagctgggcgtggtggcacacgcttgtagtcccagctactcaggaggctgaggcaggagaactgcttgaaccggggaggcagaggttgcagtgagctgagatcatgccactgcacaccagcctgggtgaccaagtgagactgcgtctcaaaaaaaaaaaaaaagttatatctgtggctcacattatatttgtattggacagtactggccaggctttattcaataatcattgaagatatttgagtaggactctgacacgattcaaattttgatttaggataattcacctagccctgatgtggaacggattcatttttgaagaagggagaggaaagaggaaggaagaccttcgtgaaagtgggacaggcctgagagctgggattaggcccttcaggatcaacgggagtgatggatggatgatttaaacccagtttagacaggaaaatcaacatttctcaaatgttttctttcttaatcctgaggacttattttctacagtgttatcaaattcaaagtgaactctgcctacactaacctaacaaaggaagattaaaaagttgctttaacaaaagtcgttctttatgaggactattacagatgcaagcaaagttttagagcagttactagctttttgtgtgtgtcttgaaatgccatttacattgttttatgaaagagacagttttccctgtctttacctcaatgcgtttaaaggcttgtgttccctgactttagattttatgtttgttttccacctggttatcatactagcaagcacccatcccacaaagctgcatgaaactaggattgagatttacattctgcagatttagattctaggattgagatttacattctgcagatttagattctagaattgaaatttacattctgcagataactgcatctggaactaagcgacctcagacaattattctattcattcctttttttctaggcagacctacattaaagtattaggtgtaaattttgtttgtttgtttgtttgagacagtctcgctggcacccaggctggagtgcagtgacgcaatctcggctgactgcaacctctgcctcccagtttcaagcaattctcctgtctcagtctcctgagtagctgggactacaggcgcacgccatcacggctggctaatttttgtatttttagtagagacgggctttcaccatactggtcaggctgtaggtgtaaattttataacattctcactaacttactctgttttgaaatttacccatcgcacctcacatttcctctttttttttttttttaatagagctacagaaagatttcaaaaggaatcaaatgacacagcataggtgtctgagggcagctagcctcactggcccatcctgacatacttaatccctcatgcctcatcaccagagctgtgactgtgactgagccaggctcctcccaaagtacactgaagacccagctcaaccaaccagtctctcgaagcacatcaacaaacagttatattgagcaactcttctctagtggccagggtgaaggactatctaagcttggacatctctgttgctttgggggccagcccagtgcagaactggtttttgagcatcaggttcctcctaggtgccatttgcccaaggaacacttgtctcaatatgctcaacacactttttttttcttttttgaggcagggtctcactctgttgcccaggctgcatagctcactgcagcttctatctcctgggctcaagtgatcctcccaccccagcctcccaagtagctgggtctataggcacctgccattaccatacccagctaattttttttttttttttgatagagaaggggtctcaaaaaaaaaaaaaaaagagagagagaaggggtctcactgtgttgtccaggctggtctctcaaactgctaggctcaagtgatccttctgcctcgacctcccaaagggctgggattatagatgtgagccactgtgcccaggtcaacacattttttagattctcaagactcagtttaattccaattgtaacctttaaaaataatcccagcatttgggagctaaggcatgaggatcacttgaggctgggagtttgagaccagccttgggcaatacagtgagatcccatctctacaaaaaagaaagaaaatgaaggaaaataagagaagggatggaaagttatgagactaatgaaaaaaaaaaggctctcaaagatagtgaatgatgagaggagaaagaaaggacttttactaaaaagaaaaagatttaacagagagcattgtactggcagggccctccagggtatcgatgcttagttgtgactgagacatctgagaggccgcaggcaaggtcagttctactgaagctttcagcctgtggtctaccctgtctgacctgaaaggaaaggaatttaagataggaaaggttgaagggattggtgggggtgcgggaaaggacatagaagatggcttcaggtatagaaattgagctgccccaaggtggaaatctaaaataatatccacttgcccagctgaattattccaggcaaggtgaagacgactggttctccccactaagaaatgtctctctctctctttttttttttttttgagacagagtcttgctctgttgcccaggttggagtgcagtggcacggtctcggctcactgcaacctccgcctctcagggtcaagcgatcctcctgcttcagcccctcctagtagctgggattacaggcacaccccaccatgccctgctaatttttgtatttttagtagagatggggtttcaccatgttggccaggctggtctcgaactcctgatctcaggtgatccacctgccttggcccacctgccttggcctcccaaagtgctgggatgacaggcatgagccaccgtgcccggccagaaatgtcttatttgttaggtttgtagtgagccgagtgttctttcttcccccacccgggggttaggttagggatagcagaacagtatttaataaaccagaagactgaaatggggccaggatgcagtgagtagatccagtaggttacatggtcctgagagataagagactcaaagagccacccagcagtgaagacacaaactactaccacctccccctaccaccaccactgggcttccgtggagtctggggtacagatcagactgcactgtatttgtttccaaaatgatcaattcttagtaatcctacccaaggctgtgttgtcctctttcctcccagttcgtgagtggaattctatgcctaccttcacctgatgcaggtttttaaatatttccaaactgaccaacccagtttctcttaacttcttccttctccaattttcttttccacttttaccaagttaacttcacattcttatctccagataagttctttagtataatctattactttgtcttcccgattaattacctaaatctcgtttgatgtttgtccttttcataccactcataggtcagattctcctaatacagctccataattaataagaaacagtcatcaattacaagttttaaggactattctctcctccctgtcctctgtctctccaggtcaccccagctctgatctttgccatcacagttgctacaatcggctctttccagtttggctacaacactggggtcatcaatgctcctgagacggtgagtgccaggccacaagaattagaatctggaatagggaaattattcctttaagtagggtttcaagaattcagaatttaaggccaggcatggtggcacctgcctggagtcccagctactccggaggctgaggcttaaagatcacttgagcccaggagttaaacaccatcctgagcaacacagttagtgagggtccctcccccaactaggggaattaaactttgtatctatcctgtccaagactgaagatggagacaatattggtggggaaaattagtggggtcatttaatcaaaggaaaaaggtcatttactccttataccctgggcagtgctgttcttcctcccactctttcaccctatagtaatacacttcctgtattatcccttaggggttagttaccaagctggccaggttcgcttagcagagggctggggtgaacatcagtgctgccacctactgggatattcaggacaaatgaaaaattactattccagggagagttaacattaattccaatatgttatctgcctcttcaattcccgtctatttattcccttgattctctagggaggaaatgatccctaatatttgttttgtttgtttgtttgttttgagatgtagtctcgctctgtcacccaggccggagtgcaatggcgctatctcggctcatcgcaaactccgccccacgggttcaagcgattctcctacctcagcctcccgagtagctgggattacaggcatgcgccaccacaactggctaattttgtatttttagtagagacggggtttcaccatgttggtcaggttggtctgcaactcctgacctcaggtgatccacccgcctcggccttccaaagtgctgggattacaggcgtgagccactgcacccagcatatttgtatcttttgttctcatccaactgtaatagtctgtcctcccaccttttattttgcagatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggtattgactagaaactgggcaaggaagtgggctctaccagatgcattggggacaagtgtggagagttagggcagggaggtgatgatgcctttgaataagaacaccttgaattctaatcaagggaaactagcccaactggccccgaatatgactgcccttgcttggagctctactaccctggagagctcccacccagctgtgcaagagatgaactgtgtgagtgattggcctttgcagtccagttagggatagttcagaattattccctagtaagctcaactatggggtttccaggaacatacttaatttacaaggtccaaagttgattacttttctcaaaaaaaaaaaaaacaaaactggggtctcatataaatgtttttgttacctctacacaggattggtaggaattatctttagtctatggcaaatgtggataatggccaaaaaaagaaaactgaatcgtctttttttttttttttgagatggagtcttgctcttgtcacctaggctggagtgcaatggtgcaatctcagctcactgcaacctctgcctcccgggttcaagtaattatcctgcctcagcctcccaagtagctgggattacaggtgcccgccaccacgctcggctaatttttgtatttttagtagagatggggtttcaccatattggccatgctagtctcgaactcctgaccttacgtgatccgcccacctcagcctcctaaagtgctaagcttacaggcatgagccactgtgcctggctgaaaactgaatcttcttattttatactagcttagtaatctattttagaaggtagaatatattttcagttatgactgacaaaggaactgttttaatttgccaattagatattctagaaatgcaagaatgtaattcacatttaaaaattgataaggcaacctattttacttgctaatgttcttccccctctgccctccctctgcccaagaagcagggtcttgctctgtcacccaggctggagtgcagtggcccaatcatagctcactatagcctcgacctcccagtctcaagcaatcctcacacctcagctccctgagtagctgggactaccagtgggcaccatcatgcctggctcccaactagaaacgttctgataatagaaagtaaaaaagggctgggcgtggtggctcacacctgcaatcccaacactttgggaggccgaggtgggtggatcatgaggtcaggagttaaagaccagcctggtcaagatggtgaaaccccatctctactaaaatacaaaaaaattagccaggcatggtggcaggcgcctgttatcccagctactcgggagtatgaggcagagaattgcttgaacctgggagtcagaggttgcagtgagcggagatcgcgccactgcactccagcctgggcaacagagcgagactctgtctcaaaaaaaaaaaaagaaagaaaagaaaagaaagtgaaaaagaaaagttagaccaaaaaaggagttgatataagcctggagaagagcagaataatgagtacagaagaggagaagttaggagcctctcactttgctaattccatgttgtctttgattaaccttacaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccaggtactctagaacttctcatacttaatgagtgttagtttcatgggtcattaaaaaagttaacataggtaaagcactgaagaatatctggcacatgttcaattacatatggaagttttagataatagatagtagctgaagaagcaggttgagtagagaaaggaaaagaagcacaatttcttttttccttttttctttttctttttttttttttgagagggagtttcactctgtcacccaggctggagtgcagtggaatgatctcggcccaacctctgcctcctgggttaaagtgattctcatgcctcagcctcccgagtagctgggattacaggtgtgcaccaccacgtccagctaatttttgtatttttagtagagacaggatttcaccatgttggccaggcttttctcaaactcctgacctcaggtgatccacccgcctcggcctcccaaaattctgggttataggtgtgagccactgtgcccggcaatttttaaatttttttcaatggtaaaataatgtatgattttctgaacttttgttttgttttgtttctgagacggagtctcactctgtcgcccagtctggagggcagtggcgcgatctcggctcactgcaacctccgcctcctgggttcaagtaattctctgcctcagcctcctgagtagctgggattgcaggtgcccaccatcacgcctggctaatttttgtatttttagtagagacggggtttcaccatcttggccaggctggtcttcaactcctgatccacctgcctcagccttccaaagtgctggaattacaggcgtaagctactgcgcccagccaactttttgtgtttcaatgaacttgtggcctgtgaagtatggggtttatagcattatctttgtgtggtttctagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggagtgagtatctttcactctttagtatacaaagtatatggttgtggtttgttttaagggtgagggtactggatctattttctgtcgtaccctttccctgcccgtcagaatccaagtgaagatggttctgattactctactttgttttttctttttttgagacagaatctcatgctgttgcccatgctggagtgcagtggtgcgatctcggttcactgcaacctccgcctcctgggttctaagcgattctcctgcatcagcctccggagtaggtgggattataggcatgtgccaccaccaccacaccacgcctggctacttttgtactttttttttttttttgagacagagtcttgctctgttgcccaggctgtagtgcagtggcgcaatctcggttcactgcaacctctgcctcccaggttcaagtgattctcctgccttagcctcccgagtagctgggactacaggtgcgcgcgacaccacgccagctaatgtttttgtgtttttattagagatggagtttcaccatgttgaccaggctggtctcaaactcctgaccttgtgattcgcctgccttggcctcccaaagtgatgggattacaggtgtgagccaccgcgcccaacccatctaatttgtattttttttttaagtgaaagcaagtttattaagaaagtaaaggaataaaagaatggctactcgatagacaaagcagcgactaatttgtatttttattagagatgggctttcaccatgttggccaggctggtctcaaactcacctcaggtgatccacaagcctcggcctcacaaaatgctgggattacaggcacgagccaccgcactgggctctgattactcttgagtaaaattttcagcccctaaagaatgaggtgagagggcaggttcaggaatggatgctacccatcacctcacctcgtgcggccctttcctggctgccttacaggaagaatgaatttggggcagcacattctctttatcctttcctctttcttcttttcaccagtcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgagtgtgatactttagggtcaaacgtgtcttacaatatttcacttaaaatgccaggcatggtggcggtgtgcctctgtagtcccagctactcaggaggctgaggcaggagaatcgcttgaacccgggaggcgaaggttgcagtgagctgagattgcgccattgcactctagcctgggtgacagagtgagaaacttcgtctaaaaaaaaaaaaaaaaaaaaaagacaaaaattagctggacgtggtggtgcgctactcaggaggctgaggccggagaatttcttggatctgggaggcggaggttgcagtgagtggagattgcgccattgcactccagccggagcaaccagggcagaactccttatagaaagaaataaaaagaaagaaagaaagaaagagaaagaaagaaagaaagaaagagagagagagaaagaaagagagagagagaaaggagagaaagagagagaaaggagagaaagagagagagagaaaggagagaaagagagaaaggagagaaagagagagagaaagagagagaagaaaggaaagaaaggaaaggaaaggaaagaaaaaggaaaaagaaagaaagaaagaaagaaagaaagaaagaaagaaagaaagaaagaaagaaaaaagaaaggaaggaaggaaggaaggaaagaaagaaagaaagaaaaaagagcgagcctggaagtacactggcaacttcagactgagctgactttaccagtctctatgtttttacaagtagaatagggagcatgatagtttaaagagggcggcaaaacagaagctagcatttgacaggtaacccttgtattccatgcaaatatcagcttcctgctattgagtgtggattgtgggaagagagtactcctgtgccttctagtcaattgtggataaaatacggatatgaagagcacccttgtacttcatcccctgagggttttccattagtctttgatcaatgggattaaatcattttgtaacaaagcattttgcaaaacttagtattttgagcattttaatactaagttggttcttggccttttctcctacctaacacaccagatatttgtatttgaagtggcagtgcttcttgtgaggggttagaagctgttttatcagaatgtacaaggagccaggtgtggtggctgctcatgcctgtagtcccagttactactcagaggttgaggtgggaatatcacttaagccaaggagtcaagcctgggcaatatagcatgaccctgtcttaaaaaaaaaaaaaacttgggaggaaatacacagtagttagaaaaagcctcctaggtgattttgatgaatcccagtctcaaatttcctcatttggaaatgataatgtaggccacacgtattactggagaaaaatgtgctcccgagactttccagagcagcagagctgggactaggcaggtgaggcagctacgtgcaagtgtagccctgagaatgagcacctctttaaagaatgtaccttgcgttagttctgtgcctgtttaaaaaaaaaaagaaagaataaaagaatgcacctgaggcaactccctagctgcctcaccacagtctgggccctgcaaaacagggtcagaaaaaaatcacctgtgggaaattacagatgatccatgagcattctgaggaacagactcctcccacttcagagtggtatgtgcatactttctttctttcttttcttttctttctttttttttttttttgtgagacagaggagtctcactttgtcacccaggctagagtgcagtgatgcaatcttggctcactgcaacctctgcctccgggttcaagcgattcttctgcctcagcctcccaagtagctgggactacaggcacgtgccaccatgcccagctaattttttgcatttttagtagagattgggtttctgtgtgttagccaagatagtctcaatctcctgactttgtgatctgcccgcctcggcctcccaaagtgctgggattacaggcatgagccaccgcgcctggcttgctctttctttttttttttttgagaggtagtcttgctctgtcgcccaggctagagtgcagtagcgcaatatcagctcatagcaacctctacctcctgggttcaagtgattctcctgcctcagcctcccaagtagctggaattacaggcggccgacaccacacacagctaattttgtatttttagtagagacgggctttcaccatgttgaccagtctggtcttgaactcctggcttcaagtgatccacccgcctcggcctcccaaagtgctaggattacaggcatgagccaccatgcccagcctataccttaattattgttggactaaagtggctcccaatttagtcaatgagcagattttgctccacatataatcatcacccaaagttagctgcaccggaattatgggggatgggattcctgagtcagctgaatccagagtctccgtgtaagagggctggaaattgcctgtaaaaaaataaatctgggccggggacagtggctcatgcctctaatcccagcactgtgggaggctgaggctggcagatcacctgagatcaggagttcgagaccagcctgaccaacatggcaaaagcctgtctctactaaaaatataaaaattagccgggcgtggtggatgcaccatctaaaaatcaatcaatcaatcaatcagtctgatgcatagcaggcttggaaatcacttttccaacctacttttgtgcaaacaatgtattcttttttttttttttttttgagacagagtctctgtcaccccggctggagtgtagtggcacaatctcggctcactgcaacttccacctcctgggttcaagtgattctcctgcctcagccttctgagtagctgggattacaggcgtgcaccacttcgcctggctaattttgtgtttttagtagagacagggtttttccaggttagtcaggctggtctcgaactcctgacctcaagtgatctgcccgcctatgcctcccagagtgctgggattacaggtgtgagccacctcacctggcccaagaagttttattgagatgtgtacatgtacattaggtttttgatgtgtagacattgtgataaggtagataattgtgataactatttattgcttgtttaaactgctcaagtaattacttttgtaccaacctaatatctttccccacaagcttgacgtcatcatataatatgttgaggttttgttttgttttgttttgagacagagtcttactccgttgcccaggctggagtgcagtggctcgatctcggctcactgcaacctctgcctcccaggttcaagcaattctcctgtctcagcctcctgagtagctgggactacaggcacctgccaccacacccggctgatttttgtatttttaatagagacagggtttcaccttgttggtcagcctggccttgaactcctgacctcagatgatccactcacctcagcctcccaatgtgctgggattacagtcgtgagcaactgcgcctggccaattataatcttattttagaaaatataagtatacatagtttacatcttacatcttagggatttaaatagttatttcttgagaaggtaaatcccaatgtagaggtccatattatcaaaaagactaataaatattgctatggaggcaactactctgggtgaaataaactgaagtgaacctgggtaacctagataatgttcccttgttaacttgaggtctgagtccaatatttcaatatttcttttctttttttttgagacggagtttcgctcttattgcccaggctggggtgcactggtgcgatctcggctcaccgcaacctccacctcccgggttcaattgattctcctgcctcagcttcccgagtagctgggattacaggcatgcgccaccatgccctactaattttgtatttttaatagagacggggtttctccatgttgtcagggtggtcttgaactccaacctaaggtgatctgcccgccttggcctcccaaattgctgggattagaggcgtgagccactgcgcatggccagtttctcatagctgtgatagttgtagcaaccttactttttttttcttttttttttttgatatggagtctcgctctgttgcccaggctagagtgcagtggcacaatctcagttcactgcaacctccacctcccaggctcaagcgattctcctgcctcagcctcccaagcagctgggattataggtacccaccaccacacccagctaatttttttatttttattacagacagggtttcaccatgttggctaggctggtcttgaactcctgacctcaggttatccaccagccttgggctcccaaattgctgggattacaggaatgaaccactgtgctcggccagcaaccttacattttagcgcagtgcctagtaaataacaaacatagtaatttatttaatatatattaaattgcaatagtagctggtattatttcataaaacacttcaaaagggcctaggcctaggaaatacagcccaatctctgcttattcaaggagcaggataaggttattcaattagttcactatcaaattgagacatcaatgtgcctatcagtgttttgagggtttggggaagagtcaattaaaaaagcatttagctgggcctgatggcacatgcctataatcccagcaacttgggaggctgagaggcaggaggatcacttggagaccaagagtttaggaccagcctgggcaacatagtgagttgctgtctcaacttataaaaaagaaaccagttagtaggaattacactttcttttttttttttttttgagatggagtctcgctctgttgcccaggctggagtgcagtggcaccatctcggctcactgcaagctctgcctcccaggttcacgccattctcctgcctcagcctccccagtagctgggactacaggcgcccgccaccacgcctggctaattttgtttttgtatttttagtagagacggtttcaccacgttagccaggatggtctcgatctcctgacctcgtgatctgcccgcctcggcctcccaaagtgctgggattgcaggcgtgagccactgcacccagcctacaccttcatataagttggtgaagtagacataagcaagaggaaatggaacagtgggaataagcatagttagaagcaacaatggacattagtagctaaaattgagaacatttaaaaagagaaaggagggcgaggtgcagtggctcacgcctgtaatcctagcgctttgggaggctgaggtgggtggatcacaaggtcaggagttcaagaccaacctggccaacatggcgaaaccatgtctctactaaaaaaatacaaaaattggccaggcgtggtggctcacgcctgtaatcccagcactttgggaggccgaggcgggcggatcatgaggtcaggagatcaagaacatcctggctaacatggtgaaaccctgcctctactaaaaatacaaaaaattagccaggcctggtggcacatgcctgtaatcccagctacttgggaggctgaggcaggagaatcgcttgaacccgggaggtagaggttgcagtgagccgagatcgtgccactgcattccagcctgggcaacagagagagactccatctcaaaaaaaaaaaaaaaaagaaagaaatacaaaaattagctgggcgcggtggcaggagcctgtaatcgtgccactgcactccagcctgggtgacagattgagactccgtcaaaaaagaaaaagagaaaggagataagattcagaagataattcagggatattaggattgaacaaaaattgtagtaaaaggacttcttacctcctgggacttttaagtattttttaaattttattttatggtgacagagtcttgttctgtctggcctcccaagtagctgggactacaggtgtgtgccaccatgcctagctaatttttatatttttagtagaaacagggtttcaccatattggccaggctggtctcaaactcctgacctcaggcgatctgcttgccttggcctcccaaagtgctgggattacaggcctgtgcaaccacgctcagccttaagtattttttgagggttctgtgtaagtggtgtgcagaattttatcaaagctgcatgttttcttttctcctaggtgttctattactcaacaggaatcttcaaggatgcaggtgttcaacagcccatctatgccaccatcagcgcgggtgtggttaatactatcttcactttactttctgtaagttggatggtttgataattttggggggagaaatgaatccttgctacagatgttcaaagatggattgcatggctccaccgttatttagttacaccttttttgttatttatttttatttttttaaattttttgagacagagtcttgctctgttgcccaggctggagtgcagtggtgcaatctcggctcactgcaacctcagcctcctgggttcaagtgattctcctgcctcagccttccgaagtagctcggatacaggtgtgcgccaccacgcccaactcatttttgtatttttagtagagacggggtttcgccatgttggccaggctggtcttgaactcctgacctctggtgatccacctgcctaggcctcccaaagtactgggattacaggtgtgagccagcgtgcccggactgttgtttaattttcctttggaaaaaagagatacattcaatgctgaatgtagtcttcattcttcaagcaaatatggatggatgggaaaagaggaagtatagaagggactatacagtatgttttgaacttggaattggaggagaggtgtttggaaaaactttcaaactgttattcctctgtttttacactaaaacaacaataataacagaagatttctgtgacccccaaaatatataaggatttgtccccatcaagtaagcaatcagttccgtagtggacactatctaggtgtcctgtgatttaattctgacactacctggagatagcatcagagctcacaggttggtggccgatttcccaagactgcccccaactcctgatgccagtcacaagctccaggttgttttacctgtgcttctgactcaccagctgtagatcaggattcccacgacatcctctttgggtttgattaatttgctacagtggctcacagtactcaggaaaattgtttcctagtttgatttaaaggatattttaaagcacagaaatacacaaccagatgaagagattcacagggcgaggtctggagggatcctgagcatgggagcttctgtctctgtggggttggggtgcactcctagcacatagatgagttgttgctgaccttcctgtcagcttccacgggttcagatatctggaagctccccataccctaccttttgggccttttatgcagacttaattggttctccatgattgaagcatggacaactgttctgacctgtgattggacaaaaagggaatgatctgaacccagctgggcctgtctgcttagatgatttgttggcctctctgtagcgtttcttcctctagggtgtggggcaggaccctctctgaaatgagggttttatgacccacagtcagattagcgtcctgccaagtgggagggcaggagaaagtcagagaagaattctgttatctgaggcctgctcctgaggcctgaagcatcccaacattatgacaaaagactctaccaagggctatggggattttgagccaggacctgtgaatggcacacaatatgtatgtatataaaatcataaatcacaggaggggtatccataacaagtgtcctgctgttggtaaggcagatttcaagtagctcagatgctgttttcatggaaaggaaaactgaagtttcatgtcatattcttcttccagctatttctggtggaaagggcaggaagaaggactctgcatatgataggccttggagggatggctttttgttccacgctcatgactgtttctttgttattaaaggtaagtgctctttgggtgaaaaaaaagggagggggaaagaagagaggttacagttgacttctgtgacacaaggggtgggttgttaaggttgcagtttgtcaataaagtcagaggagagaagcaagatgcccagagtttttaagaaacatgggtcatcagagaactggaggtaaactgttagaatctttacatttagagaacattattatggtttataaaataagttatctaatttaattcttttgtttgtttgtttgtttgtttgagacggagttttgctcttgttgcccaggctggagtgcagtggtgcaatctcagctcaccacaacctctacctcctgggttcaagtgattctcctgcatcagcctcccgagtagctgtgattacaggcatgcacctccacgcccagctaattttttatttttagtagagacagggtttctccatgttggtcagactggtctcgaactcccaacctcaggtgatccacctgcctcagcctcccaaagtgctgggattacaggcatgagccactgtgccctgcctaatttaattcttaaaataatatcaaggtaatcacactttatggatgatgacggggtctcagtacaaagtgacatatatgagatcacatagatgggattcaaaaatccaagcctggctgggtgcagtgcttcattcctgtcatcttaacactttgggaggccaaggtgagaggattgcttgagcccagaagttcaagaccagcctaggcaacatggcaagaaactgtctctaaaaaaaaaaaaagtatttttttgtttttgttttttgttttttgagacagggtcttgctgtgtcacccagttgggagtgcaatgtcgccatcttggctcactgcaatctctgcctcccaggcttcattgattctcctgcctcagcctccctggtagctgggattacaggcatgcgccaccacacccagctaatttttgtgttttttagtagagacagggtttcaccatgttggccaggctggtctccaactcctgacctcaaataatccactcacttcaccctcccaaagtgctgggactataggcgtgagccacagtgcccagccaaaaaaacaacgaaaaccttttgtttaattagccaggtgtggtggcacatgcctcaagtcccagctatttgagaggctgaggtgggaggattgcttaagcccaggaggtcgatgatgcagtgagctgttatagcaccactgcactctagcctgggcaacagagtaagaccccgtctcaaaaaataaatataaaaataaaaataaatccaagccttttgattccacagccactctttgtattgtacgtcaggacaggaggagcttgccattagttgcctctgggaacctagatcctgggttacactgtctttaaatttaatcttctgtgttccttcctcttacagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgctgtaagtaaactcaccttatctatgtatctatgtatctatctatgtatctgtctatctatctatctatctatctatctatatatatatatatttttgagactgagtctcgccctggtgtgcagttgcccgatctcagctcactgacaagcgattcttctgcctcagcctcctgagtagctgggactacaggcacccgccaccgtgcccagctaatttttgtatgtttagtagagatggggtttccccatgttggccaggatggtcatgatctcttgacctggtaatctgcccgccttggcctcccaaagtgctgggattacaggcgtgagccaccatgcccggccaactcaccttatcttaaaaccagcctacgtaggctgacatattgaagatacaccttaataatacagtagtcaggctgggcgaggtggctcactcctgtaatcccagcactttgggcggctgaggcaggcagatcacctgaggtcgggaggtagagaccactctgaccaacatggagaaaccctgtctctactaaaaatgcaaaattagccgggcatggtggcgcatgcctgtaatccaaactacttgggaggctgaggcaggagaatcgcttgagcccaggaggcagaggttgcggtgagctgagatcgggccattgcactccagcctgggcaacaagacagaaactccgtctcaaaaaatatatataataataatagtaatacagtagtccctcctcatctgcagtttcagttacctgcagtctaaaaatattaaatggaaaattccagaaataaacaaatcataagttttaaattgcacccgggagcagtggctcaaagccggtaatcctaggactttgggaggtggaggtgggcggatcacttgcagtcaagagttcgagattagcctgaccatctggtgaaacaccatctctgctaaacatacaaaaattagccaggcgtggtggcacaaacctgtagtcctagctactcgggaggctgaggcaggagaatcgcttgaaaccaggaggtggagttcgtggtgagccaagatcttgccatgacactccagcctgggtgacagagctagactccatctcaaaaacaaaacaaaacaatttacgaatagagacaggggcttgctatgttggccaggctggtctcaaactcctgggttcaagtgatcctcccacctcagcctcccaaagtgctgggattacaggcaggcaccatggtgcccagtttaagaatatatcttttgtccataaaattgtgaagaagaaaaaagaagatgggtgagatggctcacgcctgtaatcccagcactttgggaggctgaggtgggaggatcatgaggtcaggagttcgagaccagcctggccaatatcgagaaaccccgtctctactaaaaattcaagaaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggagcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaataaaaaaaataaaaaaaataaaaaataaaaattcaagaaattagctgggtgtggtggcaggcgcctgtaatctcaggtacttgggaggctgaggcaggagaattgcttgaacatgggaggcagaggttgcagtgagccaagcttgcaccattgcactcaagcctgggcaataagagcaaaactccatctcaaaaacaaaaacaaaaacaaaaaaacaaaaaaaaacaaaactggccaggcacggtggctcacacctgtaatcccagcactttgggagaccaaggcgagaggatcacctgaggttgggagtgcaagaccagcctgaccaacatggaaaatccccacctctactaaaaatacaaaatttgccaggtttggtggtgcatacctgtaatcccagctactcaggaggctgaggcaggagaatcgcttgaacctgggaggcggaggatgctgtgagcggagctcatgccattgcactccagcctgggcaacaagagcgaaactccgtctcaaaaaaaacaaaacaaaacaaaactggataactggggactactgtaattactgacgctatgaaagattagacatcaaaggctataaaccagattttcaacaatacatagaaaaaaaatgacggcagaaaagattgaaatgggatggcaaaactgggaaccattcattttttattatttgagacggagtctcactttgttgcccacggtggaatgcagtggctcactctcggctcactgcaacctctgcctcctgggatcaagtggttctcttgcctcagcctcctgagtagctaggattacaggcacgtgccaccactcccagcaatttttttttttgtatttttagtagagacggggttttgccatgttggccaggctggtctcaaactcctggcctcaagggatccacctgcctcagcctctaaaagtgctgggattacaggcatgagccaccacacccagctcagcaacacagattttaaaaataatactcaaggccaggtgcagtggctcacgcctgtaatcccagcactttgggaggccaaggcaggcagattacaaggtcaggagtttgagaccagcctggccaatatggtgaaaccccatctctgctaaaaatacaaaaattagccaggcgtgctggtgggcacctgtagtcccagctactcaggaggctgagacaggagaatcgcttgaacccaagaggaggaggttgcagtgagccgagatcctgccattgcgctccagcctgggtgacagagtgagactccatctccaaataataataataataataatactcaaaagtccaaaaatactcagtagacatttggaagcatctaactttaatgaaaaaaaatgacagaaagaaaaatacagagaaatatagtaagttagcaatagaatcataagtaaatctctgaagaaacctttatgttttcattaaatatggaagggttatagcttgaagcctattggaaatatgaatgtgaaggaaattgtatttgtcaatgaccagatttttatatcaaccttccttttttctgtcctttcactagtactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgt

SEQ ID NO: 38747 - DNA, 34523 bp, Homo sapiens; identical to SEQ ID NO: 38459

SEQ ID NO: 38748 - DNA, 4159 bp, Homo sapiens
gggtcctgcagcctcccgagtgcggagaggcggggccgcccgctgccgcccggctgcctgcgccccctcccgcggccccggctctgggagcggggcgccccgcgcgcgggcacacggcggccagagcgccgaggcggtaccttcagcctgcaatgagaggaacccgggagagcccccgggagccagcgaagagcttggctgctgcgtccagggctgctgctgccgccgcggctgcttgaaactcctcaaagttgagagccggctagagggtgccgcccgccgggagccggagggaaaggaagtcggaaggtgcaagagtgacagacacggacagacggacgcgcagaccttcggaaggcactgcgtaggcagcctccccggagcccacgaggctccccagcaccgtgagttttttcctggatgggtggttgctaagtatttccgtttaattgtttgtagcgtacgtttgcgtatagttgtgtctgttggagggagtttaaaacaacaacaacaacaacaacaacgcaggatgcaccttaggaaaaaattgagtttctgatggtgggtgagacggtgggttgtatggagagaatgtgactgtacatttttataagcaggactaacccaggaaagaggaaaaaatacatttaacagtgaagaggcaacacagagctccctattgtgaaataaaacccatttcaaaagttattggaaagaaagtaaggtatggctcttatgggttaactagtggtagtcagtttctgctttttactccctctgaattattaattgtttgccaggttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccatagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttaaagttgatttttttaaagggggaggggaaggctttaatgtgttctagatcaatttataccttccgtatgacgttttactctgatatcattgtgcactttagccagatccagaaaacactcaaatttattttgcaacaagtgagagcccaggagacctccttattatcctgtctctgctttgaggcaatcaagtaccctctctgaacctaggttccctcatctgtaaaacaaaggtttcagaccagatggtgtttaaggtttctccccatactggaatgaatgatttcttggtggtattagcatcatcacagacctatacttgctttctgaaactctaccacatactgaaggaatacaggaatgggattaagatgactagcatagcagtgtacagcttgaagagatgttccacatcatcactccagctccttctcttttctcagggacaaatgaggcccagagagaatacgacctgtgtaaggtcaaacagtggcagggaaagaaggagagctggggtttagcattctccctggtgaagattggaggtccaaagaaatgactcctttttaagggatgggcataaaaaagtgatcaaaacattgcaaaggagaatcaaagattgattgtcctggggctaagaaagaagataatttttaaagaatgggagtgggcaacagtgaaaaatattgcagataagtagataaggatagaagatcaaccactgactggtagta

SEQ ID NO: 38749 - DNA, 135550 bp, Homo sapiens
agaactctgcgctactgcccacgcatctcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccccaaaacgctggagctcagaacccagctcaggtgcgctcgtcggtttcccagggagactggggctgattgtaggcacgcgggggcgggaagacagcttcttgcttctggctgcgatggaggcggatctgggcggggccgaaacgggggcggggccaagtgtgggggcgtagtcaggcgtgggggcgggccggcgccggcgccgcggtcggcggcagcgctctcctaagctctcgcggctgcgcttcggtcccggacccgggccacccacggggtagtgggtgctcctcggccccggacattgcaagccccagaaggtaaatttgcgtgggagccgcgcacctggagcgcgagggtacccatgatgagggcgggaggctggatggcgacagaagggagcgtcccgcggcgagtttcccaagaaagctgaactcgtcccaagtttcttgtgcctcggcttgcactcagtgaatgggtggcgggctcatttgctgcgggtggtcttttggcgcgggagggacgcggaggtgattggattaatccgcctgggcggcagcccagatttctgccgggaaccgcgcaccgcagtggtgcagtttttgcccgagaaagggcgggtaagtgcggtgcagtcgtgtcctgcgcagcagcagggggaccgccggtctgggagcacgcgagtcggccaggcgtccccggttgtccagaggcacagtttcctaacttctttcctctttaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaaggtaaaagtgggcaggagtgtggcacgccattcactaagcggaaagtaaatgtgttgggagtggggaggaggagcgtagaggaaacccgaagaagtcattccgttttaattctgtgttttgctcttgattgctagtgtacatccagctcttggccactttgatgctggcaggcacagccgagtttagtgcaactttgtgggaagaagtgaaattcatcacttttaaatttctaagctcaggcagaattgggggggacaagagtgaaatatggcagattattggctgagtgagtctttaccacttttaaaagagatagctgaaagggggaggagcatgttcagaaccgcactctgcagtcaagttgtctggagtttgcttagaggtttcagtcaatgatagctgttatcacagctgattcagaaaaatactgattcctgtttgagcctgttgattattttttgcttttacttactgaattttgagtggttactacgcacttgatgtcattcaggtagaatgtgaatttgaaaatcagttgccaggatcacaaaagacataaatattttgtcatcttttttgttgcttgtttttgtcaccgtggcctttggttgtgttttattcccgttgtatgcccattcatccttgagtgcatgtaacagattggcagctgaaaacttaaggttagggtggacactgtgtggtattgctcccctatattgtcccattagctgcacttattaaaatattgtcaaatatgacataaagaaacagggaaaactgaagaggggtattttggagtgtgtgcttccttccacagaaacaacacaggtttcagcaataaggcagattctttttggcagccacattttttcttggttaatcagagcactggaaccagtctatataaatggcacatatgcaaaacacaagcaagcctgttttattttagagcccgtggtcttaaagaaaataaattacataacattttatgtgttttttccaactctgcaagtatagcaaagttcaatttaacagtgatggtgaatcacgagttgtaaaatgagctgacctgctagttatttgaggattctcaatctgttttgacagggtgtgggggatcttgtacattttatttcattgtttcagtgaattgtagtgatcaaatgagtgaactcctccagggctcagcttctgtgcgctcttggaaatctaattaatgtaatgactaaaaaaaagtatttttacttaaaatagctgtattttctatttggctcattcatacatagtttgcttttccttttttttttttttttttacttttttttgtctcttagaaaaaaatgctgaaaggacaaggaacatttgatggggaaggtaagcatttaattttccaaactttcattgctgtttcaatgtggaataccaattataagttgaaatccaactgcagtaacaaaaatgcttacgatgagaaatatgtccaacttcttctcaaattatacagtccaaagcttctcactaagctaaatttttatctagtaatactaatggtgaatatagttaatggcattttttataggctgataactttttcagtcgatgtcctgggatttttaattcttctctaccttggctccatccccatgttcctcaggaagggtaagagcaagatctagctttttagttaaaaattctgattttggcatttagatctgaagtcatatttctttaggtcacatttcctttgacttagtattctgcccatatttccacatttgattatcatttctgacttcctgtttccttattaagtttcagctttggggaaactctaactctcctggctgacaaaaacatattcttaagacttttcaacccatgtagtatttttattaaggatctcaaaaaaaaaaaaagcagcttcaaccaggtgttcaaaccctaatcagattaatggacttttttaaatagatgggtcaagcgtcagccaactggaagagcatgaagggagcagtcccagctgtagcacttgttgggctagagggtcatggtggtagtgagggtagttaaatttttgtcatgttttgaagtgtgaagattttccaaccttcaaagaataataaagaagggagtgcccctccataggtcaagcaaatgtacaatcacccagagttataaaatatgtagccttaggtgattgtcaagtaattccctatataatttttataaagatgagtttcccattggaacatttataaatgacttatctataaaaattcattcaccgcaccaatcttaggaaatccagatatagtatttagctggttggaataagttcatctccctaattttataattgaggaaaccagaagatctgagaggtttggtaacctgtctgctgtcacacctagttacacagccagtagtaggacacagatcgagttcttagtccagtttgctgcttcttatagcactctgactatgaagtgaacagcatctacctaatatttacctaaggagatgctttacattccctggaatttgatatttattttgtgacctctgcctaagagagtttaaaatttttagattttttttgaagtcagagagtagacttcattataactagttttacgttatttccttttataaggagctgtttctgtgtatcctctcatttcttctcaaatataatgacctagaaatttttttcatgtacatacatatgtacatgaggaatgcaggattcttacagttaatgattaacaagaatgtaactaaagaagcagtgtgtctaaatggtgagaatctgtgatattagagccaggcagacctgggttcctgtcttgctgttcctgttcatcagttaagtgatactgagaaaaacccttaatatcacagggacctcactgagccacctcatgtgtgaaatgaggttaataatactgttgcctaagttgttgtgaaaatgaatgagaaatctgtcaacaatgttatgcatatatactttgtgccaactacttagtactttgaagactaggggagactcagcctttaccctcataatctgctttacatagcatgacaatcagagaccagtaaaatcttgaatagactccagtgttactttagtcatagtgcatacagaatattctgtagttgatgagaaaaggggcagatgcatgcttgttttggtagatgggaaagtcagttcaaactcaaaatgccccaaaccaaactcataatcttccccactaaacctgaatctcttctggtgttcccatctcctactttctggttgtgaggcctgcagacctaggaaacacccttaacacctccctctctctgcccccatatccggtctttcaccagtctgttctatgttatgtagctcaaatctccatcatctttcgttgactaccccaatagcttcttagtctcctaggtagtcaatgttttgctgtctaatctaagcaagtctttccttttcatggagtcccattgtgttcaggaaagaaatgctatcatgacagtgtgaaagaaactcaatccttttgtactcagggtgaaatccagtttttaccattgcctacaaatatttccttgatttggactgtctggctcatgtctctaaactcaccttgtacactgtggccactagacatacccaagcttttgccacgttgactttccctagttcttttaagatacagccatgcatcacttaatgatgaggatacattctgagaaatacacccttgggcagttttgttgttgtgcaaatatcacagagcgtacttaaacaaaccagatggtatagcctaggatatatggtagagccaaacctgtacagcatgttactgtactgaatactgtaggcagttgtaacacaatgatatttgtgtatctaagcacaggaaaagtacagtaaaaatacaatataaaatattaaaaatggtactcttctataggactcttaccgtgaatggagcttgcagtactgaaagttgccctgggtgagtcagtaaatgagtagtgagtgaatgggaaggcctagaacattactgtacactattgtagactttacaaatactgtacatttaagctatattaaattttaaagaaacttttcaatcattaacttcagcttactgtaacttattttgtaaaatttaaaaatttttgaatcttttcaactctggttttaatacagcttaaaacacaaacacattgtacaactgtacagaaatgttttatttcttcacatacctattccataagctttttcctattgtaaaaaattttcatttttactttttaaattcttttgttgaaactaaacacatgcattagcctaggcctgcacagggtcagaatcatcaatgtcactgttctccatctcaacatcttgtcccacaagaaggtcttcagggacagtaacatacatggggctgtcatcaatgataacagtgtcttctggaatacctcctgaaggacctgcctgaggctgtttcacagttaactattttttttttttttttttggtaagtaggagtgcactctaaaataatgataaaaagcatggtatagtaaatacataaaccagtaacatagtttattatcattatcaagtatcatgaactgtatataattgtatgtgctatacttttgtatttttggcagtacaatcggtttgtttacaccagcattaccatagacatgtgagtaatgtggtacactacaacatttaagatggctaggtgataggaattttttagctcctttataacatatgggaccaccgttgtagatgtggtttgtcattgatcaaaacaatattatgcaatgcgtgactgtattatgtttcctcttatgttcgcattatagcttttgtgtatgcttttcctgtagctctgtagcttctcagctttcagaccttagactttcctcattgaccaaatatctgactgccagactagatcacaccctactgacagtctgttctcacctctatataaatccttcagtttgtaggtatgtatttgtgtaagatcattatgttctcaaacttatagtgacttgccatcacattttgagtaaaaatcaaagtcctttaatggctgaggcaaggccctacatgatcagccctctggtcacccacaactcccatcttcttcttcttttttttattttgagatggggtccagtctggagtgtagtggcatgatctcggctcactgcaacttctgcttcccaggttcaagcagttcttctgcctcagcctcccgagtagctgggaccacaggggtgcaccaccacactcggctaatttgttgtatttttgatagaggcaggatctcactatgttgcccaggctggtctcgaactcctgacctcaagtgatctgcccatgtcagcctcccaaagtgctgagattacaagtgtgagccaccatgcccgccggcctcaactcccatcttctgtactttccccccatttccttgtactccagccatgcagtcctccttgctgctcttggtacatacagacataccaagtagactcatgccccagggctttgcacttgctgtgtccctgatgagatgctgtttgggcactagttcttcatcagagtcaacatcaagggccttttctttgtagttttgatacaggtggctcactttctcacctgttctatgtctttacttaattgtcactccagtgaggccttcctaaactaccctacttaacatctacatgccctcctcccagcgctttctaccccccttccctgtttcatgtttcttcatgacacttatcagcatcaaaatactatcaaagttatttgcttatttattgcagttctctcatgctttagtatcagctcctgaatattgagatttttagtgtctattattgtatttcacgtgctaagctgttgccggttcctagtaggtgttttctaagtaacagttgaatgaataaatgcatgagtgaatttgacagtttttttaattaaactgttagctcatgagaggtggatgagggcatgagagctcatgaggcatcagaggtgtctttcttttgttttccattttactctcagcccttggcacgtcatagatacacaataaatgtttattaaatagataaatgaatggtgatggaccttaaataaaagataggatgtaatttaacctaaattacagtgatttaacaggcctgactgtccttcatgagtagtggacagagacatggaaactgcttctgttggcattctctgtatgggctggtccccttcccctgcagttgagtttgagatagagctatgtgaatgagaaaatcacttttctgtaattattcttcagggactaaatctgtttgtctctctgtttataaaattggaggccaaacattgggtacatatgatgtttatttagaacaagtaacataatgattgagaacaattagtgacacataggccttgttttcttgcagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgagtgtttatcttcttttctatctgtggtaggaaaaaaacaagttttggaaattatgtgtggatttggcttttgttcttttctgccagtgatcctgtaactaaggagaaagactctttttagattgtgaaatgtttctcggaactctgcccgcactaatgagaacatgaactttgacacttctgatcaggaaaattaggtttgataaaataaagtgctatgagattgatgtactgtgacctctggaaactctttctgcgagatctctctttttgttaaatatagcctgcactttatcataattatggctatttacatatatatgcgtgtgtgtttatgtatgtatgcgtgtatatgtacatgtatgtatgtacctgtatatgtatctctgcacaatagaaagctagttacaattcttccttggaaatttttttttttttttttgagatgaggtcttgctctgtcgcccaggctggagttcagtggcgtgatctcggctcactgcagtctcccaggttcatgtgattctcctgcctcagcctcctgagtagctaggactgtaggcgtgtgccaccatacccagctaatttttgtatttttagtagagatgagatttcaccgtattggccaggctggtcttgaattcctgccctctagtgatccgcctgcctcagcctcccaaagtgctgggattacaggcatgagccaccgcatctagcccttccttggaaatttaatttgatatagaaatgtttatatattcttaaagctgattaatgaatgatattctgttccatctctgtgccttttttgtatgcctgtctctgacacttaattttgtgttgatgagtaatttctcctctctgcatcagacaccttttgttttttaactgtatatttttttcctcctggcttacaatgtcacagtttgatgcttagtttacttgataagagtttgggcacagcatttgcgaatatctgatgaattagcaagtagaaaggaattcccatggctggcttggttcaggggagctttgcatcaaaaacaagccagtacacctccatgagtccttaggcaatatcagagcagaggtgacagagatgtttagaatcaggaatcttgtgtatttagggaacccactggtgtaagaaaaggagttgttaatgttggtgctgtatagccagggccgtgggaatatgtgtatgtaaacggtgggagacaacttctgcttcaagctctaccttccctcttctaacctgtattggaattcaaaattcaatacaccaagcgctttctccctgtcttcttcccacctcctaattttgttctcaggagaatctgttcatttccagggcctctgaggtatagcacccttatgattatgccaaaaattaaaatattcacagtgtcaggggaagtagaatgaatatgtgatgctggtatatgtaggtgatagggagtggtgggagctgtggtgaacaggccttatataaattgagcagctactacttagctcaaaccaggtgagtgcaggggctcagtgtgaccagatgttctgataattagaaaagagaatgtacaaatccagacttttatgagtattttctcaactcaaattttaaagaaatgttgtgtgtccaagaaagtattcagatttgccctctatgctaacagtttgtaacttctgtgatatttttaaaatttttgcatgtggttaggtggtaaaagctagccacagaattggtttattagcagccttataccctaatctaatgatctcatgatatgtgtatcccaaaacagatatgtggaaaaactgatgacaaggtccattgaggccatgttggctctaaatggctgtcattcagttcattcagttgttggtatggaccatttggtagaggatccaggagaagaaagaaggctgtgaattttttgttttctctctgtggcagcagctgggtttgttagcacaggcctaaatcgtgctgttggtctctgaaagaatgctaaaaagaaatgtggatttttatgtcagttacaccctgatctcagtttagcccaagaaacaggctgccatatttatgcctcctggagtttggctttcatatacatgaacaaatgtatatacaattaaataatagtgcatatccttcagttcaactttgtttatggacttgcattttatttggcaaaaaatgaatgttgtgtcttttgtaaatgatattgatatcatagaactatcttgtaataaaatgtaaaactataaagtgatttctgattttagtgtatgttatcttggagttgagtgttcccgggaggcttgtgtgtgtttattgtgttgcttggcaattaaatttaatgaaagcagcatgattggacttggccacttagcattacttaggcaccagcctgcatttctttgtgccttttgtgtcttcttttcacttacattttactttaattttttttgttataaagtgctttaaacccatagaaaaattaaaaaataaataaagttaatcaatttctgtgtacctatcactcagattgaacaaatgttaatattttaacatatttgcttcattttctatttttttagactattacagcgaacccctccttcctttccagttcttttctccttcctacctccccagagataaccactatccctgacgttctcttctgtccttcccatgagggttttctgtccaccaaaaagatataaccagttctggcttttaggaaagtagatattttaacaccagaaagcagccattacctttttagaagctcatctgctactaaattttcaagttgtatttaggaccctaacgagcggaggcttcgtgcatcattaacaatgtcaggatgtttctcaaaagtgatcggcacctctatttctctatctgacccctcctggtagtgaagctgcagcgtttagggcaggtctcagaagactttcaactttaatatatatattcagctttaatatgtaatatataaatatatatgtgtgtgtatatatagagttggaggtctatatatataaatacctagtataatgtatatattaaacctagcatcatctacgtatataaaatcatccttccatgcttaattttaataatcaaaatagtaaggtagcccgtctaattttgagtataacattttaatgcaaaactcttcttaaagacaaggggttttctggcagtgggttaggtctcagttcggcatataccttcacttcctgctaaggagggtagggagtgagtgcacatgtgcattagccggtgttgttttattttctaaaaaatctttttattgcaaatgcctgcctcctgggatggtgaaactatccttatcagttgactataagaagcattcagtatgctgaatacttttgaagtgcagcaatttgcagtaatttatggttgttacgtaagatctttaagccttgagtctgtgctgtaatttgtctgggcgtgtttatgtttcctttggtttcattggaccatgctgggtaaggcagtgttcagctatacagatgacaggtggttccccatttatggtgttgggacaggtttaactgtagtgttgtcatttaggaataaaggagaattagaagaggcatttatttagttgggcctcagtagaataataaatgatagtcatttgtttaactgagcctcaatagaataatgagccacagacttctatattaggactaaagaaataaggctgcacacctacaactatctgatctggcaggtttgtagaagatcagatagttgtaggtgtgcagccttatttctgggctcttttttctgttccattggtttgtgtgtctgtttttgtaccagtatcatgctgtttggttactgtagccctgtagtgtagtttgaagtcaggtagtgtgatgcctccggctttattcttttgcttaggattttcttggctattttttggttccatatggattttagaatagtttttttccagtttgtgaagaatctcaatgctagtttagtaggaataggattgaatctataaattgctttgggcagtatggccattttaatgatattcatttttcctgtccataagcatggaatatttgtccatttgtttatgtcatccctgatttctttgagcagtgttttgtacttgtagagatctttcacctccctaattagctatattcctaggtatcttatttttttgtggcaattgtgaatggcagtttgttcctgatctggctcttggcttgactgttgttggtgtatagaaatgctagtgatctttgcacatcgatttcgtatcctgagactttgctgaagttttttttatcagcttaagaagctttccggctgagactatggggttttccatatataggatcatgtcatctgcagacagggatagtttgactttctttcttactatttgaataccctttctttctttcttcctttctttctcttgccagattgcactggccaggacttccagtactattgtattagtccgttttcatgctgctgataaagacatccctgagactgggtaatttatacaggaaaaagggttcaatgggcttacagtcccctgtgtctggggaggactctggggaggcttccacaatggtggaaggccaggaggagcaagtcacgccttatgtggatggcagcaggcaaagagagagcttgtgcagagaaacttccgtttttaaaaccatcagatctcgtgagacttactcactatcatgagaacagcacaggaaagactggcccccatgatcacttaactcccacctggtccccccaacaacatgtgggaattcaatatgagatttgggcagggaaacagacaaaccatatcaactatattgaataggagtggtgagagacggcatccttatcttgtgctggttttcaaggggagtgctttcagcttttgcccatttagtatgatgttggtgatgggtttgtaatatatggctcttattattttgaggtattttccttcaatacctagtttattgaggtttttttttttaacatgaatcaatgttgaattttatcaaaagccttttctgcatctattgagataatcatggtttttgtctttagttctgtttatatgatgaataatatttattgatttgtgcatgttgaaccaaccttgcatcccatggataaagcctagttgatcatggtggataagctttttgatgtgctgctggatttgatttgccatattttgttgaggatttttgcatggatgttcattaaggatattggcttgaagtttttttcttttgttgttgtatctctgccaggttttagtatcaggatgatgctggcctcatagaatgagagaggagttcctcttctccaattttttttggaatagtttcagtaggaatggtaccagttctttttacatctggtagaatttagctatgaatctgcttggtcctgggcttttcttggctggtaggctatttattactgcctcaatttcagaaatcgtgattggtctcttcagggatttgatttctccctagttcagtcttgggagggtatatgtgttcacgaatttatccatttcttctcgattttctactttatgtgcctagaggtattcataatgttttctgatggttgtttgtatttctgtggggtcagtggtaatatcccccttgtcctgaaataatgttaatggtcgtagttcccagtttgggttggtcaaatgtggaagggatttgaggttttgaaacctcaatgactttgaaaagtaagttttgacccctggagattatctggaactctactcagagacaaaaaccctgctgcacgcaggtaaatcaccggtgcctcacccaaaacagcagcacaaacattaagccagcagttcttggatctctgggaaaagcatgtgggtttgaaggaaaatattgattgtattagtcagggatggaacactgtgtacttgttacagttaatgccaggtgtgtagtcagctgaacttcaggttttccaaagggttcattcattagtaggaccccggaagtatttattgtcttttcttttagatagattttgactagagtttttgcttttcactgtaagtaccccctccacctctccaagatcatgtactatgcatgtatgaagaaatgactgttgcaacaccagtgtttgttatgttaagttcggtgatggaaccaaaaccatatttgccagctgtgccctgacctgatttatttgccatggggtgcgtttgtgtaatttccatcaccttgaaatgccagatacctttgaaaagggtgttctctgttcagcacctaatagagtcatcctctactgcactcttcttttgtacttgctgacatgtggctttatcagtaatcttaagtcattggaatgtttcttcagtttgctcaaatattttgaactctgtagtcagaaatggtttgatttcttaaagtattttaattttaattaaaatattttaactaaagtattttaattttaattaaagtattttaagtaaagtattttaattttaattaaaatattttaactaaagtattttaattaaagtatttttcagctctgtgctaagtgtgactaacagtgcaatgggagatctagaattcagacctcagtctctggttctgggctcagctcttaaagcacacatagtgtacctgtgggagactttctggaattgcaggatgagaaaggaagatttgaaaagcaggaattttattataaatatcatttcattccattgaaaatgcagcagacactttggcatcttagtagtttgaggtgatgggacttattattttagaatttactctgtgcttattgtgaaagacatactattttctagtaaaaatcagagctcaacaaatgtaatatacctgaatgtcattctgtttgcagaaatgcttaatgcatttaaacttattcttttccctaaattttcacatttgtctgaattttcagttgtttgtgacttgttgcttaaaatagtaatttctgtagttttataatttttcatttacagtttggcaacgcagcagtctcataagattatttttttactttagatggtgactaaaaccttttaccatatctttttttgtgtgtgtataagatatggaaaattattttcactttttataactggctcacatttagctcacatcatggtttaaacagaactgcaagcacatactagtccacattttcaagttggcttgtgggtcttctggaatccttgtgtctttataaacaaaaatagaggcccatgtgcctagacctgagatccatggtttggatatttttcccctccaaaactcatatggaaatttaattcctgatgtagcagtattgagaggtggagcctttaagaagtaattagatcatgagggctctgcctgcgtgaatagattaacagccgcagattactgggctaatggattaatgaattatcatgggaggggagcaggtggctttataggaagaggaagagagacctgagctagctcgttagcatgcttagcctccttgccatatgataccctgcaccacttcggggctcttcagagtgtccccaccggcaagaaggctctcaccaaatgtagcccctcagcctggaacttcttagcctctataactgtaggagataaatttctttgctttataaattacccaatttcaggtattctgttgtaagcaccccaaaacggactaagacataccccaattagaattactactctagctaagagagataaaggtgggggactacttagcttgggccagggactgggctctgtatgtggtcttgctttttatgtataattagattatggtacatttctgaaaattaacttgacttatgtaagcaatatataatatgtccttcatgtagagaataattcagacattttggaccaggtacagtgggtcctgcctgtaatctcagaactttggaaggctgaggcaggaggatctcttgagcccaggagtttgagaccagcctgggcaacatagtgagacccctatctcttaaaaaaaaaaaaaaagaagaagagaagaagaagaattgggacatttcagattagactaaaggctcttttggtcatttgtgcaatcccagtctctatccccttctccatagataatgctgctctcaatttggcaatactcttctgaaaatccacatatatacatttaaggaaacaatatagattacccatatttatgtaaatatacagactatttataatatacagcttgtttcttttctgcactatgtgtcttataagtcatttcatatctacacatgatctacagtgttataactgcattaatacataggatggatatgcatttagccatctttactgggggagtgtcatacatgctttaagaatctaataaaaattatgagccataggctttctctgtagaaaaatgcacacatgtatacatgtaaatttttttaataatttttgttttttcagttttagttggagagtatttttttcttgactttatttccaaatactaggagcaccttagtgtagcttgttatgtattgagtacagtttccatgttgttaatatcactttaaaaagtttttctgtatctgcattgttgcagcgttggaactttatgtaactcctaaaaatatagacagagattgaggaaaaaactactctggttggagctcactaattaaagggcaactgagtggtagatctgccaatatttatgtaattgattcttctgagagaacagtgaagtgttgggatatgggggtgtgtgcaccagttgcccgagggtaggcagagatcagaaatgacaggtgctccaagaaagcaggaggagatgaaaacacggttagttaattgttatgggcataactacaaaggcagatgtttcaactacaaacctacaacagggtccagacagagagggtcttcttacttcattgagtagaaaatcgatgagagagattgatgaattcattgtcttcatcaagggcctgccccacatgaagttctgtctatggcaggccctggagatagagcaagaacagactccaccttgcattcatgtccttgtaaacaacctgaatggcgagacagatgtcagatatcaaatcatcccatagataaatgcataattactattgtggtaaagctgtgaatgacttactggtgctgctgcaagatcttctagaaaagagcacctgtctgggcaaggtgcggtcagtggagagcaggtgtcagaggaggtaatgtgagctgtcatctggagggtccaggacgatagctggtggggcacagttggggagtggcagggtagaagagtctcaggtagagaaaatgtcatgtgcacagacatttggggtgatggtgggtaagaggagttgggataaggccagtgcagctggaacatcttgatctcctttgtgggtttttcctcattcctctgttctctaaattttggagggcccctgggctcatccttgggcctcttctcttacctgcactcatgtggtggttttatcaatcttgtacttttaaatatatcatatactcggatgacttccaagttattgcttactatgaaatcgaattaaattttggacttattctcaactagctatttcttttggggagttggaagggatacattcaagaataatagcagtctgtaggaagagaaggctcagggatgttgaagagttctgaataactgcatagaaaggctttttcatactgactttggattgcagattcatctatgggattcttgtatttgccctgttgagcttaatgtatcctcttgtggggtctccttcctcagtccaaagatagggctatttctcagggccacatccacacagtggttggtctccatgatgattggagagtgttgtcacctttaaaattactattgaatctttaaataaggaatccttaaaaatttgttactcaaattttgtggatttatctggagcacatatagcctgttaattctctagattattagcctgtactctaatatcttaatattaggatgtttattatctatatttctattattttgaggagataagaactatacagtcagtggacaacttctgtagcaggaagtattattgacagtaaaataaaattgcagattatttccctctttgtaggaaataagcctatccaactataataatacaaaaatggagcaatttccacttagcctggttagaaaccctgcttctggtagtggagtgcaaaggagtctgattgttgtgtgcccacctgggcaacagggagcccttatatccacatgggtccaaagttctgaatgagcagactgagttgcaggatagctgttagctctgggatcatcacagtattgatttgtttacatgcagttaaattactgaccacatatttgcaggagacttattgtgtaccaggattgtgttaggtaatttcagatacagtttatgtagtcccgggacaatgccacgagggtaagtacaaattctttactttgtaacaagtcagctgagaggccaggatgttaaatgcggctgctagttaaggtcttgagattacttggaacagcctctgcagtgacctcaaaagatggatacatgtacctagggctctggaagagcaggaactatgtttctcccaggtgctcagccaataatgtgactgcaactctgacttgggcttttttttcttctcataaattggcttattttccctttttactatgcttgtctttttcctgaaagctcctgaatactcagggtttctgagtgcttttttttttttttttgagatagtctaactctgttgcccaggctggagtgcagtggcacgatctcagttcactgcaacctccgcctcccataagcgattcttctgcctcagcctcctgaggaggtgggattacaggcacacgccaccacgcccggctaatttttgtatttttaatagagacagggttttgttatgttggtcaggctggtctcgaactgctaagctcaggttatctgctcgcctcggcttcccaaaatgctgggattacaggcatgagccaccatgcccagcctctgagttctcataacttacacttgagcacttgagactgtgttaacagccctgtccttccctcaagtcactctttcagcttccatcctattttttttttgagatggagtcttgctctgtcgcccaggctggagtgcagtggcacaatctcagctcactgccagctccgcctcctgggttcacgcagttctcctgcctcagcctcctgagtagctgggactacaggcggctgccaccttgcccggctgattttttttttgtatttttagtagagacggggtttcaccgtgttagccaggatggtctctatctcctgacctcgttttccgcccgcctcggcctcccaaaatgccgggattataggtgagagccaccgtgcctggccttccatcctatttttgaaaggatgtaggccagaatgccaaagtgagttacacagtttagttgcccagtttagttccttgagaaagagaattatattggctcagctactttgcccccgcttaataggtcactagaacatgtattgtcatttagctaggtgcttaactaactctgctccagtcagctttggcctccatgatgtactatggcacaaaatgtggtcccttggggctgctgcttttgcagaggctgtgagtagaatggtttttcttgtagaggtccatggaagtgttaaacgacatgactgactgacttttgtctagtgtaaatttatacatcatggagtggacattgtaaccatggtctttatcagcagcttaacatgataagaaatatgttttaccttataaaccagtatgtgtgtctgaatgtgtatgtttgcacatatgtatgtgtgtatatatctcaaagaaattttacaaggcaggagttactttatacttctgcttgcagtgtactatagtatttttaatttttttctgttctgttacatttaaatagataacgatcacttcatgataagactttattttgcattcaatgccagtttataacttataatttgaacagtggtaatatctgactccaaaattcatttgttttccactgcactgtagtgaatgaggcaaacaaaacaaggctaaaacccagcctaccctccaggagcttagaacctagagcagaagacaatagaaatgaaatgtctgaatgatattttgaaaggatgtaggacagaatgccaaagtgaatgacacagttgaaatcacagaaagcagtgaagtgaagatgaggaaagttttgtctataggatgtaacttaaactagatgggctatttgggcagaagaggagaaaataaaagtaatgaaggtgtaaattgcttgaataaaactttttctttttttttttttcttttaaggtagagataggaagacaggatttcaccatgttggccaggctggtctcgaactcctggcctcaagtgatccacttgccttggcctcccaaagtgctgggattacaggcgtgagtcactgcgcccagccaataaagcttgataggtaggcaaagggaagaagaaagataggacttctgtgtctgtttctcagatctccgtacaataaggtaattcctgtccaaagaaaccactgcctgctttgtacatctaatggaaagcatcagtttactctattacccatttttcagaaacagattttgctcaggttagatttttattgcaaaatctcagaaattcagagtcgctgttgttctaagtagcttattgttttggagtttctcattcctatccactggtcattttacaaaaatagcaagcaaaaataaaatagcaactaatatattggcatcacctttagaaataggtgttcttttcttccgcaagagaggaacatcagacctgttgtaccttccttaaccccttgactcataccttcactatgtgtaaatggcatcattctcagttacgcagactcctttatcctcctttatctctcatgcttgcagattggcctgtcatcactcattttcagcactgcctcataagctattgctcagtttggacttgattaaaatctttctttcttattgcctccctttaccttagcttctcatttcttttatctacaggtggtcatctctcatttctctagtttctctttggggcagcaacaaagaaatagaggtattattggcacctttaaacagttctacttgtctgccctactcgttttgtttcttttttgggagaggatgttgaagtagtattttagtttttgttattcgaagtgttgctttaattgcaaagccaagacatgtttattacagaaaaatcagaaagtaccaatagataaaaaaattgaactatctctttctattcaatcactattaacatttttgtctataacttttcagatttaaaaatatatagaaggattgtcttttacgcaaaaatcaataatgtagtaatagttttgtcacttttttcccttaacagtgtcgtaaatatcttttcatgttattaagcctgctgttttgtcacctttttttaacagtgttatgaatgaccttctatgtcattaaatattcttctacaacctttttaaagcccacatactagctcctcaaataagtggatgtttagctcttttaaccaatttcttgttgttaatcatgtgtgtgtttctaatttttcaatttaaaattcaaaatttaaggctgattaagttttttaaaataattatttttgaactactgaagtaaaagaaatacattctccttattaaaatattaaatgtaacagttaagactgaaagctgcttaactttaccaccattcccaacccctcagctgttaaccactgctataagtctggtctgtcccccagtattttattaaatagtgcacgtttaaaaattgttagtcttcggttaaattatagaattgccctttaccctgaatttattccctttcatccttgttacttctgtgtcattagcttttcatgtatttgttaacctcattttctcttcttaatttagctgatagatacatgagaactgcatctcttgctcatttgggggatagagaatacataaattttagtccaggctcagtagcccacagcgggaaatgcaggttagagagagccacaaggaaaagaggaatttgtttggtggtagaaatgtcaggattgatcaacaagttaaatgaccagggagccctgctgacagcttagctttcactgcagcagaagccaggaagccaatgagagatgttgtttctggggcattcagggggagcaacttaatttaggggaagagtagcttgcacagctcttaaaaactctgaagttttagaaggcagtgtgctacagtgattaagagctcaggctttgggggtggacaggccggcccaagtttgaatctcagctttccaattattagggtgaatgacttaacttttctgtgtctccgttctttatttgtaaactagggatagtaatgccttcctcacagaattgttacagggtttagatgcatggaaggaacagtacctggttcatggtaaacatttgatataatggtagtttgagaaataaattgagaaccaaccagaactctgaatcaggaattgacaagacatgggtagcaagctggtgagtgctggctgcaaatgaagtaatgcacgtttatttcctaaatgtacaaagcacagcagttcattcttgtgcatttaattacttatctgtagtttgtattctcagcctcatgtctgtattgaaatgatttggattcattcaggaatcctggctctgtctgtagatggtgatgcagggcatagaggagcaagtgtcctggtctgctttatctgagttttccattattttagcaaactcgatgttgcctgcttgaggctgagtacttgctatttcttgagattcaaacacttttttgaggattatagaattaagcttaacaataggacatcagagagatcagctttttgaacaaattaatttggatgtcactggcatattacctgatgcatttttaaattaagcatatgattttatgatatgtgctattatccttctactttttctttccttaaaaaaagcgttctctctctctgtttacccaccactccccagaaggatgacccatcttgacctcatgtctagtgtttggttatgcagatctctggccctttgaaatttgtgttctgtggcagctcctagctaggaaaagtgatgtcttagaacctttccttgtggatgtagtggggttaaagagagcctattgggtctggttacagaggacactctttctggactctggcagatttttcattttaaggatttcaagcatactctcaaactgctgctgttcccatgttatttacagtgaaagaactctagctcacttgtaattcagggatgactcaggttacattaagtctgtagaaaggacctgagagtgattgtgtcctgtggtataattttactttgaaatcccttcccatttgagctcttgagaaaagaagcctgtaagtagagaatcaccaatagacatgaaaagcaagcttactttcagcaaatgggtaaactccattgagttttagctcagatgggtgttcagtataaattagtgcttgatggagacagagtgatcttggattgtaaatctaatgtaatttttaactggctacatttttgagtctttttggtttgtgaggcttttgggttcttcccatctgttttccctagtggtgggcaaaaatagaaggaatgcacattcatctagaaacactatcgagtcatggagggtctgagaacaaagagggcatcagaacataaatatccctgtttacttcacagaaaatgattatctgatcagccaagagactggtgctaatcttggttctctccacagatgtaggactggctgtatccatagataagttctgtgtaaatggcaatttgagggatctatttggggcttagagaacttggctcataacctattccagttagtagagtcaaagaccaagaaatattacacaaagtttatagttcttttacacagttctctgcaaggtggagatgcttagtgtaactgtgatgagtgtaataatggactcacggtctaaagcttgtctgttcctttttagagtatttatctgagaagctcagacctgcaaagtactttagtttgggctgccataacaaaataccataaattggatagcttataaacaacagaaatttatttctcacagtattggaggcgggaaagtccaaaatcaaggcagatttggtgtttggcaaggggctgctttctggcacatagtgccttcttgctacatcttcacgtggtagaagggttaggggtttctctggggcctattttaaagggcgttaatcccattcatggagcaaagcttaatcacttcttgaaaggctccacctcctaataccatcaccttgggggttaggatttcaatatatgaatttgggaggacacaaaccttcagaccatagcacaaggtatcaaaaaggaaaccggcatgattttaggtggagtgtctaattaccttttggatctatactttgggagtttacccttttacaaatttcataaactatgttttgggtctaactagacagcatcatatccatagaagaaatatcttgtagtgttctttattaggtttagccaattactaatttctatctcatttcgacatgcaaaatatatcagttataaagatcacaggtcaagaatttcagcaccaattatacagtaaatttgtaattatgaatttaaaactattataacattagcaagttctatgcattcactatcttaataaggcacagatgtatgcttatatttttaacatgtcaaaactgtagtattgttcattttcttgttttatttgaatttttatccacttaaaatgctgaagatatagacatatgttcatatattctgtttaaaattcagaatctacagatttgaacagtttgtgaattggctggattatacaaaatcaagaacctcacattaaatccagttcttactgctttgttaaaaactacttttgcaattttacttgttgatgacatatttaaataagaaatttaaaccagtgaggaataagaaagttcaaatgaggttgctttggctgtctgtgtgtttaaaggagtgttgctttggctgtctacatgttcccatttgtacccagctgaagctggtatgaaatgtatattttaaaaatgaggccggacatggtggctcacgtctgtaatcccagcactttgggaggctaaggtgagcggatcgcctgaggtcaggagttccagaccagcctgaccaacatggtgaaaccccctctccactaaaaatacaaatattagccaggcactgtggtgcacgcctataatctcagctcctcatcctcaggaggctgaggcaggagaatcgcttgaacccagaaggtggaggctgcagtgagctgagatagcaccactgcactccagtctgagcgacagagtgagactctatctcaataaataaataaatacgaaaaaggagcctgtacaattttaatttctttcactttatgtatcaagtaagactcataggttttagaaactggtatattatattttctttcccacgaatggagacaatagaaacacttgaagaaatgggataaatttgacagtactttggattctcatagcaaaaattggtaaacttcaaaaagcttgtctattttaagactataggtataaacatatgtttttcatgctacaaagcctggaacatcaagtgatttttacttaggtttacagataaggtccctgtgtctgaatttgagaattttcagaggtctttcctattaaaaactttgtacacattctttttccccttcttttcttccttttcctttcttcctccctcccttcctctctgcctttcttccttatttccacttgatgttattcacctacattctcattctcccctgattgtctcttctttgctctctctcagtcttcttggggtccccttttcagatcattctctcccctcttgggtttcatctctccaccttgatcagtctctgaaatcttcttgcctgttcatgaccttctacctccagacacctgctataaggtgctacttaatttggagttgactgtggaaggatgcctcaggtggacaaaatgactcctctgggccttggaggaagaacctctagagcctgttctgttacaggccgtggaaggacagagacagaagcacaggcccaggagcagcggcctggcagccagccatgaggagccgctttgtcataccttagaagaaactttcaggctccccaaatgtgtgacacttcagttttctcaatcagaatacaagaaggcttcccggaatctctttttctagcactataattttgttagttccttactgatggcttgttaaaggaatattttactatatgtcatgttagtattagtgaaagattataattctgtatattaatactttacctttgtcaaaactaccttctctttcccctcaaaaaagcaagtactttagttgtgggtttgccctctcttttgataggacaaagtactcttaattcctcagtaaagtagctgtcatctgtgtaggtcgctaagcccaggtttttcattctcttctccttaagattttttgggtctgaaccccatttgggtggagatgccactggcatggaaattcttgctggtgacctcacctgcagagattgtgggcatggcacctgtatatccatctgccggactttgggtcatgcaggaaatcctgtgaaattcctgctcagggttaaccaaagggagcagctctgaagggttacattcttctggccagtctcctcccttattaaaatgtgtaaagaatcctttttagccatgaattcttgctgacaggctgacccagggtcaggatggtgggtaaagctaagaacattccaagatacatgtggaccaaaaaaacacatgaaaactggtacagacttggtattagaaggggtcttagtgatgctagcccaacccttagaaatgggatgcctttcatataaagtagggggtccctaaccaataatattgactaaaagcatgagccctggagttggactggcgtcgatgcagatcctggccttgttacctattagctatgtgctcttggatcctaagcctcaattgttacccccatctgtgaaatggggaaaagaacagtatcagctttctagagtttgtatgaggattcaatgggaaaaagagtataaaatgcttagtatattgtctggcacactataaatatttattaaataactgttgattaattaataaattaatattgatgaattcaacattttgtatagtttctcctaattcatttttgaagggcatagagttatgccttgaataatgcccttgaaacttttaaagtattaataaatgagtcaactctactttgctttttctcctaggtgaaaagaaagggattatctcagacagtaagccaggaggaaagaaagagacaagaggtatgtttctaccgagcagctgctttagagctctggagtgtgcatgtcggtgtctgcttttttgtgttttcacttactgtgtgcacttgtttagtgttgccctttgaaaatgtatttgtttaacaaaagcagtaagtgatcattttaatgtaaagctacgcataagcccccagaaaagaaaaaattttaaatatctcaacatcactcaacatcgtttgattttaaacaacaaagcacctagttcaggtatttaaactgagagaaatatgataaaaaatgaaaccaacattagatcttagaactgaaaaaggatgtttatggaaaaactgatagtcacgttagtctgtagacaaatgtagcctatttatgtaagataccctaggttagggaaagctggatgtagcatacaagggtctctgaaccctttttgcaagttttctataaatttaaaattataccaaaataaaaagtttatttagtaaaaaaaaaaaaaacaggttaataatgcagttttacaacttgaagtttaaatcaatgcaatttgagaaaattgcttattgtaataatattgtgaagctctcaaagcattttcctcttgcttcctgcatattattgtgtgtgtgtgtgtgtgtgtgtatgtcaatgcatatacatacatataaattgattccacaaaggacccaaggatgtccttttttttttttttggttggcatagaataaagtgaaatacaagggtgcagtatagtgccattttttcaagtttaaaaaaaataatagtatagaactttggtgtacccatccactgagaattaacaaatgtataacaatcgtaatttttctccttttttaaaaagaacataaaactgatagtgtagaaggcctgcattctcttcctcagtcctgtcctattcctttcctccccagagacaactataattatgaactggtacatatacttccagcctgtgttttaaaattatgtataacatacacacacatatttgtgcatgtgtgttaaaatgtatatgtatgagattctatgcatattttttggttttctgttttttacactcaacattatttttgagattattcatgttaatgcatatgaatctagatcattcatttcaatcatcatatagtactctagtctatgaacaccacctttaaatattttttatctatttttccaatgctggacagtaggtgggactttttccttcattgttaacattgtgacataaaaatgtttccctctccttgtggataaatttaaaagctcctccaagatattaatcccatttgaacatttttgttcttttaaaccttatataaccttgcctatttctatcatattctgaaaatatttattcagactttctattcctatatagcaattcctacctgctatatataacaggtctaacctaatttgcttttaaatagttgatggtattattgcaggatattttagcaattattttattaaacttattataataaactgccaattatttaccttttcctgtgatctattataaatagttcattaagtctttttgcccagtttgagtatttagattagattacacactctctccttgatgtaatcagaagtaaggagtgagcagagtgggggaaaagaaggaatgaagtgactttggacagctgtctgctgtgacaattcattacacactgaacatctgtctgtccacccaacttgaaacatacctcaaaatttctttcaaggaatcaagacaaaagccaaatgcatgagacattataaccctaaatggcttcctttggagataacaaagggcttatttgtttatgcccttcaggaacaaaagaaattatttaaaatgttgaattcagcaatattaatttttgttctcaaaaccctcaattatcacttaatcacattaatcagttagcatagtacagcattgaagaagtgaaaaatgtctttgctgttgcaaatattttaagtaattccaaggcatcgtatacatcaacacctgaaatccattatttatggtccagaagggaaatttttctttaattcgctttgtgtatagtttttgggggttattgtattgattgaaaaaattcaatacgcaggttaaatgagactcttaacattcttactctttactcttcagatagttacatcacttaatttcatgaaatacaactgaggctagattagcacatttaagtaagacccaagtccctaaaccttacggaagttaaaagtggaggtgagcactgagattagcacttctaacctgatttataaaatatggagcacccatcagcagctgggtgtccacctgcttgtgcctttcctgctcccacccagccacagtaccctctgctctttggggcaaggacttgaaggggtggagccctggagatcagggtgatgaagacagaattaccagggagctttccaggaaggctgtgaatcttaggcctgcattttccctatatccctttttagaggatctgaatttgattttgttaaggatctagatgaattccttacgcagggcattggaatcttatccacatatgtgggttggtatttcatcattaacagttatcaggaaaaccactgtgtgcctgccactgagagtctctgcagagagtcctttgctccttcttgagacattgatgagagtagagaatgtgacttgttgaatagatggaattactttcaattgtatgagtttatataaaagaattcctgtggttgataagaaccttttgagggtagacacagtcataccagaatatttgctgttattgactgaaaattagtcagattaagcatagggagaggaagagtgtgacacacaagagggaagggaaggaaggtgtgagaaattttctctgaatctcaagagatgaccataaatccttactgtccctaaagcagcatgctttgaaagcagggctggaggagatgaccccaaaggttaattaatgtctcactgagattttatgacatgccctcgcttccttccatagattctaccccttggcaaaggcatgacctcaggatgtgatgtcaagtcatccacatgatttcatttttttcatatttacagatagtgattattttttaagatttgggtaaatgtatattatataaagagagtagttttgtgatgttgtttctttaatgttctttttgtactttccaagatactatacctgaaaagtggagtatcttgttattcttacagcaaaattatgagagctatatttagttctttaattaaaagaattaataatacatttctttttccttcttaccaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagtaagtgcactgcagtctgcctttggtcgtgccaagaagttgcgtactaataaacactttgttatctctaaaggaaggcatttctggttatcaagtctcattcagttggcttttgtcttgattccttgaaatacattttgagatatgtttcaagtttggtgaatagacagatgctcagtgtgtaatgagttgtcacagcagacggctgtcctaagttatgttattcctctttccccactttgcttgctctttacttctgattacatcaaggaaagtgtcttcgtttggtgctagtctgtgatattcatccatttcagtaaagaaagagtaagccttaggcttaggtcttctgcaggcaatatctggctacgatttaataatatatattttcattatatttaaggatttttgctttactttttgtcatgaagagtagataaaatcatataataaacttttatacattcaaaacttatatttagcaattgttaaaattttccatatttacttatctattatttttgcttaatttttttccaagtatatacattggatgttttacttataaatgctccagtattcagctcttaagaataaggttattttcttacataactacactgttgtggttatacttatgatgatgcttttatgattttattccatttaagttttgtacgtgtaagtagtagagtcacatgttgcaaaattccaaaaatatgaaagatcctacagtaaaatgccattcatatactgttccctggccacctgaaacacaaccagagtcaacatttgtttcttgtgtatctttttagtaatactttatgattatgtaagaaaatacatgtatatatatatttttcttgtttttacttaaatgttaccatactataaacactgttctgctccttacttttttttacctctatcctggagattatagcatgtctgcacattaaaactttccttattcatttttatgttttttccttgcaattatttgttgaagaaatccggtcatttgttctgtagaatttcccatgaggcacataatttatgggtggtgatcaataccagatccattaattcattaaggattgtaaaacagtgttactctaatttatcgttctttattcatttattagctgaaatatttctataaagggaaaggtacatccatctattcatatattcagtggtaaagttcacgttattctatttattagtgctcaaattgttccatctttgatcttaacaatttttgattattttcttgctatatgacattttaagatgttaaaggatcatgttttacaattcctgctccaggcctggaatcaaccatttccccaaagagctctggtgtcttttgaaatgaggtggtatttaaaacctcagtgagtaccagcgtgctcattgctaagtggttttaggctgtttcagtagatacccagaaaaaaaatccaaatttttctctataaaactagatatattaaaagcccatagacactccaaatttatcaaagtatatatattaaataggtacttttttatgtatcaattatacctcaataaagcttaaaacataaagaagaaagtctagtttctattcttgtcccctctatcctattctcttcccatatagatactcttaaataagttgtttatctttgttttttaaaataagcatatgcatatgcttatgtatatgtattcccctcactttcttagataaatgaaagcatattctacttatttttctcagcctctttattcatgtaacaacatatattagaggttactccatagtagtttatggagatgttttactcctttctccagctacaataattatcatcgagtaactgtgtagtagtttattcatccagccgcctatctgtatgagcattaggattattttcagtctcactgttacagatagtttttctttgtgcttacaccctgctatatattagccattctatctttgagattttctagaattaggattgctagatcaaagggtaaatgcgtatactattttgtaagatactgccaaattcttcttcaaagaaattgtaccattttgcagtaccaccaagaatagatgaatgcttgcttccccagagtctttctagcagagtatgtcaacaaacctttagatttttgtcatctaacctttagattttgtctgataggtaaggaggattatctgagcatagttttagttagcatttctcttataagcttttccatatgaataagagccatctggaacatagtatgtgtcagtaaaatattactaaactaataatattcctctatgatgttggaacaatttaaaatttgagataagcactaacattacatcaacaaaagtcaaggaaggagaggttttctaatgctcgctgaaacacaagaatatttgctttgactagatcagcaatgttaacatgtaagattggcttagctagtgaaagagaattatctgcttaataagaaggagagggaaaacgtattagcatttttttttctgctcaaaaagttagaagctgttagaggcatcttatctgaaaaagttaatacaagtagaaatgatgaacataactgaatttatcaaataccaaaatattagaatccagggtattccttgaggcttgaaggacgtgtacgttcatttatttagttattattttagttatcttttatggaatacttataattcataccaagcattatgttgtagccttttcaatagagtatgtatgtatccttaaatagactgccctcagtgaacaaagtcttaggagaaataacaaaagtataatgtagttcatggttagtaggcatgtaaagatcatcactctaagaggccaggaaaactgaaggaaaattctaaaaggactgtaatagaaatatggttttagtttaataagctatgtatacctatataatgtacgattatttaaccaataaaatgctttaaaggaatatttaataatatggactttaatatattcagattttaaagcaggtctaaagagtgggatttcatattgttctagattttaattatttgaaaggtaatttatcaaaacataaaggataattatctttaatgatagaattatgagttattttaatttctgtctgtgtacttatctgtagtttcagcatctgcaataaacataatgtagttagaaaaggaaacacaaggaaatgagaaacaagcagtaagaaatatgagcccagaataaaacaggggaggtcactggatatggctgacaaattcataattggttaaccttgaaataagtcattttatttaaagtatagactaaaattttactttaatttcagtcatttacaaaattcatttaaggttttattaaaaattttatctctgtcatagcttatcgtaaggggctattttgaacatttttgtctattttttatttaaaaaagaaaacagatacttttcatcctccattaaaagaaaaacaaagaaatatctgtattctttacatttttattttgttttcacttcaaatgcaatgctttaatatggatatctgcctttgtaataatttgatctctgttatatttcaactaggaatgttcagcttttacatgataactctgtctatatcataataacttacattacaaaagtgtttttgatttagtttgaaacactcatttcagatacagcctttttgaaattcaaagtactcagaagatttatttgcaaaggctatttcatgatgtaaggcctgcttgttgaacttcaagagtgacacccaagtgttggtaactacttaatgtattactcatgaaagagtttgcagtcccaagaaaatgcgaaataaaatcttgagtaaaataaatgatcagtgtctgaattagatattacagagtaagcatggtattgttaagtatgtcataaccagggctatcttcattgttttacttttacctaatgaaaaattatagctataggtgatgacatattcaatataggttgcggtcagaacatcctggacatccaaattaacagtgtgttgtctagtcccctgtattgtggcttaggttgttgactgccaataaataacactaagatttatgtaagttgacactatttgaaaacagacaagcagggacaacgatcattctgactgtgtgtgtgtgtacgtatgtatcagtagtatgtctctgcaaaattcttttcttcttttaaaacatttctcatttcagttaacacttagggcctcctattctgcaaggctcctaagttccaaagcatttcagctggtggcatctccccaggggccgttggttcttgggacccatggtagttggcgaacacctccaatgtatttgcagaggcgttttagggcactttccttgaaatggaaaggcttgggtttggctggaggttatgggtttaaaggcccttggtgaaaatcaaaggagagcatgagagcagatgttcgtgaaggccattatgtgccctgctgaggcattttcaccatttcctaaagcctatgtggaaacatttatcaattaagtaggggactgattttgtggcattgtagagaacagtatggtgtttgtcttagcagagaggtgaaaatgttaaaagatttgaggcaattgaagtaacacagctagctagggtggaaactgacaggggcctccaagggatattgagagatatttagaatatggactcttgaggacttgctgaaaaggcggggtcctcctaggtttgcctcccaggtttctacctggttgactatcattggaaattgtattaaccaggatataagagaaacagattggggcttagggagggagacaaggaattcagtttggggcattttgcatttgagtgcctggaacatgagagtaaggtatttagttaaaaagagaaaagcaggttagaactacagaaaaatcttcagtagggatgtcaatttgagtcacagaggtggttcttgtcattttaagtttaaatgagataactacaacttgtagcagtggtttgtaagcagtggtggtggtatttaccccctaaggatacttggaaatgcatttttggttgccccagtagacttggggggctctattgacattagtaggtgggggccagggtgccaggcatcctacacttagtaggacagtcccagataagcctgaattgtcccacccaaatgccactgaagccctttttgagatgcatggagtaaaaagaagacgaatgtcagaattttgacaaagaaacatttaaggagcctgtgggttggaacagaaatgagttaaataggataagaggaattgcacagtgtgcatggatcttaagtcctttggctgtaaagggtttgcctctcttattaacaccttcctgttactctgtctcttagtgccatggcctaacaattgtttgttttctaaccctccttaaaaggagtatttggggagttagaatcctactgattgtttttaccctgcctaagaagggtgacacactttccttttgcatggaatgattagagctaaattctttaaatttaggtagtacctagatgactttgggtcagtgtcagggaaaaaggctttgacttccaactctacttccttcctgtttaactgtaccaacttcttccctctgactcaaattcatgagcttttcctggtttcatgatctccttgtcttttaaggacctcggctatcttaaaagcctgatcatctcatgaaaaatggagtatttgatatcatctttcaattagaaatgaataggcttaattcataactaaacatcacacatagtatatactttgcatattttcatatttcctttgatttttttttggttcttcccctacaaaatctacaaaaatctatggttacttaggataatttatagataatccctgtgttaatataaaaagacctataaatgtgattaacttacaatgatttgcaacagaatatgatctaacaccaattgtttttaaatttaagatacatccctattaaaagactgatactattaggaaagaaaattgtcttttgtagaagactgaatgttaacccttctcccatatttagaaactctaaggtctaaataaggtcttttgtgttaaaaagttttctgcaaaatgaaaattagatgagtctttgctttgatgtttcataaaaagatgggtttttactctcaattctgagttttcattctaaatacctaggttatgttaacagtctttcatttaatttttttcaataacagagtgtgctgttattagtaccctataaaaatatgctactgaagacctttgcaaggtacttgtttctctttttccaattacaaagttaaaacattggtattctttggaaagccatttaaaactaaaactatgcttgtcttcaatttctgcagagtaaagtaaaaatatccatcaatgtgcttttgtgtcctgaggaactgaatttgttcccaacatataatgagcagtgaatgccaaattctctggtttctgctttgtgtagcagagtaaattacaataatagtaaacatacaaaatagtacttaccccgcacttgcttctccagaagttttttccctaattttaatcaaactctattaaaattgaaatgtcatatgacattaaaaactaccttacatgcacttgctttaatattattttatgaaatgagttcatattaccaaaaaatgacaatttatgtaaataatagtatagcatatctgcattatgaaatacgtttctatttggtaattaaaattctaaactttaatgcataagcaaataacagtaaaccttcaaaagtcttttatagtatgaatattaaaattttaactttcctgactaattcttaaagctaaattttaaaggaaaaacacattaaatttaactaggccagagaatatggaacattttaagttgtagaacctgtttaatttttgccctgaagtaatggctgttgctatttttgttagcaaatgttattttcttactccatatatactcaagataaacttaccccagagtctttggtaaacaaagccattaccttattttcctgaatataacagagaaactttattctttctaaaatcaatttcttcaactgacagttgaaagacagtgacattcagaagccactctttatgtcactttttgactgtttctctatcctgagattaatgacaaagaagtttatttgaaattcacccgaagtattttcacaatacttcaaagtaagtctacgtgagtattctagtccatgttgttcagctcttatcaacaaccagtgtctggagtaatagtaaaagaaataggtagttgtttaggtattatttcaataaagaaagaaaaactagtgatgttttaatagatgcagtcctttggataagacctcaggaaagcagtgtgggatctgaagtctttgtacaattgaacaggaggccagttaaagatgactgattagagacatgcactgtattcattctcttctaaaaatcccagtaaaaatgatgggaaggtcaatacacaaggaaaaagaaaataagaatgagacaacagctacaatattttggaacctgaaaaacctgagatggttgtccagtaatgcaggaaagtttaaatctagactggtagtgaggaaaaccaaggatcaaccagattgaaatcccagaacctctgaaaggtggtgcattgattgattgattgattggttcttccttcacaaatctatggttacttggagtaatttatagataattgctgtgttaatagaaaaagacctataagtatgattaacttaattaatttggtctaggactaggttaaaggtaattcctaggtgcaggaattgatgatgaagttgggtaaaggtgtgactaaaactgcaagtttcatgcaaatctgtttgagaagtagtcagatcctagatcccctctttggctctacccagcaagatgatgaccctctttaccccagcagcagggcagcattggtgaatactggaccaggagacccaggaccacataagaaggggactgttgtacaggaaacgaaggtatagtggcagttggcacccacagccttctgcgctactctccttttggaatgctggtagccaggtttgtgtgtgtgtgtgtgtgtgtgtgtgtgtgtgtgtgtgtgtgtgtacactttgtcccttttctgtcaaatagtgattggcatagtataggttaagtaacattttatcatctttgttaatggatttatgttcaaatacattattattaacatcattattaggttttgcaggaaacaataagttgagtattacagcagaaatataaaaagcctcaagaaatatccattttagtaacatgttaggcaagtacttgttgactttaaatcttaagtttctttctcatttaataaggatgatagtatacttaaccttataagattgttttgaggattaaatgatatacataaaatgcttagcataacactagacaagttctttagtagcaattattttgttgatgttattactaaatgatttttatcatctatgtctggtattctgaaatgtctctggattttgtatttgttgacttttgtaaatatatgcctctgccagcattggtctaggactaaattaaagaataggtcttgttttatgcagcatctagtgcaatggtttgcatgagtttatttttaaaggtagttgtggcacaatattacattttagcaatcatctttattttgacattgagtgaatcaaagtaaatagattcttccataatcataaagaattaattgtgacctagattaggactaaaacctgagctattttttccaaccagcctggtgttttctttgtgagtggtagattccttgaatcagtgcttcagagcaggccctggcatgcttcagctgccaattagaccattctcctggtcactttttgcaggcatttggacccattatgttctttttgcattgcctttacaaattctaagtctgtggattctgagttgtcacatggagatttaaacttggataatgagcctggttgggacagactaaagtgttacctacttagtcattagctgttatcaatcttaaactagggtagaattttgtggaaaaagaaacaatgactggggtttggttgcagtgtttcatctgcattgcatttatagctgtggattttgaaccattacatggatttttgactctgccagttgtgagtaaaacaagcaggaccacacagtttttctggctgatggaaaagattttaatttaaactttgtattctagccaagttaaagctagcacttgatttaagtggaagggagatggttgatgaattaagtttcaaaagcagactttttaaagccttctaattgcttatcataggatgttgcctctaattgctgtgcattaattattagcatctgggcatcaattttgtgtttctccaaaaacttttcttatttcatctgatttaatccttaatagcatgctgtgaagtatgccaaatccttgagtaatgttgttttgctataatgttgatgaggggaaaaatggattcccagccagggccattgcatgtgtggagtttgcatgttctcccggtgtctgcgtgggttttctccaggtagtcaggtttccttccacctcccaaagatgtgcacattaggtgaattggcgtgtctgtggccccagtctgaatgaatgtgggtgtgtgagagtgcactgtgatggaagggtgtcctgtccagggttgacacttacctcgccccctgagctgccgagataggctctggccaggtgtgaccctgaactggaataagatgcttgggaaaggaatgaatgaatgaatgcaaatgattatgaaatataaatttgtattatatatgataatcatacaaatgcactataataaacgatgcttttagaaagcgctcattgagccgccgtatttgtgattgtttttgaaccgcatgatggtaggaggtgctccttccaattttcactttgcaaacatttataccttgatttaacccactgctgtcactcactgattcaccaaaaattgggtaaataattgtcttacttgtttttacttctctttcttaaatgtatatctagcttacatttatttcagtgtttaatattagaagtgttttgagtgtttatttagaagtttggtgattttctttttgaccagaaatatcctgtaggaacttaacttttgtttatatcaatgagcctttggtaaaattagtttagttatacatcatttcacttagagtcacagcccccaaaacctatcaacaacattgtgtggacttactgtactaccatttcccttttgtgggtaaggagactgaggcccaaattagttacgtggatttgtttaaagtcattcacctaactggaattgtacctagtgagttttttgattcttcataatgtattggcatagactgtttgttcaaaaatacatatatattgtaagtgcagttaagggttcagtctacagaactaaattttaatttaaattttaatctgccagggattacacatctggaaaattatttgaacttgctcctgttggtgtacatcacccatggagctagtcagacggagtgatgagatttttatctcatatttgaatgtctttgacctcttagaatatggagacttaaaagcaaagagcatcttgttttctgtggcacagctctgtggcacatcataaaggtcattgtcttattttctcatggacattgttcccgaagtgaagaatattgtccatatctttagcataagcagtctgtgaatgtgtcccaatggtttggcattgcagtattctctagaaataacctaattgattataaaagtatcccataatctgaagtgtgtggagtttgtatttattaacttttgcatgtatgctgtctatgtactttcctcagattaaaaaaatacccaaataacatacactaccctccttaaactactttacagtgatttgaggaagaaaagaaaatgtatgtttggaaagtgccaacttaattcaggttgtaattttctgctttttggtctaaaaaatctgttttcaaaataaacttttgtagaaaatgattttgcaagtctttttttaggacttaaagaatttcttatatcttaggtgctgatataaatactgagcaacctcacagcaaaatattttaattttttagagtatcaactttatgtaaaaaagctgtgaaaatatgatttttaaaaaaaattttgaaatcacctatatgctaagaagaaggtgaagactgttttagtattaattcagtatattattaccattctctaattgttttaaggatgtggattaaatcatgtaagccttgttttttaattttaaaaatatatttataaaaaatatcctgaggaacatatgatgaatggtatttgttaaagaacttaatagatactttatacagtgtttcctttggatttcaaaaaggtttcgggaaatgacttggactttgaaaaaaattttggtggaaaggttccatagaaatgtcaagattggctaagattgaccttgtcacttgtgggggattcaaacaaaggtccctttgtaacaagaaaaactgtctctgtattgggagttcattggaatttcttttctagcagagaagagtaatacgaatgaccagaacagggcacaataggaatgtttgtgttcatctgctgaagttgtcctgtgatgtagcttctacttcttattctcttgagtcttgtatatatttgatacacactacttagttataaatatttaggtgtacatttgtgaatgtttttagatagctctgaaaaaatctgctgtgaataagatgctttccaagaaatcctcagcaagcgttcttacaagttgagattttacttgaaggcattcagttgaaaagaaagctggagtgattaagttatgaaattattctcttggatttatctaagtggcattaaggatttttaggaagactggtttaaaaaatgtatgtcacaggtatagatttaattattttatctttgatttttggaggatctcatatggtcgtttgagaatctgtgtttttcaggttttaaaaatattaaatatgggaggagtttggtttacctcacttatgcttatgccattcctaggggtcactgtatgcctcctgttttgaaccttgacttattttttaatcctttttcttttttcagtcttcctggccaatacccagtttactttcacaaagctgcttttgtgattgtaatataattttatttgtccagaatattattttaccactgttttaataaatttagagatcaggatatcattttattaatatttcagagagagagacactaagtgattttctgttacttatggagtaccttttccaacttagaatggggaaaacagtataattatttagaactaagatacgttttctctgcatgctgttgaataaagcatatttttccggactctttgaagaccccaatatttggaaactcaggtgttcaaactggagaaacttgcctgcctttatctattttattccagactttcctggcatgaactaattaccaactttgaatactagtttttattgatcacatttctttttcctgagacctgcataaggaatgttaatctcatccttagacagatcactttgtccctctgcatgtcagctgctaaatgaactttccatcagcatggaactaatgtttatcggaataactaaataatctaaaaccagggccctaaggtttcacttgctgtgagtctgttatcaccagctcacactggagaattctttttcgtaccattgctttttctaaacaataatttctatccatggtatgtggatttggaagttagtcttttagagacttagctttgcagacattaccttaggctcagaagtctgacttaaatcagggtctggatgtagtgaaagcctcctggggatggtttgaaaaaatctagctgtacatgttgctacagtatttatttatatctatttttattttttatttttgagacagagtctcgctctattgcccaggctggagtacagtggcgtgatcttggctcactgcagcctctgccttccatgttcaagcgattctcctgcctcagtaggagaatctactactcctactgggactacaggcacatgccaccatgcctggctaattttttgtatttttagtagagacggggtttcaccatgttagccagaatggtctcgatctcctgacctcatgatccgcccgccttggcctcccaaaatgctgggattacaggcatgagccactgtgcccagccagtatttatttttaatgtgggaaagagttgctagaggtagcaaacatatgaataacctgaggataggaaggtaacgtatgaaaatggttttctgagagggaacgttcatgctctgaaaaacagatggagcagaaagctttataaagaagctgccttttcctttcctctggaattgttgaacaacatctttgagggaaacatgacataatattttgataattttagtgagtgtatgtatttgagcaaggctggtattgagttgtaggctgtttggcatggtaaaagtttgaattctccagagctgcttttaatccatttgcaatgcctgtgttttttcttgtgagcagtgtgtatcctcatcaggggctgcctcaatgcttatccatctggaggaggctactcagctttaattaaagaaacagtggttgagagggtccgcctacaaccactgaaagtaataaatgtacatggtgtaaaattcaaatactgccaaaaagtatgcactgagaaacaagtccccctgtatgactggtttggggcgtagcttccagagatactctctgcacatacaagtacagtttttttaatacgatgattgcctaccatacacactgtatgcaccagtacctatttacttttagtccatcaaacagccagagtcttaagaataacaccgagtataattttttaaaatctttgtatgctccccaaataagcccaagttttctttatgtagtttcttctacttaggaactttaaatgaataggtccacatgagttatggactttattgtgaaaatagtcattgctctgaatatgggattcttattgagcattacatctgattccttgataaaatattttaggatgagagcacctactgtgtaccaggcactgtgctaggcattggaaatgtaacagtaagcttgacaagcgaggtccttgtccttgagacctggtgggataaacacacacagaacagatgcctgagaaacagagtattccttaaagtaggaccttggcctggatgggggaactgaggaagtgacctttccttaccgctcaatcttctttcctttcctcctttgtcaaattaatctcattagattaatagtctttatcagatgttttaattcaaatataattcagtctagtctctagatatagaaatgccatactagtcacatgttaattgttttatatttgcaagtaacttcattaaatgggcacctgggatgtatggaacagcttaataaaccaacatttctgcactgtagttaaattgatcctttagctacaatatgaaaatttttatttaaagaaaaacagagcctggattatgtcacagtgcaaaatacgaaacatatttctagtttgaatgcataattcttggatttccctgcctctgaatgatttctaaatctggaagatttggatcctgtcaatttatttagcttacggaaaagtcatctgatctatacttcaggttcattagaaactccttttacatcatgtccttaggtaacagttttatgaaaatttctgtaactcatgattgcagttttgttcttacaatctccaggtattttatttaaaaataagaaataaaattgtacaacctatcaactgtgtgatcattagcttgattaagatatagctcacctgctgttaatttatttatcttagtaagccatgtggtgtgcatgagcttattttactctttcactttgttctgtgattaataaactacttccatggaattttgggattgagtttagaggccatatatcccattctgtaatttacagatagtatcccagatctcacagctaattagaattagagctaaggctagaactcaggacttctgacccattttataggaaagggtggttcactgtgtttttagtatgttatatatttacgtggcttaaaagtccaaagaggctgtacacgttggctcacgtctataatcccagcactttggaaggtgggggtgggtggattgcttgagctttggagtttgagaccagcctgggcaacatggcgaaaccctgtctctacaaagtatacaaaaattagccaggcgtggtggcacatgcctgtagtcccacctacttgggaggctgaggtgggaggatcacttgagcccaggaggcagaagttgcagtgaaccgagatcactccactgcactccatcctaggtgacagagactctctgtgtcttaaaaaacaaaaacaaaaacagaaaaacccaaaaatggccaaagattatcaaatagcatctgtttatatactgagaagcccagacgcgttgactctgttacccttcaccttctgttgatgtattatattagttgtcttgtttatcctcctagcatttccttatgtagatacaggcaaataaaaatggtttcttattgtcccacttttctttaaaaacagcgtgctgactgtatatgcgattctgccacttttttttttctctcaagaaagtttaaatttaagctcctgaaaaaagtcagtgtgcctacagataccactttattttgtccacttagatcagaactaggttgctatctttagcttaattctagcatatgagaaatgtgagatagttctatgaagactgtagtgaaaaaaaaaagattagaaatgtaaagtacaaggtgggaaattattgaaattgctattatttaacccaaagaagaaaaagtttgggcattattactttatagatgaggaaaggggaggctcagatggaggtaaagtaccttacccacagtcacccaagcactcggagtctcaatgggggcctgcactcagattagcctgccagtattgaagtctcaattcctcatctgctacaggagcctgatacatttgtgagtgacaagtatagtcgatactcattatttgcggattccatatttgcaaatttacctatttgctaaaatttatttttaacccaaaatcaatacttgtggttttatggtcattcacagtcatgcaagcagagcagcaaaaaaaaaaatgtgtttcctgacacgcgtgtttccagctgaggttgaacaaggcagtctctgccttttcttatactataaacaagtgtccttctgatggtcgattaagtgccacagttttttgtatttttgtgctttttgttgatcattttgctgtttaaagtgatcccaaagcatcgtgcaaaactgtttagtgtttacaagaaggctgtggtgtcttacagagaaaatgtgtgtttaaggtaagctcatagtgctattgtaagttagagttctagtgctgtactgctgttggcgtgagttcaatattaacaaatcaacaatatgtcatagttttgtgactgcagtgatagtgccattggcgtgagttcattgttagtgaatcaacactgtatacattaaataaggtgtttttaaactgaaacactcagaaaacaaagttatgtattgatcagttgatgaaattattgtgaccagaggcttgtaggaacccacactgtgtttccactagttcagtattccagtaattcaatgttcacagcaacttcatggaacataacttctgggaataatgagaacagatagtaaatgcaaagccagaagtagtcagcttcctgccagttctagctatgttttatttcttttcattctaccctaaggtacaggaggaataatttagtttagctataagaaaaaaaaaaacaactagctgggcgtggtggctcatgcctgtaatctcagcactttgcgaggccaaggtgggtgaattgcttgagcccaggagttcaagaccagcctgggcgacagagtgaaaccccatctctacaaaaaatacaaaaattaacctggtgtgatggtgcattcctgtagtcccagctactcaggagctgaggtgggaggactgcctgaaaccgggagaggtctaggctgcagtgagctatgattgtgccactgcactccagcctgtgacagagtgagagcctgtctcaaaagaaaaagaaaagaaaagaaaaaacaaacaaacccatgacttcctattgagataactcaggactatgaaatacaaggttaaattgcttattataaaacatcataacaattgagacattttgaaagttgctgacagtggtgttactgatagtatagcatggtgactaagagtgtcatcagtccacctggattccattcccttctgtaccatttgtcctgtgtgaccttgagcaaaatacctaacatctttgtgcttcagcagtcatgtgtgtaaaatggagatgataccactaactacttctttgggttattatggaagttaaacgaatcagtcagtcagtctatggaaagccattagactagctcctggtatacagttagtgctttttaaatgattagagtaattgcatctcctcatttgcccaggataattttagttgtgattagctgcccctttcattctcaaaagatatcccaatttggaggataaattgtatggtcaccctctaatgtaaggatgattcataattatcagctaatactgaattattggctatttctgtaaatacctgttgggacgattgatttctttttcttcttcaagaagtaagttgaaaaactccctcctcctggttttggagggctgcttggagaagagaaatgggagaggaacaggttgagtattcacatgtggcataattgtgtgttgtttccttattttgtgtttttgctcagtgaaagaaagtggtctagaatctggttctggcatagagagattatatctttcccactggacagctctttctctagtagccaggaaagacttgtgggaaatatagtttatattttagaacagttttaggttataggaaaattgagcagcaagtacagagttcttatataccccctgatgctgctcccaccccacacagcttctaccctactatcaacatcccacatcagaatggtacatttgttgtaattgatgaagctacattgacacatcactatcacctaaagtacataatttacattacggtttgctcttgatgttctacactctatgggatggataaatgtataatggcatgtgttcatcattattagtatcatacagaatagtttcactgctctaaatatcctctgtgttccacctgttcatccctccctctccttaagcccctgacaaccagtgatcttttttattatttctatagttttgccttttctaatgctgttgagttttgcagtagttatttgtcccttgtcccacatagtcttttgagatggctatgagacataagaggcactattgaacaggcaggcaagcaggtttggatttgggccatttgaaggctggagacatatttgggagtggttagcatgtagatggaatttcaagcaatggtgctgaaagagattattggagaaagactagagatagagaagttaaagctgagcaccaagccctgagaccttccaacactaagatattgagaagttgggggtgggggaggactggccaagaatgctgagaaggagatgccagtgggagtagaaggaaaccccggattatgtgtgctctagaaggcaagcaggatgtaattttttttcttcttcttccatatttataaaggaagaatcaacataccttaagaatggtttcaatctcttgtggcattcttttgaggatcagtattttgtgccatgtcaatgagatacagagttgtagacaggaaaggctctgcgcaagaagcaggtgcgaccggctcattcagggtgtcatcagtgtaaaaaggatacacttttggaactctggagtcatggcatggcccctgtgccttccagaagattattggagtaatcagcatcacttccaaagaagtgaaaagtgaaggggaggtagagcacttcagtaaatgcagtagatgctgttgaagtttcacagtagctgtggaatgtggatgagtcttctgctttcatttgttttcagaatgtggaaagcacaggttgtgtttaaagacaggccagcctaggcagagcctgccatggccaggcaccatggtgcacacctgtaatcccagcactttgggaggacaaggcaggtggattgcttgaggccagtagttcaagaccagcctggccaatatggcaaaccccatctttactaaaaataaaaaagttagctgggcgtggtggtgtgtgcctgtagtcccagctactctgtaggctgagacatgagaattgcttgaacccaggaggtagaggttgcagtgagccgagatcacatgagtgcactctagcctgggcaacagagcaagactctgtctcaaaagaacaaaaccaaaaacaaaagcaaaggaagagccagccatatagaacagatacattcattctaaggggaacatgttcatcctcaatatgtttcttcttataaaataaacatccaagggtttttttgggtcatttgtagtgatttgatttccaaaaataattagctttataaacataaattgcataagtaatgtccccattttataactctaagttgtcattatggaagggataggctgtgctgtaaaattgttgactttgaagtaaaatgcttattaaggatcatgagtaccaattttcacatatgtcgtagcctatgttgtagccaaagtcgacatttgagaaatggttaaggttttacagcaacgtttactttattatcagaatatagtatattcagtcaagtactattaataccatttcatatcgtaattatgccatttcaagggaatttattagaaaggtttacatggattcttctttgcattaccctccactcctgccacccccccaccccacctgcagccatccacgtaaaaattcattatgttactgccttggatttttgccaatatagaataaataattggatttagcttctgttacagttttgtctgtctcagattatgaatgtaagttggtaagattttctgccaattttaattcaccaagattgcattaaaattatgaagagacaattgaatgtaatttttctttcctttactcctgtaattgaactgtaaaagttctcaattaattacagttcttacagagtatcaattattgcaatttgcaaactccagagcctttataatgaaagataaacattttacaaccatacatttgtcaacgtttgatgctaattgcagcaattaattcgttctttaatgtttaatgttttataggttaatgaaagctggcattctcttccctctttatgttaatatgagaaacttttcaggagtagggtacagattgatacatgtataaaactatttttgcaatctattgcttgtcttagcaactaaatgaaaaccagaggttgcagaggtttgcttattcttttctctgcatatgtagagtggaggcctgcaggttcctgacaaacaagagcagaagtttaatgagtccctaaaaactcagtttgtttctaaataaaacataaatttggagagttgaaatgagtgatttcagaaacctttttggcttgggtgaaaattagcatcttctcaagtatttcttaaatgccttgtcatttgaagatgataatagtatctatgaccatttattcagcccagtgtgctgagtactgtggtaagttcttttagtactttatgttatttaatccagaattcagacaagatctgactccagagctctctctacagggagacaagttcaaatacctgccctggcagccaggccatatagcttagtaaagtaggatgggtgtgagatgggtctgagtagtgggatcaccataaactgggctgtgagtacagcgccagtcattccagccatggtggaatgtaagctcagtgttgccagatctactgatgtttcagaaaaagtgggaaatctagatgtgtgggtgcacttccttaatttttaaatgtttggagctaatttaggtttttaaaatacatgtgtagggcagtttcaacccaccagccatccatttgagagctccgaagcacactgtgttggcttgatcttttggtctgaattagcttgatacaatggctggggcttgtgcctatgcatcaggtggcactcttgaagttcctcagagagcctctctacaaattcagcaggggttggagggaagaagggaaaatatatcttaatgaattatattaataaatactaatatgtaatttgaggcattgaggaaatacaattatataactttcagtgataaagcatgctgatctttccttcattttccttcctgttacagttaattgggcaatcagttaaataatatgcctttgtcagattttttatattagagcacctaaaggatcaggtagatttcttttttatagtattaacacagaagtaaaaacaaagtagcctttctttaaaagaatgaggaaatgtatacatacatatacatactcatttttttttctgaattaaaaaatagttaagaaatttgagttggcttggcaaagaaaactgagaaaatgcttaaaattagaaaatatatagacatatactttttataaacattgcaaagaaaaatgatggagactatttttatgttcaatctctaactgtcctaggcatagtgtaagtgccctccgcatgcaagtcatgatttactgtgaatgggtctcctgtatatactgctttcagcctgtatgttttttaaaaaattgaatttaccattctgtgtcataagactagagggtaaagttcagattttgaaagtctaagaaaatgtgatggcatcccattcatcttgtattaaaggttctataaaccgtaatggttagatctttgacctctgttcctacacctgcagctagtcctaaatcaaagtgtttaagcctgacatgggctgtacctgtaactcagtgtggaagctgcatattgtaggctatttctactgttggagagggagggcgggcattgtggtaactctttttaccttttcatatgttcattaactttccaaggaaatgaaatgcttccctcttctttttctacggttaaatttcaagctagtgttaaaaaaaaaagtgcaaggaattaatgtaccaaaccctggagatgtgtaaaagaaaaacctttaaaattgtattttcaaaaatcttgagtccttttaacattcctatagataatttagtaaagataaatcatacttactttttcatgaagctaattgcctctggtttgtatcccctgagaaatactaatttacaaattagaacctacaaatgatttttgtttcaaagaccacttttgtttcagagaccactttccagggaacaattctcaataacggaaggagggtgttttagttcccccttcaaaggaaggtattggcactgtatgttttgttttgttttgttttgttttacaaagaagccagatggtatttattttgcatagctgtaataagttctaaggaaagcacttggaaatggtactaatgtttaatggaaagatgtataaacccacttgggaactgtaaagcattatgcaaggtatagtttagctatttaatataataacaggtaatcattctgtgctggctttgttattagcacaggtgccagggcattttggggctctgacattttatagaaaccagagtagctgctgacaactcaaacagtattgttaccgtggcagggcctggatcccacagtctagctatccagtggtgcctaccttctgttctgcaggtatatctttctccatcccttttaaaccggagactatcaccctgtgaaaggatcacagtgcagccttcccctgagtaaatgacaaataggcagtttctttagtatttttcacattcctgcacctggctgggagccagctctgcttttgtggcagaaagtgaggctggagagaatgtttgggagccaatctttggtagggaagtgacaaaatgcaagggtatatgtatatgggccaaagttaagataaacttttttttggtagttttcactgtaattattaagaggcaattaaaaaaaagaggtaacactagaaaatgacaaactcccagaaggtgtgattacttacaaatcagctgctctgggtcctggtgagtgacatagtcctggtgatcagtgtcagcatccttcacaagcaatgaaaggagagttcgcaatgacgctgcttcacaggatgtagatgggtccaggcatttaggctggctgagaggcataaagtggctgagatttggttgggaagaaccaagatgaggcgtgcctctgtgtgctttacgtagacggtgttgtatggttagaagccagtagttagaaattcggtttgaaaagccgggtctgatgtttcagagaaaaagggtaatgcggccagagacgtttttagaagcagattttggtagattctttttaccttttaaaaaaatacatatatatatctttttatgagatgaggttttcctacattgcccaggctagtctcgaactcctgggcttaaacaatcctcttgcctcagtctcctgaatagctaaaattataggcatacacctctgtgcctggcttggtagagtctctaaaaggggattgatgcaagaataaaagggagaagagtaaataccataaaaagcccattgcagaaggtgtgtgtttcaaagccagggtagagaaataagtaagggatgcatgtataaaacagaacaacattggtgaaatgtgactgtttatggtttacaaattactgattggcagcaggaaacatagatttaagaatatacatgctacagaaatttccctaaagaagtaacgtattttataattctaaatttactgttattaaagttagaggctgccagcagcttggttatggtcaaatgccaggtaagattttgggatatgaaacatttgacccttctgaactaagttcacatgcattggacctctccgaaagccttgtaagagggtataaaagcaaacttcccttagcttcctacaagtgaaaccattatttcctcttaccagggtaccttgcatggtgattaggcagaaggataagagttgtgatgtgttaaaggctgtgcaggactggctttagtgtggacataactgtctctaattccctggtgtgactggggtgggggacatgttggctgaattccctctcactgaccctacaaatacaaagatgcttaacattccacatctctcagccatttggatctatagagtggtttcggattgtgttccatcaggcctggaattccctgaaggcactttagggtctgccaatttgggtgtcagggaagcaaataactgggccctgggcctcctgaccctgctacaagcagaacagctctcttttattgtggaagtcttgggacttttcataagattcacttgaaaagggatgaaacacatacaaaatccactatctggggaagcaggaaaagagagcattctgtatgtgaacaaaactagctgatacaagccccggccctccatccatttctctagctgctgcacttattaaaagggctttattggccaggtacagtggctcacacctgtaacaatcccagcactttgggaggccgaggcaggcagatcacgagatgtggagttcgagaccagcctggccaacctggtgaacccctgtctctcctaagaatacaaaaattagcctggcatggtggtgggcgcctgtaatcccagctactcgggaggctgaggcaagagaatcgcttgaacccgggaggtggaggttgcagtgagctgagaccatgccactgcactccagcctggttgatagagtgagactccatcttaaaaaacaataaataaataaataaaaataaaagctttattgagatcacaattcatatgccatacaaataacccattaaaattgtataatttagtgatttttagtatagtcatagattgtgcaaccatcaccagagttttacgatttcatcacctcaaaaagaaatgccctacccattagcgctcactccgcatttccccccacacttccccagctctaggctgccaccagtctactttctgtttctatagatttgactgttctggagatttcatatgaatagaaaatataaaatgtggtctttgatgactgctttcttttacctagcataaagttttcaaggtttatccatattgtaatgtgtaagtaagtacctttcattgctgaataatatgttattgtgtgaatataccacattttatttatccattcattaattgatggatattgggttcttttttattttaaattatgctgctatgaacatttgtgttgaagtttttgtgctttcgatttttatttccctcgggtatatacttaggagtggaattgaagggtcatatggaaactatgtttaacattttgaagaactgccggcctcttcttaagtggatatgtgtagacttgcagctggcctctttaccacctttgcacctcagttcagctttttccagccctacaccctgcccttcaccctgctccctccagggttactttcctaaaataccagaaaccctagtggttctcttgttactttgaaacaaattgaaactctctaatagggcatttcgagttctacatggtctaggcccaggctatgtttataatttcatttaatagtaatttccaagttcttgcgtagatgtttcattatacaagcactagatgtttcattatacaagtcagtgattattgaacttccttttagttatggacccctttgaaaatcatccaatagccatacgtttcttgcttcctcaaaaaaaaatatgcatgtataattgtactgacaacaacaaacctggcatgcaagttcagagagtttgtgattgctctggcaccattagcaaaccatgaagttcaccaacacattggctgggcacaatctgagtgttctttgttcaaactactctctcacctctcttctcccttttctccttcctgctgattgcctaatgagaagctttcttgctttttagagtatctttcagagaatctgctggaaaggaaggtggtttggctcctttttccaccattgctgctccacagttgtgtgtgcagtcctgcagcagggccttgagggaattgaacagagagggctagcctctctgagaactagatggtgagtgccatgaagacagagacttttgttggaattgtcctgggctgtgtattttatgtgtctagaatagagcctggcacatagtaggcattcactaagtagtcactgaaagaatgggtagggaagggaattgaatctggaaccatcagctttctgggatggatgaagctatatatagtagggcccatgagttacaagggacccgtatgcagatactggatgttggttactgggaatggaacaagaggttagaagagagtttctaagacagattaagaggatgtattagttttctattgctgctataacaaattacaacaaacttagtggtttaaaacaacacaaatttattctttttcaattctgaaggtgggaagtctgaaatcaatttcactgggctaaagtcatggtgtcactaggctgtttccttctggaggctgtaggggagaatccgttttcttgcctttttcagcttctagaagtcacttttgtatcgtggcttatgaatttttctgtcttcaaagcctactgtgtaccatcttctctgatttctacttctcttctgactcttatcctcctgcctccctctcttataaggacctctgtgattactttaagcccacctggataatccaggatgattttcccatctcagtatcattaattacttctataaaatcacttttaccatgtaagataacatattcacaggacatggacatttttgagatgatggacattaataatggacatgtacatggccatcatttagcctgccacagggggctctaaaaataaacatggcgccctttgtgtttttgccaagtgtgtctgttccttgctcagggcttcttaattgtgacatgacttcttcctcacaatgattacgctaaggccaaggacagtgtttgcatgtaaagaaatgttccaccacttctcagttgctgagaactgttagttttccctggttcatttctctcccacatgtaactcactggggaggtaccaacacaaaggacttaaaaaggtctgtgctgcatcctcctctaattttgtcattggtaagtacctactaaaacagtagctatcagaatgggaatgagaactaccagagcatttttgtttagaactcttttttcccctcacatcccaaaccacttttaatttcttatcctcttattatcaatccagagataaaatttcagaagaaaaggctaaaatagaatatgagaagacatatagtctgctgaaaaggaagtctcttgagacctttaccagatcaggatgtaggtaggatattttctgattgagaagcaactgtcctatatttgtgtcgaatcaacacatttcctatcactgttagtctctggtgaaggattcatcgatgagcttcatcttcctcagcactgattttgatgtattgttaatggctgcctggagtgcaaactctgcatgtaggcagagtgccagacagttactgatgcctgccatgggttagtggcggtgcgcttgccatgcttttattctccctgatccagtatgtcaaaagaaactgacttcaaccttcagtgtcaatgtgaccaccaaaaaaattccaaataaagcagccccaaatcttacttaccggcagcagaatataaattcattttggtagagtacagaatgttctgtattaggaaagtatttccagcagcacatacttcgctgccacttatctggaatatttctttgtttagggaagatattttattatataacaacaacttagacatgtgaaatctgcctggtatgttacaagtctccagcctaagtgaatatgaccttctctggtaggatactgcagccatttagattgacagctcatttaagtgagggagacgtccaagaatgatttcagtttgctttaggcagatggatattaatgaagaaaaagtaccttgaaaggatgccattctgaggagggcaccggacagcggcattgattataaccagagctcctttttttctgtgtttccagagctagagtgctgagtgctgcgctgcttagtctctctgtcatccttctgaattggataggggaggggctggtctggcaggtttttcagaaaatgcagctggcattgaagaaactcagattggactgggtctctctttagtaatcctaattgaagaattgtaaagacttgtgctgggagtttgtgtcttcattggtggcccttcctgtacctagcacagttctgggaagccaacttgtggtcaattaaatatatgttgacttatcagtgataaaagcaaggtagagactgacccaatttgtgggcattactttcttagtaaaataataatagaacgaaattcttttacatgtttcacctttatcattttttatttaaaacaataaatttcatttgtttatgtattcactgatcaaatatttgactgtctcctatattccaggtactatggccaagtctgggtgggtgggtggttgggtgtgtgtgtgtgtatatatacacacacaatatatatatacacacacactatatatatatataaatatagtagtgaacacaacagacatggccccatcctctaaaccttgctaagagagacaaaagtaaacaaaaattataaaagaattaattgccatcatagtaggtacactgaagaaaatatatggggatttatgaagtcatagaacaagagaacttagcctatcccagcaggttcagggaaagcttcctggaatagatgaaatttaatctgatgcatgaaggatgagtgggattcatgagggaaaaaggggagcgagaataggagggccaaaatgaataacccccagagggcttcacagggcacctgtaaaccaatatttgatcacactgtgtcaaccaggaccagagcacattgctggctgtgattttcctgattatctttcttggaggctgaacctgatatggttgctgacccttctgttgtctgcacattttgtcatggcgtggatcttactgtgaacatctgcactacgttgatttgtgtaatttatttgctgagaccattcaacattaatcttggaaaatgatctttttctttgcagttccagctgctactcttcttgctggatgtcttagttgagggttggccagtagtaacaggtgggcaagatcagctcaccgctgagagctgaggcagcaggtgttttggttcaagcacagggtctggctctggtttcaaatgaagttgtgacttaagcactctttgccttggttttcttatctataaaatgggtataatgaccatctcataaagcaggcttgctgttggttttgttttttcctcaaaaatgtagtgccacatttaagatcatcacataataaagcaaccacaaaagacctaaaaaaaatccctgcagttttaaaaaacgttagaagaaaggttactagaccataagcaagctccacatcaggctcttttttcaaacatgggttttagctgaatcatcttgaacctcctgggaggtggaccttatatgtttggtaggaccattatctgcacagctgaggagctcaccttggcagactacaatcatttaaagcactcatttgaagtatgggtgtgattttgcttgtgatggtgagttaacagccaaacagggctaacttgtgtttctggttaggagggaatgtttctaggcagcttttcctggtccacagaaggtttctctttagtggtgagattggaaatgctttacagggaaaaaaaagataaaggttgtgtaacatgattggttataaaacatgaacatcttggtaatactacaaagaggaaataagtggaagtattatccccgaaaaaaattcatagaacttaaatacgtatttccattaaaaagttgtcctcctcgtaagccaaattatttcattcaagtttcatccagggaaccagaatacttttacttttgcttcagatttgatttgattcaccggcattcttggttcccgaaatcatacctcattttttagaaatactttcttgatctttttgtagctaactcacttagtaaagtatgcaaattttccaaaataactaatagatcatttaacatagaaagctttaaattatgtcttaattatgtcaatgtaaaaataaaaggtgggtggtttggtttatattgaagtaagtagcataaacagaaatttaattagtaccttatttttaatatcgtactttggcaaacctttcacagtgataaatgaaattttccttttcattgggaaaagccaagttactgttgtttttggttatatagttgcattccttcaggctggtaacagtgtaagctaaagacaaattgtaagagctacttgcctcaagatatttatatcctagaattataacggccttatggtttcttcttttttcaattttctttctttttttttttttgagacggagtctcgctctgtcgcccaggctagagtgcagtggcgcaatctcggctcactgcaagctccacctcctgggttcacgccattctcctgccgcagcctcccgagtagctgggactacaggcgtctgccaccacccccggctaattttttgtattttaagtagagatgaggtttcactgtgttagccaggatggtctcgatctcctgaccttgtgatccacctacctcggcctcccaaagtgctgggattacaggcgtgagccaccgtgcccggcctttcaattttctttaaacaattttctttacatttgcattacaaaacagttggagttaaatgacaaatatttcacatttctatgaaaaacagctagaaatcaaatagtcttaactatatagtacctagaattccagttcctctgaattttcacagatgtgtatttttagctgtccattagacatctccaaggcaaaattaaatggagctcttcctgctgcttctccctgttcctaaatctctgtcttcattaatggtttaagaacccactttattgaccgggtggaaaccttgaccagaaatctcagcatcttccttgacttcccatctaatgcgtttcttgagtctattaattttatctccagattgttaccctatgctgggtcctcttgatttcccactaccaggctttattgtcagcttgcccagattagccacctaaccggcctgcttgccatctgttcctccctactagtaatccatccttgctctgctccagttttctcggattgagtgatttattggcttccacacctccagtggtttcttattgtctacagattaattgtaaacttcccagcatgcagtataacctttgcaatcaagctcagccctgctctgcagtcttctttctgtgcccttgttcctcctggagtggagtctgtacctcagctccactgaacttcccagtttccccaaccagacccacgttgcttccactgcccattgtgctttgctcccctgctcccgtcatgtcatccttcgcactgataatccagcttacacgtgtccttacctgtgtttaccacaagagtggtcactctgccctctggagttttctttgtaggcctctttggttttttactcaccatacttctgacaccaaatgtgtgaattttttttttataccaaccgactctctaacccttgagacaccaattgtgtgtcctacagttccggtcctacaatttaagttcctacattaaccaccctgagtttgcatcacactccacaggtttaaggtttcagcccacaatactgccctcatttaagacggcagatgcaagtattgggtccccaggttacccacacttctcttctacttggctacaaagttgtggggggatttccacaatccacccctatttcaggccctgatgatttgctaaaatggctcacagaactcaggaaggtactctacaatttctgctttattatatagggtacgactcaagaacagccaaatacaaggattgttacagggcaaggctggagggggtgcaggtactgcagaccacctagtccctctcagggcctgctactctcccagcacctcaaggtgttcatcgaccctccctaaccccatcagttaagggttattgtggaggctccattacataggcactattgattaaatcattgttccttggcaattgaactcaaactcttctcttcttatgactggagataggcaggcatggctgaaagttccagctctgcaatcatgccttggtctttctggcatgctgagagccatgctgaagctatctaagggtccccagctaccagtcatctcactggcatacaaaagacactcctgtcactggagattccaggtatttcaaggagctgtgttccaaggaccagggatgaagaccaaatacttattattaccacacctgtgttatagatcctgtattgtaattggctgcatgcctcccatcaaccgctccactgtgagtgttgggagggaaaggatcatttcttactaaattttgtttaatgagctaacctctccttggcatataattcagcttcttctgttttggttcaagtattatgctaccgtttctctacacacacttagacacacacacacacacacacacacacacacccctatacacatactattgtacagtcagtgtggttaaaattccactgataggaatataccccagagacttgaaaacagacacaagaatagatattcgtatgcagatgttcatagcagcattattccaggtagccaaaaactggaaactactcaagtctccatcagcagatgaatggataaacaattgctatctatatgacatatataatgatatatatcatatgtgtattatagatatatacacttgtatgtgtatatctatttaggtgaccctaaattgctatctatttatacactaaatctggtaaccctggccgggtgcagtggctcacacctgtaatcccaacacttcgggaagccaaggtgggtagatcagttgaggtcaggagttagagaccagcctggccgatatggtgaaaccccgtctctactaaaaaacataaaaattagccaggcatggtggcacatgcctgtaatcccagctactcaggaggctgaggcaggagaatcacttgatcccgggaggcagaagttgcagtgaggtgagataatgccagtgcactccagcctgggtgacagagtgaggccctttctcagaagaaagaaagaaagagggaaagggagggagggatttaaatatcatgtatattatcagatttaaaataatgtgattgtttttattttgagaaaaaaacatatactgttagatttatttcagacttttttttttttttttttttttttttttgagacggagtctctgtcgccaggctggagtccagtggcgtgatctcggctcactgcaacctccgcctcctgggttcaagcgattctcttgcctcagcctcctgagtagatgggactacagctgcgtgccaccacacctgtctaatttttgtatttttaggagagacggcgtttcaccatgttggccaggatggtctcgatcccttcaactcataatccacccgcttcggcctcccagagtgctgggattacacatgtgagccaccacacctcctggcctcagacttattttttaagcatttatttaggtgttttgctcatgtatttttccatacaataaaatatataagcattcactccccttcccataaagaattcttgaaaaataatgaaatatgtttagtctaaagtacctgaaggcagagcagatcaatgtttgaagccaaacacttgaagcaataacttgatttttttttttttttttttggttttgtcttgtcttgaactcctggcctcaagtgatcttcctgcctcagcctcccaaagtgctgagattataggcgtgagccacaatgctcatcctcaaggaggtgttaatatgatagatttaaacttagataaaatttttatagattttaaaaatattttttagttggtactgtgtactgttgaattttcaaaccccgtgtaataacattacatgaggctaatctgttatctgttagagtgtatgaaagaagtgttaatttttttttccctttggtttttcaggttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttgtaagcaatgtcgaatgctacagttttaatcatctaacctagttttaattaggctacattgactgaaattaattgatcttttgaattatatttagaaatgcctcctgataggctatttcccagaggagaaatgtttaagagcattacttttagggtgagggtgtttaagtagaaaaatctagtgtgtagagaattttctctcttacgaaattatagcttgttattgatgtccttgtttagtgtttcgttgtttttaattgttgcaggaaacagaggtggtcctcactctaaacccgcagttttctaagctttttactggcaattaagtggttttcctgaggcttagaggggattcttgagttgattgagctaaaagctaagattcagagttttctctactattctgatctccctccattcaattgacaacgataataaattgttcataaaaattgctgattattccccccacttgggtagttagagttgaagagaggagggaagttctgaaggaaagcagtagaaaaaagtaatgttcttaaagatttcagttatgcagcaaaagagttaagcattagatttcctgccacatcttttctttttgtcctttttaggttactgagagttttgatgtgatgcatatgccatctgtgtccttaaaagagtcaccaattgttcagtaatgcctatatgtattttaaagagtcctgtttatcacaagtagctgttttacagcacagttgtgcactgctgtaaacccagtttgggagcttaatggctgttatcgttctcaccccctcctgtgagttgtggcatttatgaccacggcatggagcttcggtcaacttctgtgcaatatgtgagacccctatggaggagtaggggttgaggatgactaacttatggctgcttggagaaatagtcaaagcctctaagctgatgagaagggctgatgatggccccctttttcctccacatcttcatgacattttcatatagccagggtggaaaacacacagctgctaaccccaatgagatttttagtataaagcagggtttgttcgcacaattgacattttggactggataagtctttgtggtgggctgtcctatgcattttaagatgcttaagggcatccctggcttccatctgctagatgccaaaaatctccccagacattgcagaaggtcccctgagggtaaaaccacacccatcacttcctcactccaccacgccctggtgggaaccgctgctataggaacagaggttctctgtaactgttagagaatgcaagttcatgtctgaaaacaaagccttgaattagagataaatttgggtttcattttgttttgcaggatttaaaaaatgtcactaggtactgctatacatcatgtgactcttaaaggttttatctaaattagcttaatgataacatcatcagcactttcacgtggcaattagtagtgttttcaggggatttgttgcagttgatgtgatttttttttttttttttttttgagatggagtctcactctgtcacccaggctggagtgcagtggcgcaatcttgggtcactgcaacttctgcatcccaggttcaagcgattctcctgcctcagcctcccgtgtagctgggactacaagtgcatgccaccacacccagttaattttttgtatttttagtagagactgggtttcaccgtattagccaggatggtcttgatctcctgacctcgtgatccacctgtctctgcctcccaaagtgctgggattacacgcgtaagccactgcgcccagcccgcagtttatgtgaatttaaggttagaacagtggctttcaattctagctgcatgttagaaatgccttggggcctgaaaatgagcaaatgtacactgtccagagtccatcccagactatttaatcagaacctttggaaggtgagggaggggactgggacctgagttatttaaatatacaactaatttagaggtttttgttttttttttttaactttctaaaaatcttgtcaaagctatcagtaaaaggaaacttaaaacttctcaattagagaaaatggaaatgaattgtttctgtataatttcttttcatttgctattctggcattctccccctccctgcttttagtagcagccttgaacaagattatttaattttcaaaataacattttttttaaaaaaaatgactgctattgtcactatcctgcttccttctcccttcatgggagtacaatatccatctacctcctaccctccttgccttggaaagtggcagtggaactctacagagctcctcatgggatgaagtgaggtaagagagtgagaaatggggggacaagagtgtcagatttaacattagaaaacttgggtttgaggccaggcacagtggctcacgcctgtaatcccaccactttgggaggccgaggcaggtggattacttgaggccaggagttcgagactaccctggccaacatgaaaccttttctctactaaagatacaaaaattagctgggcgtcatggcacacacctgtaatcccagttacttgtgaggctgaggcatagaattgcttgaacctgggaggcagaggctgcagtgagccgagattgtgccattgcactccagcctaggtgatagagcaagactccatctcaaaacaaacaaacaaacaaacaaacctgggtttgacttctgtctttggcagttactaagtcatatttacttggtgaggtagggacctttctgcattccattttcttactggaatccctatctggccttccttaaaagttacgtaggtggttccacatgaaagaatgtatgtcacagtatctcgctaagtttcattaaaatgttatagcagcattaatacttttcttgcattaacaggagaaaaagaggaatatttcgactgatgtgatgaaaaggttttctgtctcagaaagaggatctttgtggcctaaagcctctgaagtccagtctaactgttaatttcttatgccattgtctagggctggagaagtggcttaaaacatattatttatgatcttattaatgatatatgtttatagatgatcggatataaaagacctagtctgtatactgatttatgacccatatattcaccattatgataccacagcttcttcatttgcttaccttccacttgtataaatttctagctcctacatgttttgccttattgttaatactgttatgtgaaatccacatcttattatattcagccttgaatataaaaggcagacaagccattcgtatttgccagtgtaattatgtgcttatgatattttcatacagtttaaaatagttgatgctatatggatttatcacagtattttgtaatacatttttacttgctgcttaatttgaggaggaaatattttgaagtttctcttttctttgttttccctcagagctaccaatccatcctttaaggaagtattgtcaaggattgagtcccatgaagactgtaggaacttacccatgatctcttttctcattctccccatgcagagggtgacccgccttcccctgctgatggatgtaagacatgacggtggctttttcctctgtggatagctgtgcttctctaaatctgatttagaaaattattattattccacttaaattgatgcatatttaaaggtctaaaaatcccccaattaagtgagaaggtgttgtttgttcagaaagtctcacctgtatctgatatctctggaaattatctttcatttaggcttctatggtcattctgaagaaattggatctcatcacccacttactcagcattttttgaaataggaagagttgtggcttctttatgtcaggaggcctggattccaattctagctaagccattaggcatgtgaccttgagcaactcagtctctttgggcctaagattcctcagactgatcactgagatcccttcatctataatgttccaaggtgccctgggccttccatttcatacaggaatgagagtctcttcagcatgacaaggcatagtactgcctgtattatgcattgtgcgaagtgagtgaggaaagcccagcttccttcttgtgttaggcagcattcatgaggaaagcaagtgtttttgactttgaatcacggcaagacatgactgggaaaagtgagtagagtctgcctagtagtacgtgcagctggaaagacaggtaggctatgggcaggagagcctgccactggctgcactggagctgctggggcagcaaaagagaaaagtggggtggctcgacacaggtgccattctagcagtggatcacagagtgtctttttgatctaattagaaaatattttgttatgattttcctactttaaaattggatcataatgttgatataaggtcaactttttacatacctgattttgactaatcaaaacaaagtaaaatatatattaaaaattatgattaaggttacaaagtaaatttcacattctgtatcccattgtaaattctaaaatacattctttaaaaatgctgaaattttgaaatgtgtaaaagcatggaatcatgagcatttagctgactgctgcagttttggagacgttttgtcaggtatttcaggattcatagcaccttgtgctcctcaagtttacttcgatctactgcctttacaccttctccacccatcacctgtaattcaggaacttcccccctgtgtacatattgggaagcttgcagttttgaacatttcactttctgatttttttttgagatcagtatttatcatgtttaaagatagaatgtggctaagttatcagaatcgaatttttgcttaagaaggaaactttggtccatataaggaagtattatttcaaacatgactatttttttaagcaagaagtgaatgccttgtaaatacaacatttcttgtaatattagacttttgaattttcagggttttcttcttctgaaaatgcattttattcctctttgagaattgaaataaaagaacaaaaataaataaaatgcattttaaacatgttttccagattttatatatgctgtgatggccaagccttttatatcctctttaaatttgagaaaattacttgtatggaatgggactctaaaatctaacacattatgttatacagtgttggagattcatgccatgattgctcagtaggctttaaactttttttaagccacagacccccccttgagattctgagtaaagctatagcttttcttcccagagaatatgtgtatgcacaaaattttacataaaatatcaatatatggaatccagctaaggatgcctgctctcagggacataaaccagtatttttcatgctgctttcatacccattagtgggccataaaactgatttttgaattatgagcatatgtacgttgctcataaagtggttaaatattgtttcataaaatcctggttcatttatgtgtgcatgtgtgctggttgcagtgtaaaagtatttcttacagtgagtcatagtcaaaaaatataagaacctccacagatggtgcactctgtgtttctcacatagcagatagttaaaaatcttgatgcctgactttcagatggcttggcttggtgcttctgtacatttaagggaccagtgacttgctagtagccaactactttctacctctgcctgatgcctgttgctctaatctgtttctcatgtgtggaaatctggccatttaggcagaatgtaaatgtatttaaaatagtgtctcttcaattttacctcatttggaaattcagttaagcttgttcattaaaataaacactttcagtaattaaagtggttccctgggctttgaatgtgtgtgtatagctttaaagttatatgtaattaaatttaccgtgaattgaccctgtttgacctgattttcctatcacaaatgaaatttctcagtataaatatatcaacagaaaacctagcaggctttttttcctttgctggtttttttgggtttttttttgactgttttttctttgagatgctgtcacccaggagtgcaatggtgcgatctcggctcgctgcaacctccacctcccaggctcaagtgaccctcccaccttagcctcctgagtagctgggaccacaggtgcacaccaccatgcctggctaattttcttttagtatttttgtagagatggggtttttccatattgccctggctcctggactcaagtattctgcctgccttggctttccaaagtgctgggattacagacatgagccactgtgcctggctgttctttttattcaaaatgtatcatctataaatataattgcctctaataataatgattataatggtgataattaaagtaactcttatttattgagggcataccctatgccaggcactaataaagaactttacataaattatcattaacacttctaacaaccttgtgatgtagctggcatcaccccagttttacagatgaggaaagagaggcttataaagatagagttagtgacttgctcaagatttgataactagtaagggcagacctgggatttgaaaccagggttacccacctctgaattctatctttcttaaccattccctggatggacttggatcctgtgtttaaagattatttcctggtttttaaattgggttttaatattatcctcatactcatccgtaatatcgtgtttggcattgtttgctatgagtaaaaggatatggctggacattggttttattttacttaataaaatagatcaataaattttgttcacttttatttcattacagactatctgtcaaaaaacacctaaggactctccgaagtatgaagtctgcaaaagagccttgaaggaagttagcaaggtaactgttgggtgacagtttgtttgtaagacaggaaaccattcagttagctcagacacaaagtgtgtcttggcttgatgctgaaaactggtagagtctcacagccatttgtacagcgttctttaggtagttgcaaaacaaaatcatatttgctatactcaggtgaagttggtatttttactgtttcagacagttttgttttaagagcctacagatacctcattttcttttggtggctgaatagctgtttattcatttctcgttcagtaaatgtttattgagtatcaaccactgtgccaagaatgatgccagttcttggaaatgcagtgatgagtgaggcacgtgtagtcactgtgctcgtggaatgtgcagtggaaagaggagggcagacattaaacagagttacaatgaagggtagtgggtgatgtgatagggaagtccacagtggtgtctaagctgagacctaacacaggagtggctgtgagcccaggattgggggaagagagtgtctcaggtatgtgtagaggtccaaaggcaagaaaatattggagattttgaagaactggaatgttctccatgtggctaggatgcaatctgagagacagcactagggaaccagctgtgtggggccttgttatacatgctaggctgttgggggcctgatcgtaagatgatgtagaggctaaattcatgtattatgaagatgatagtggtgatggggccagttctgaggccagtgatagttgattaggcaagggatggcagtggcccctattgacatgatggtaaggtggtgagaagtctacctgtatactggggaggcagacttggaaactgattgggtgagcacatttcaggacagaagtcaaggaatattgtctgtggcttgggcagcgaggtagatgctcttccttcatctacgatagaaacatagggagagtggataagttccatttgggttgtgttgtcattgagattcctatagaacgtccaagttggctaaataaacaaatcagaagctcagagaggagacctgaactggagacatggatttgggaatcatcagcatatggacaatagttgaagctgggtgagtggatgaggttacttagggagactggaatgagaagggcagtgagcctgaggaatgaccatgaggaatgctagcattcatagtcttattagggaaaatgagccagtggagaaaactaaaaagaacaaaacaaagtaaaacataccagggaagaggaaggaaaaccgtaatagcttggcaaatggcagttaatttggtggttaactctgttgaatgcttctgaaagataaagtgggataatgattgaagttatccttaggtttatcatcagtaggttgtatactggggttggggggcggggatagggaacctgagctgagtgtattgagaaatgagagggaggtgtgaatatgcagccagccggcagtggtagctaactgtctaaattcagggagtagaaagagaaagagctgtagctgaaagggaagtgagagagggtcttcgttagtgtatttgtttaaagattagaaaaatgtaggtagggttagctactgatagaaatatctagctgagaggaagcaatagaaggtgtaggtgtcactgaggatactgtatgaggttggcacagaggagcaaagataatggtagcatcagaagcttcctaaatgtctccagttacatagccctatatgaattgggtatggctttgtaccactttgctatgaagtactgtttcttttagtcaatttacatcgagtcaccattttacttaccctcttccttgccaataatatttacaaaatcatgggttttattagttgtttatttttctaacatttttgtagtaaaagtaagtgtatctgtgagccacttaaattcatctcttcatcccatcagtggtctgcacacctattttgggaacagtaagtaaagaaagcctgacaagtgagaagttacctaaggtactattgccagtggtgcttcctccaagacctcaagtcctgtgctgctttcctagaggaggaactggggagggaaacgggggaaggtttttaggagaaactactagagaagttctagtcttggacataaatgggattttgacaaattttgcctggttgttactaagaaattgaaaaaaaaaaagaatttgcacagagaaaaaaataggaaggtactagtagttggttgttgaattaaacctggaatgttacttaatttttttcaagaattttacatctcagttacagtagattactacattccttcaggcatctcttgttcacttgatttcatactgatactttcaggaaaggctggcaaaaatgtaatagaccagtgagttgctttaccttgatactataagtatacaaaaagctatcatgtgaagagatgtcattccagtgacttgctttctctgaagggcatcattcctttctctctattgagcatgaatcatgaatattagaaatattccttcagtctcccagcgttacagggaaactgaaatcgttgatatagtcagctcaataattaatcttcttttttatttgtaaaggttactgatgaggttttatagaatctgggaaaacaatatgaatattttcagcagaaagagtatgcatagagagcatttatggtttagaatgaaaatgtagaactacacttgtttgctttatcagagaaattgggagttcccaatattttattttagagagttaaatttggtatgttgaggcccaaggtttagaaccagatgctgccttaatgtcttgggtaagtctctctaggtagttactcattcttggaaaaaaagagtcataccattttggtagttaaaataatgcagtttatttgcaagatgcgaataatactttgctgaaattgctcatgcatgttgccttaaagactgtgacaatttctttaatttagggccttggaaagacttactgacctaatcaaacaactcaaaaacaagaacaacatttctataaaatgaaaatgtgcttacctcctgattttctgttaacatgctggggggagaaattctagggaatctgataatttccataggaatctggtaattcagctcatctagagtgatgtgtaccatgtaaggaatagtgatcaagagatggtcttatgccaaatgaatcttccctgttatttccttctgtttactctcccatggaaagagaatgtctgctttaactctgacctcatcaaaattccgtttagagttggagatagtgttacattatgagcctttctcccagaggcaaaatagtcaagctctatttaatcttttcgtataacgtattgcttcagccatttacaaagaagtacatgtgtatgacaaatggccaacaaacgtgaaaaaatgctcagcatcactaactataaaggcaaattaaaaccacaatgaggtaccaccttactcctgcaaaaatggccataattcaaaaataaaaaatagtagatgttggcatggatgtggtgaaaaggaaacacttttaccctgatggtgggaatgtaaactagtacaaccaatatggaaaacagtatggagattccttaaagaactaaaagtagagctaccattcaatccagcaatcccactactggatatctacccaaaagaaaagaagtcattatgtgaaaaagacacttgcacactcatgtttatagcagcacaatttgcagttgcaaaaatatggaactaatccaaatgtccatcaaccaatgaatgggtaaaggaaatgtggcatatatacaccatggaatactactcagttgtaaaaagaaacaaaataatggcatttgcagcaacttggatggagttggagaccgttattctaagtgaagtaattcaggaatggaaaaccaaatatcatgtgttctgacttataagtgggagctaagctatgaggatgcaaaggcataagaatgatattatggactatggggacttggggagaagggggaaaagggcttgggataaaagagtacacattgggcacagtgtacactgctcaggtgatgggtacaccaaaatctcctaaatcaccactaaagaacttctccatggaatcaaaaactacctgctccctgaaaagtattgaaataaatttttttatagataagtagatacaaaagtatttttattattttattaattttgtgggtacatagtaggtacatatatttatgaggtacatgagatgttttgatataggcatgcagtgtgaaataagcacatcatggagaatggggtatccatcccctcaagcatttatcctttgagttaaaaataattcagttaaactctttattttaaaatgtagggggttattattgactgtagtcaccctgttgtgctatcacatagatcatatagtaggtcttgttcattttattttttttttatacccattaaccatccccacctcctccccagcccccgactacccttcctagcctctggtaagcatcattctactctctatgtccatgagttcatttttaaaaaaaatttttaaatcccaaaaatgagaacatgtaatgtttgtctttctgtgtctggcttatttcatttaacataatgacctccagttccagccgtgttgttgcaaatgactagatatcattctttttcatggctgcatgatactccattgtgtgtatgtactacattttcttcattctttcatctactgatggacatttaggttgcttccagatcttagctattgtaaacagtgctgcagccaacatagaagggcagatatctctttgatatactactttcctttattttgggtatatacccagcagtaggatttctgaatcatatggtaatcaatttttagttttttaaggaacctccaaactgttctccatagtggttgtactaatttacatgcccaccatcagtgtatgagggttctcttttctccacatccttgccagcatttgttattgcctgtcttttggatataaaccattttaactggaataagatgatatctcattgtagttttgatttgcatctcgctaatgatcagtgatgttgaccttttcatatgcctgtttgccatttgtatgtcttttgagaaatgtctattcaaatctttgcccatttttgattggattattagattttttttctatagagttatttgagctccttatgtattctggttattaatcccttgtcagatggctagcttgcacatattttccttctattctgggggttgtctcttccctttgttgactctatactttgctctgcagaagccttttaacttgttgtgatcccatttgtccatttttgctttggctgcctgtggttgtagggtatttttcaaggaatttttgcccagaccaatgtgctggagattctccccaatattttcttgtagtacttttatagtttgaggtcttagatttaagtatttactccattttgatttgatttttgtatatggtaagagataggggtatagttttattcttctgcatatggatattcagttttctcagcaccatttattaaagagactgtcttttcctcagtgtatgtttttggcacttttgtcataaatgagttcactgtaggtgtgtggatttgtttctaagttcttttttctgctccactggcctatgtgtctgtttttatgccagtaccatgctgtcttggttattatcgctctgtaatataatttgaagtcaggtaaagtcattcttccaattttgttctttttgcttaggacagctttggctattctgggtcttttgtggtttcatatacattttaggattttttatatttttgtaaagaatgtcattggtattttgttaggatttacattgaatctgtagaattctttgggtagtatggactttttaataattttaatttaataatttaatttaataattttaataatattgattcttccaatccatgaacatggaatattttttaattttttagtgtcttcttcaatttcttttatcagtgtttcatagtttttcttatagagatctttcacttctttggttaattcctaagtacttaattttacatgtggctattgtaaatgagattactttttaatttctttttcacattgttcactgttggcatatagaaatgctactgatttttgtatgttgattttgtatcctgcaactttactgaatttgtttattctgatagtttttattttgtggagatcaaatataagatttttttttattatactttaagttttagggtacatgtgcacaaggtgcaggtttgttacgtatgtgtataaatgtgccatgttggtgtgctgcacccattaactcttcatttaatattaggtttatctcctaatgctatccctgccccctcccccgaccccaccacaggccccagtgtgtgatgttccccttcatgtgtccatgtgttctcattgttcaattcccacctaagagtgagaacatgaagtgtttggttttttgtccttgagatagtttgctgagaatgatggtttccagcttcatccatgtccctacaaaggacatgaactcatcattttttatggctgcatggtattccatggtgtatatgtgccacattttcttaatccagtctatcattgttggacatttgggttggttccaagtctttgctattgtgaatagtgccacaataaacatacatgtgcatgtgtctttatagcagcatgttttataatcctttgggtatatacccagtaatgggatggctgggtcaaatgaaatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatagccagtgatgatgagcattttttcatgtgtcttttggctgcattaatgtcttcttttgagaagtatctgttcatatccttcacccacttgttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccatttgttttggtgttttagacatgaagtccttgcccatgcctatgtcctgaatggtattgcctaggttttcttctagagtttttatggttttaggtctaacatttaagtctttaatccatcttgaattaatttttgtataaggtgtaaggaagggatccagtttcagcttcctacatatggctagccagttttcccagcaccatttattaaatagggattcctttccctatttcttgtttttgtcaagtttgtcagagatcagatagttgtagatatgcggcattatttctgagggctctgttctgttcccttggtctatatctctgttttggtaccagtaccatgctgttttggttacagccttgtagtatagtttgaagtcaggtagcgtgatgcctccagctttgttcttttggcttaggattgacttggcaatgtgggctcttttttggttccatatgaactttaaagttgttttttccagttctgtgaagaaagtcattggtagcttgatggggatggcattgaatctatgaattaccttgggcagtatggccattttcaagatattgattcttcctacccatgagcatggaatgttcttccatttgtttgtatcctcttttatttcgttgagcagtggtttgtagttctccttgaagaggtccttcatgtcccttgtaagttggattcctaggtattttattctctttgaagcaattgtgaatgggagttcactcatgatttggctctctgtctgttattggtgtataagaatgcttgtgatttttgcacattgattttgtatcctgagacttcgctgaagttgcctatcagcttaaggagattttgggttgagacgatggagttttctagatatacaatcatgtcatctgcaaacagggacaatttgacttcctgttttcctaattgaataccctttatttccttctcctgcctgattgccctggtcagaacttccagcactatattgaataggagtggggagagagggcatccctgtcttgtgccagttttcaaaaggaatgcttccagtttttgcccattcagtatgatattggctatgggtttgtcatggatagctcttattatttagagatacgtcccattgatacctaatttattgagagtttttagcatgaagggttgttgaattttgtcaaaggccttttctgcatctgttgagaaatcatatggtttttgtctttggttctgtttatatgctggattacatttattgatttgcatatattgaaccagccctgcatcccagggatgaagcccacttgatcatggtggataagctttttgatgtgctgctggattcgggttaccagtattttattgagatcttatcatctgcaaacaggataatttgatttcttccttccaaatttggatggtgtttatatcattctcttgtttgattgtactagctaggattccagtactatgtcaaataatggtggtgaaagtggatatccttgttatgttccagatattagaggaaaggttttcagttttctccattcagttgatactagctatgggtctgtcatatgattttttatcatgttggggtatgctccttctatacccagtttttgagggtttttagcacgaagggatgttgaattttatcaaatgctttttctgcacaattgaaatgatcatttttttttgttcttcatttggttgatataatgtattacactgattggtttgcctatgttgaaccatccttgcatcccagggataaatcccgcttggccatgataatctctctttttttttttttgataatctttctaatgtgttgttgaattcaatttgctagtatttttttgaggatttttgcattaatattaatcatagatattgtcctgtagttttcttttttgatgtgtctttgtctggttttggtatcacggaaatattggccttgtagaattagtttggaagtattccctcctcctctatttcctggaataggtggggtagggttggtattagttctttaaatgtttagtagaattcagcagtgaggccattgagtgtcaggctttgctttactgggagacttgttattacagcttcaatctcattacttgttactggtctattcagctttttgatttcttcttggttcaatcttggtaggtggtatgtgtatgggaattttccatttcctttagtttttctttattatttgttttctaccaattttgggtttggttgagtttcattgttagtttatttttcttttccttttttttttttttttttgagacaagagttttgctgtatctcccaggctggagtgcagtggcatgatcttggttcactgcaacctccgcctcctgagtacaggcgtatctcatgcctcagcctctcaagtagctgggactacaggtacatgcctggctaatttttgtattactttttagtagagatggggtttcaccatgttggcaggctgatctcgatctcctggtctccagtgatccccccgcctcggcctaccaaagtgctgggattataggcatgagccactgtacccagccttttcctcttttttgatttattcacttacagctataaaattccctctttatactgcttttagtgtatcacataggttttgatatgttgtgtttccattatcatttgtttcaagaaatttttacatttccttaattttttctttaacctactggtcattcaggagcatattttttaatttctatgtatttgtacacgttccaaaattcctgttactaatttttagttttatttcattgtggtcaaagaatatgcttgatattacttcagaatttttgaatattttatgacttgttttgtgacctaaatatggacagttattgagaatgatccaaagaatgtgtattttatagctcctggatgaaatgttctgtaaatatctattagatccatttggtctatagtgcagattaagtctgatgtttctttgttgattttctgtctggaagatctgcccagtgctgaatgtgggatgttgaagtctctagctattatggtactatggtgtatctctttctttacctttaataatatttgctttatatatctatgtgttccagtgttgagttcatatatatttaatattattatatcctcttgctgaattgacctcattatcattatatagtgactttctttgtgtcttcttgcagttttttctggaaatccattgtgtctgatataagtatagcaactcctgtttttttttgttttggtttccattgacgtggagtatctttctccatcctttgtttttagcctatgtgtgtctttataggtaaagtgtgtttcttgtaggcaacagatcaatcagtcttgttttttcatccattctgccagtctgtgtcttttgattagagagtttagtccatttacattcaatgttattattggtaagtatggacttactcctgcccttttgttatttgttttctggttgttttgtggtcttctattccttctttccttcctttttgtcttcctctagtgaagattatttcatctgatttagttttttgctttttattttttgtgtttaaggttatcatgaggcttgcaaatattataacccattattttaacacaataacagcactatttgcataagcaaggaaacaagcaaacagaaaactaataagaactctatgccttaactttgtacccccacttttaatcattttgttgtttctgtttatatcttattgtactgactatgccttgaaaagtggttgtagttactatttttgattggttaatcatttactcttctacttagggtaggggtagtttacacaccatagttacagtgttataatattctgtgtttttctatgtatttactattaacagtgagttttgtaccttcaggtgattacttattattgattaatatcattttctttctgattgaagtacttcctttagcatttcttgcaggaaaggtctagtgttgatgaaatgcctcagcttttgtttgtctgggaatgtctttgtttctccttcatgtttgaaggatattttcactggatatactattttatggtaaaagttttttgccttcagcacttgaaatatgtcatgcccctctctcctggcctgtaagctttccactgaaaagtctgctgccagatatattgcagctccactgtatgttatttgtctcttttctcttgctgcttttgttttatttattttttgtagagatggggtctcactgtgttatccagcttgttctcaaactcctgggctccaaaagcttcttaagctgataaacaacttgagcaaagtctcaggacacagaattaatttgcaaaaattgccaacattcctatacaccaagagtgggcgatccaagagctaaatcatgagtgaacttccattcataattaacacaaaaagaataaaatacctaagaatacagctaacaagggaagtaaggacctcttcaaggagaactacaaaccactgcccagagaaatcagagatgacataaacagatggaaaaacattccatgctcatggatgggaagaattagtatctttaaaacgctaatactgcccaaagcaatttatagattcaatgcttttattattaaactgccattacattcttcacagaattagaaaaaaagtattttaaaattcctatggaacaaacgaagagcataaatagccaaggcaattctaagcaaaaagaacaaagctggaggcatcacagtacctgacttcaaactatactacagggctacagtatccaaaacagcatggtactggtacaaaaactgacacaaagaccaatggaatagatagagaaaccaaaaataagaccatacacctacaatcatctgatcttcaacaaatctgaccaaaacagactgtggagaaaggatttcctattaaataaatggtactggaagaactggctaactgtatgcagaaaattgaaactggattcctttcttataccatatacaaaaatcaagatagattaaagacttaaatgtaaaccttaaaactataaaaccctgaaagaaaacctggtcataccattcgggacataggcatgggcaaagatttcatgatgaagatgccaaaaacagtcgtgacaaaagcaaaaattgacaaatgagatctaattaaactaaagagcttctgcacagcaaaggaaactctcaacagagtaaacagacagcctacagaatgggagaaaatttctgtaatctatgcatctgacaaaggtctaatatccagcatctataagaaacttaaatttacaagaaaaaagaataactcttttaaaaagcgggcaaaggacatgaacagacacttctcaaaagaagacatacatgcagccaacaaacatataaaaaaaaagctcaacatcactgattagagaaatgcaaatcaaaaccacaatgagataccatctcacgctagtcagaattgctattattaaaaattcaaaaaataacatgctggtgaggttgtggagaaaaaggaatgcttttacactattggtgggagtgtatattagttcaaccattattgaagacagtgtggtgattccttaaagacctacaaacagaaataccatttgacacagcaatcctattactgggtatgcaccgtaaggaataggaatcgttctgttataaagacacatgcacatgtatgttcattgcagcactacttacaataacaaagacatggaatccagttaagtgcccatcagtgatagactggataaagaaaatgtacatatacaccatggtatactatgcagccacaaaaaagaatgagatcatgtcctttgcagggacatggatggaactggaggccattatccttagcaaagtaatgcaggaacggaaaaacacataccacatgttctcacttataagtgagagctaaatgataagaatacatggacacaagggggaaacaacatacactggggcctattggaggatggtgggtgggaggagggagtgaattaggcagaatagctagtggattctgggcaatacttgggtgatgggatgaactgtgcagtaaaccaccatggcaaatgtttacctatgtaacaaacctgcatattgggcatacatacccctgaagctaaaataaacgttggaaataaaacaaaaactgggctcaagtgatcccttgccttggtccctcaaagtactgggattacaggtgtgaccgctatcctcagcctcttgctgctttcaggatcctttctttatctgtgaccttttggtgtttaattattaaatgccttgaggtagtcttttttgggttaaatttgcttggcgttctgtaaccttcttgtacttggatacttatatctttctctaggtttgggaagttctctgttatatccctttgaataaagtttctaccccgtctctttctctacctcttctttaagcccaataactcttagattttcccttttgaggctgttttctagctcctgtagccatgcttaatcattttgtattcttttttctgttatctcctctgactgtgtattttcaaatagcctgtcttcaagctcactaattttttcttctgcttgactaattctgctattaaaggactctggtgcagtattcagtatgccaattgcattttttttttttttttttttgagatggagtctcactctatcacccaggctggagtacagtggtgcaatcttggctcactgcaacctccgcctaccggattcaagcgattctcatgcctcagcctcccaggtagctgggattacaggcacataccaccatgcctggctaattttttgtatttttagtggagacggggtttcaccgtgctggccagactggtttcaaactcctggcctcaagtaatctgcccacctcggtctcccaaaatgctgggattacaggcgtgagccactgtgcctggccgccagttgcattttttggctccagaatttctgcttgatttcttttaattatttcaatctccttgttaaatttagctggtataattctgaattccttctctgtattatcttgaattccttgagtttcctcaacacagctattttgaactctttgcctgaaaagtcacatatgtgtgtttctccaggattggtccctggttccttatttagttcatttggtgaagtcatgttttcctggatggtgttgatgctagtaggtgttctttgtgtctgggcatggaagagttagatatttattgtagtcttcactgtttgggcttatttgtacccatccttcttgggaaggctttccagacatgtgaaagaacttgggtgttgtgatctaagctgtatctgctttaggggcacccaaagcccagtaacgctgtggttcttgcagattcatataggtaccaccttgatggtctaagatctggaagaattctctggattaccaggtagagactcttgttctcttcccttactgtctcccagatacatagcctctgtctttgttctgagtcacctaaagatgagggtggagtgacacaagcacccctgtggccaccctcactatgattgcgccgggtaagacctgaggccagcacagtgctggatctcgctcaaggtctgctctaaccactccctggctactgcctgtttactcaaggcccttaggctctacagtcagtcgacggcaaagccagccaggcctgtgtccttcccttcaggccagggaggtcccccaggccccaggtgggtcgagaggtaccgttcacaaacggtctaaagtctaaaacctcagaagtctacttggcattctgttgtactgaggctgagctgccactcaaaccacaagatgcagttcctcccactctaaccttccctttccaaagacgggagcctctctttttagccaccaccaccccaggccacaaggagtactgcctgactactgttgatgttccctgaagatccaagggttcttaagtcagcttgtggtgaatgctgcctggcctgggactcacccttcagggcagtgggctcccctctgacccagggcaggtccagaaatgccatccagaagtcaagtcctggagtcggggaccccaggagcctgcttggtgttctaccttcctgtgaccatgctggtacctgaatccaggaagtctcagaggctgactcagggccctcggcatagtacctgggtatccaagctgtttattcagggcccaagggctcttcagttagcaggtattgaatactgccaggactgggttcttttcttcaaggcagcaggttcccttctggcgattctcatgcctcagcctcccaagtagctgggattacaggcactcaccaccaagcctgactaattttttgtatttttagtagagacggggtttcaccatgctggccaggctggtctcaaactcctggcctcaagtgatctgcccacctcggcctcccaaaatgctgggatgacaggcgtgagccactgcacctggccgccaattgcatttggcgccagggtatgtctacaaacgttgtctggggccaggcacaatggctcacacctgtaatcccagcacattgagaggccgaggcaggcggatcacctgaggtcaggagtttgagaccagcctggccaatatggcgaaaccctatctctactaaaaatacaaaaaattagctggttgtggtggtgggcacctgtaatcccagctacttgggaggctgaggcaggagaattacttgaacccgggaggtggaggttgcagtgagccaaggtcgcaccattgcactctagcctgggcgacagattaagtctgtccccccaccaaaaaaaaaaaaatttgtctgggaggtggggcctggaacgggggcctcacaacagtgagcattaccctctcccactgtggctgagctggtatccaagatgcaagacaaagcccttcccattttttcctctcgtcttctcaagcagaaggaaggggtctcttttggagccccagctgtgcttgccagcactcacttggctgccacagctggtgtctcagtatgtcatgtgagcccccattccattgtctctgggcctagttcagcactaggacttgcctaattgtcacagtccttatggcctaaactgcctttcaagttcactgagagtcacagagtgctgtaggccttggtggtgagaactcaagttcagactgctgggataagtgattcccttctgactagggctgatttaaatgctccctccatggatgggtatcagctgagtttggtctttttttttcctgctctaacaggacagcattgagttcagtgtgtcacaattgctgtgttttctttcccacagtgcccagagatgctctctgcaacatgccgctgctgtaggagacgggggtgggtggggggtggcatcagggattcaagactgttttttctatctctttagtgcctcttttcagcaatacgaagataaaaccaggtactgagagctcacctaagttttggttcttatgaaggtgttttctctgtgtagatagttgttaaattggtgtccttgaagagggtagtggggaggatgatcagtggagtcttctattccattatcttagttggccttgggccaatatatatattttaacatgcaaacaagctgtattggtcagtgcagaaaattaagttgcagaacaatataaatagtataatgacacctagaaaataatgtatatgtgtgtgtgtatatatatatgtgtgtgtgtgtgtgtgtattttattgatatgtagaaatagtcccagaatcatgcacattacactttcaaccattgttagctgtggtaaagggaggagagtttggaagggaggaagtaataaggctaagtacagctctgtaagaacgtatttaagttgacattggtatattttaacagtgcataaagtggccaagtgcaatggctcatacctataatcccagcactttgggaggctgaggtaggcgtattgcttgagcccaggagttcgagaccagcctgggcaacatagtgagacctcttctccacagtaaatcaaaaaattagcctggcatacagctgtggttccaactacttgggagactgaggtgggaggattgcttgagcccaggttgttgatcatgccatgatagaccctgtgaccatgatcacaccactgtactacaacctgggcgacagagcaagaccctgtctcaaaaaaaaaaaaaagggaaaattggatacaataataagtgtacattgcagaatatttggaaaacttaagagacagtaaaatgcatcagtaattttatcacttaaaggtgactactgtcattctattttgtatccttctggttggctttctgttccaatattagcatatgactgtaaaggaacacttaaaagtggtctccaacctttttggcaccccagactagtttcatggaagacgatttttccacagacgggtggggggctggggggtaggtgggtggtaggtggtttcgggatgaaaccatttcacctcagatcatcaggcattagattctcataaggagcacacagcctagatccttcacatgcgcagtttacaataaggttcacactcctatgagaatccagtgctgtgactgatctgacaggaggaggaggcagagctcagccagtaatgctcacttgccctccactcacctcctgccgtgcgctggattcctaaccaatccatggccctgggggtgggggatccatggtatatatggtacctatttcatttaacattctaagttgtgctccattgaacattgtcttacctaaatgattgtgcacatctaaccatttctaaagataaattttcagaagtgggttcatgggaagaaaaacacaagaatgttttaaattcttttgtatataatgccaaagtgccttctagaaaagttcatgtccacatccaccagtagtatttcagagtgtctatcttactgcatactgccaggatcagatattctattaatctttgttaatttgatggatcaaaaagactttgtgttttaatttacatttctttacgagtaacatagagagagagagagagtgtgtgtgtgtgtgtgtgtgtgtgtatatatatatatatgcttttgttccaggcctaatatatatttattaggcctgggacaaaagctttagtgaaccaaatttaataaagctttggcataaattgaaggaaggtacagtaatatactgaggctgctttcaataaaaacagcagaacatgtatgttcaaattaatgcttgtcccttcaaaatactaattaaaatcaactccattgatgcaccattgcttaagacatcttgggaatcttgtgtttggtctgacttctgaagcacctttggtttctttaggatttccctagtggtggcatgactccagcttttgctgatgggctcagaatttggaagtttaagaaataagataacccaaacttaataatgccattttttcttttcattttatgaagggatagctattggcctggtgtgctggctcatgtctgtaatcctagcagtttgggatgctaaggtgggatgatcacttgatgtcaggagttcaagaccagcctgagcaatgtagtgagaccccatctccacaaaaaaagacgggaagataactatgaataaattgtttcttttttttaaaaatgacttacaaataggctctgaaggtggtttgtttatgcagaaacatttgcagaatatcccattgggcgttaggtgctatattgggctctgggcttacaattacagaaattttatagtctgtgctctccagtctttttggagaggtagtgcccacattgagcactgaaagacaagtagggggatataaatctagataaggagtcagtcggacagagtggggtgaaggatgttcagacagggaaacacacatgcaaaagagggaaggtgggacacagcatatgcatccaacatttggtagggccgaggccccacatgggagcagtgagaggttagggatcaaggaagtaggcaccagatcatgaagggtcttgctaagactttattctgaaagcttcagggagccttttaaggatttctagtggagttgtttcatgatcagatctgaacttagaaaaactgacatcttatttttggaggactcataagggtagggcagaagtgaggaaaagaattaagcagccagtaatccaggcagcaagaggtctgagcctgagttcagtggccagggcaggtagagagaagtgaacagcaggacagcatcattaaggagacttggattgtatgtggagggcaaagcagagggaggggtctgagtggtgagggccaagttttggaggaaagtggatgatgctgagttgagtcaccaggatagacagtgtggagccagggacaagagcgtgatgaaggagatgctcaggtttggtcatgctgaatttgaaatggctctgggaaatttaagaagaggtgccgtgtagatagttggatcagagcctaggatgtagacaaagtctgggaacatagatttgggagctatgaacacattccccaggagaagtcacaaaaatgtcccaagcagcaggagcctggtatggtgcttgggtttcaccctgatatgccctgttcctttcagggtattgcagtttcaggttgctcctgtctcacacctagatattttggctcttagctttgatcagatatagctatcaatccctgcatcagtgaactcacaggccacagctaaagatatgctgtcattgaagacaggtttgccctctaaatctaaaaaccaagtgagcaattagaaattgtttaagtgcccattaataggaaatagaataaatatattggggaaagtccatataattattatagcataaattggatcatgtcattcccccactgaaagcatgctggtgactttctttttgcacctggaatacaatccagacaccttaagaccttgcatgatctaaccgtggcctatctcttttggcttcatcccatgccaccttccttcatgccaggatcttctttgactcactcagtcacacactttctcatctcatcctttgctcatggtgtcccttctctgtgaaccatcttatcatttagtagtaactacttctccttcagctttcagcttaaatgacctctcaggagagggtcctttggatccctccccacttcccactcccctactcacctgtgtttttactttatgatctcagtctgtgatttttttttttttgccttttgtctgcccttccgtgaggttagggattgtaagtattataaccctagtacctgaaacatagtaggcactaaataaacttttttttttaatgaataatattttagaaggggaaatatttttgtcttaattcaagctgctgtaacagagtaccataaactgggtggtttaaggaacagatatttattgctcacagttgtggaggctgggcagtccaagaccaagatataggcagaaccagtgtttgctgaaggctggtttcccggtttgcagatggccaccttctccctatgtcctcacatggtggagagagagcagagagaagaagaaagctatcctgtctcttcttataagggcactaatcccattcatgaggactctactctcatgacctaataacctcccaatattatcacattgcctcgtaatattatcacactgaggttaggatttcaacatgaatatgggggagacacaaacatttagtctgtaataattgataagtgaaaaaagaaaaaagacatacaagcatagaatgatcatttccaaaaaagaaaaatttctgtacatatatgtgtgtatttatatgttcatatataacataggaaaaaaagagaaagtgtatgacccagtctgtttccaactacatctgtgcagtgggagtaggtcaggaccttttatggcctattttatttacttctatattatagtatttatttttatagtgggtatgtttatattattaaaaataaatccaattaaaatttccagtccttttaacaatcacatttgtttttatggcaaatgactctaatatgggcatttttttttccagattttccagttaatgagatacttgagatgcaaaatttgttttgatttagaccagtgaattaagattaggtactcattaaacgactgtgaaagtcctttatagataattttgctttatagataatttagtgcttctagtgaaacaaatttaactgatggccttagcttggctattgttgaagaatccttcactgttaggctcccctgcaagacttccctcttcagcacttgtttttttttttttatttttttttattttttattttttttttatgtctatacaaaatatttatttttttattatactttaagttttagggtacatgtgcacattgtgcaggttagttacatatgtatacatgtgccatgctggtacgctgcacccactaactcgtcatctagcattaggtatatctcccaatgctatccctccccccttcccccaccccacaacagtccccagagtgtgatattccccttcctgtgtccatgtgatctcattgttcaattcccacctatgagtgagaatacgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtacatgtgtctttatagcagcatgatttatagtcctttgggtatatacccagtaatgggatggctgggtcaaatgaaatttctagttctagatccctgaggagtcaccacactgacttccacaatggttgaactagtttacagtcccaccaacagtgtaaaagtgttcctatttctccacatcctctccagcacctgttgttccctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttctgatggggttgtttgtttttttcttgtaaatttgtttgagttcattgtagattctggatattagccctttgtcagatgagtaggttgcgaaaattttctcccattttgtaggttgcctgttcacactgatggtagtttcttttgctgtgcagaagcttcagcacttgtttactggtcacatgctttacacagcactctgcttagattttgcctttgaggttggccatctcccttcagctgctctgatttggaagaagggcgagggttgcagctttccctgagatagggtgacctttttttcccttctgtcttcacatcctaatcacaccacttctaactggatacgaatgtcttaactgtgaaaaactgtgagttctctgtcagaaatgaatctctagggcttcccaagtggtaattatttcctgtgagagttctgcttttgaaagtgaggtttctctccttgacctttaaccctcgttactcttctgtgttcccagttggttcgactatgcaatgagggcgcccggaagatggaaaggactgagatgatgtacacaattaactcccagctggaatttaaaattaaggtattctcgtaccttgttcattactgttcttgcctatgtttttctctaaatagagagagacagttgagggcaacaaagtagataggaaattgcttttcaaagaagggtcataaattgctaagagggagtagcagatgcttcaggcaattttgcttttgcttgtaccagacagagtgaccttcctccaggccctgaagccaggcattatctaagaagcacttttttttttccaggaagacaccaagcttaggggaataaataaaataatagaatagggtagttaaaataatagaattttagaattgaaaggagattccttcattattctcaaaatgttctgaaaaacagtaatattccatgagctggaccagtgttctcctaaattaaataaggacactccttttctcgtttacaaaacagatcgttaatggataatttttttcaagtttgtttttctctcataatttttttgaatatgtgctgcttgttattccttgtctgatactgctcttgagcagatgacaagatgaacaaaaaagaagaaaatgacagctaatggcaaatctaggtcatggccattcttttgttggctcatggctgagtttttaatgggaagtgagtgctcacgattgtgactctattgttttataacttgtaaatgtaattaaacaattttaaatgactggtcatatttttccctagtaaaagtgtttctatttcatgcagtcaaattatagtgatcagcatttcatggtattctgtaaagagcagattctctgccatgtcatgtagtttgaggattactgcatgcttgctttggcagcatatatactagaattgaggatcactgatatagtccagctacacccttttattttatgaatgaggaaaagaaacccagagaataattgtcagcagagtcacttggctagtggtgataaaatcaggactaaggtctagatgtcctgacttgcaggtcagtgtaaactcttctactgtaacattctgactctaatggtttagatgcagaaacacaaactgtaaaagggaagaagatgggtatttgccaaaaaccagacacacatgcacacacatgcatgcacgcacactttaaatagttttaatgttcttgtacagaattttatagcaattaaaaaacccatctttctcccaactctcagaatctcgttctctctaatttgtttctaaatattttggaaagtatatctgacaagtttgttttttgttttttaatttcctccttttgaaagatgaaaaattccctaaccatttttcttttcccttcttcactgaaagtcacttggtataagattactttaagaaactctgtctaggccgggcgaggtggctcatgcctgtaatcccagcactttgggaggccgaggtgggtgaatcacctggggtcaggagttcgagagcagcctgaccaacgtgatgaaaccctgtctctactaaaaatacaaaaattagccgggtgtagtggcaggcacctgtaatcccagctatttgggaagctgaggcaggagaattgcttgaacccaagaggcagaggttgcattgagttgatatctcaccactgcactccagcctgggcaaaagagcaagactcttaaaaaaaaaaaaagaaaaagaaaaagaaactctgtccagtacccaaaattaatttgtaattgaaaaatgctaaccccaaggatcattaaaagtaagtgattaactgaggtcaggagatcgagaccatcctggctaacacagtgaaaccccttttctactaaaaatacaaaaaaattagccgggcgtggtggcgggcacctgtagtcccagctactcgggaggctgaggcaggagaatggcatgaacccgggaggcggagcttgcagtgagccgagatcgtgccactgcactccagcctgggcgacagagcgagactccgtctcaaaaaaaacaaaaaacaaaaaacaaacaaaaaagtaagtgattaacatcagttgagttcctgagttttggttgttttcattcaatgattaaaatatttgcgagcataaagtatggatttacagtggagcacctcatttagaacacttagaattactaattattactaattggaaatactcgtaaaatcttaggaccttataatactatatgaataacagtggacatttctatttaatttattttaatgatgataaaatagaggttcaatgaggttaaatgatttatccaagtacatggcaagtattgtaagaatagagcagatttactgagcatcttccatgtggaaggcagtagataaaaacgtgatcatccctcccctcatagtctagtagaagactgctgaaaatcaaaggagtcagcaaagtctacagctgtcacagtagctagaagactatggaaaatactggaaatggaagggagatggacaactctaagagcaagagacagagagggctgggggacttggagcagtctggcaaggcttaatgccagaggtgtgtttgacctgaatcttgaaaggtgagttaagaagggccttagagcagaaacaaatgcacagtttccactcctgtggcccaggaattgtaagcattcagtgtgggtagacttggggtgcaagaggagcagggtggagctacagtagcaggcaaacactcctgcggacagccctgtgtaccaagaggaggagctgagtgaggtcatttgggagccaccgaaaagttctaagcagggaagtgaagcaatcagatgtgtgtttagtaaagacaacttcagcaatggggaaaggcttttccaacttactccaaatccagaagtcattaaaagaaaaaagtcctaattaatctatataaatttttaaaaaatttctctatagagggaaaaagaccatgaaaaaagtgaaaaggcaaatagcaaactggagaaaaaaatagttgcaactcacatatagacaaagggtaaatatccccgatgtataaaatcaaaatgataagagaagacccactagtctacaagccaaggagcaccaaagattgccagcaaactaccagaagctgggggagaggcctggaacagattattccctagcaccttctgagagcctggccttgctgacactttcatcttggcctgtcttccaaaactgtgagacataaattcctgttgtgtaaaacaaaaaaaaaaaaccactagaaagttgcaaattagaaaactgctaccagaaaaggaaatccaaatgatgacaaagttttgaagatgctttatttcactcagaggaaaattgctaattgaagattagcagataaagataatgaacttcaccttttagatttataaataattcaaaagtttgataccccattttattgatggaattggagaaaaaggcatttttatatgttgctggtgggaaagattgttttaccccaatggtgtgcaatttggcaataactatcaaaattacaaatgcaagttactacaactcagcaattttacttctaagaattctacagatgtactcatgaatgtataaaattaaacacacactgagctattattatagtgttgtttgtaatagtgaaagatgaggaaaaacatctaaatatctatcaaagaggattaattaaataaattatagtatacgcaaataatgtgataccactcaaaagaataaaggagaattttagatacctatatggaaagctttcttatatattattaaatgaaaaaagtaaggtttagatataaaaaaatacagtttgcttttgcagatgaaatatttggacagatgcagatgaaactagttattggtcattacccgtgaggggcagtggtcagggagtgggccttgtcgggttgactgggtggagagccacccactcactcagataggaaattcaggaggaggaacaagttttgggggaaggtaatgagttctattttggccatatttggtttatggtatggccataggtgctactactatgagaatattggttgcaaatttactaagtagtgccattttcacatttatctgatttaattctcacatgaaccctataatgtacccttattattaacttcactttatagatgaagaacctgaaactagagagattaaattctttgctcaaggttatacaccaagacgttataaagtctagattcaaatctttgactccagagtccacattcttaacaatgactgtatgataatgataatatggatatttttctaatttggaggaaagtaaattttgtagggcatgtgtgtgtgtttttcattgtcatttcacacgttttttatttttaattttgcttatgattttctggaagactgtcaagtgctaaactgcagtaatatgagaggagatggaaagcatccctggattggcactttggaagctagtgtaaagttagagcacaggctccagaactgacctgcctgagttgcagtagaagctccaccacttactagctgtacaaccttgggcatcacttaccttttcatgtcttggttttctgaaccctaaagtgaagctgatgatagtactttccctcatggaattattttgaaaattaaattatttaagagatataaagggtttaaatagacctgatttatagtaaacaagcagcaaacattgttgatgtgttttatcagagtagttaaatagatgtgggtgcattgaagagtgagtgggatgtgaagcagttgaagcagattagacttttcattccagaagcttgactatcaagaggatagggcagtgatgataactagaggattcacaaagtcaagggaccattttttgtgaatagtcttcaggatagtttgcagaaagggagccaggagggagagaatactaatgagaggggaataaatcaagggaataaggccttagagctgaaaacagggtgttgaagacaggagagcttatcctctgagatgggaggaaagaaaatgatggttgtagagaaaaagctggtcactaaaccaagaagatcgaaaaccagagattagtttgtgtctcaaatccagtgttttttctccactagaaaacagctttctttaaaagttgcctctacagagttgggaagaattttgtttttttgtcttgcgatggaaagtttgaccttatgaataagcacatggagaagttgaggtttctcaggctgctttaggagacatacattcagtgtgattgagtggagtggtggtatgttagttgacagaaggctttgctggttgccatttgggggccttgctaacaatggaaatccaagaaaaatctttgtgctgtagaggacagtttgttagtttcccaaaaatctaaacataagagttactactatatgacccagcagttccactcctaggtatatacccaagagaactgaaaagagatgttcaaaaacatatacacaaatcttcatggcagcattgttcataatagccaagaaagtgaaaataccccaaatcaacggatgaattgataaacaaaatgtgatatatgcatatagtaaaatatttaggcacagaaaggaataaagttcttatacatgccttgtggatgaaccttggaaatgttatgctaggtgagagaaaccaaattcaaagatcacatattgtataattccatttatatgacacatccagtatagacaaatccatagagttagaaagtagattagtggttgccagatgcttgggggaggaagagtggcagatgactgctcaatgcatatggggtttccttttgaggtaatgaaaatgctctggaattacataatgttgattattgaacaatattatgaacatactagaaaccactgtattctacaccctttgaagtggtgaaatggtgaatttcatgttatgtaaattttatctcaacattaaaaaaattatttgctcttcagcagctctctcttttcttgctgccccataaaattagttacattttatgccaaggctagctttctaggatgccaggtaatagaaaaaaaaaaatgaaatgtctgtgctccataggcacagactatttcagtactatttaggatagtatttcagtactatttaggatatatctttgttcatgaatttcttttctagtttctggttcacacatggattctagtctcagcatttccttactaggggaattcactcatgctcactttgggctgttctgatttcctttatttggatcattttaatatctcttctttaataaaacctatctgattgagttcagtcttctaacaataaatctgaaacataaactatatataaaatgttgggcttttgttttcaaaagaagcatagatgtattgaaagcttttgtcaattttaggtgtttataggtagaaatttagttttgcccctagtggagtatgaggactccataaaaatgaatctgctttaaaaacaataaaacaatttaaaaatctttctttctccaccccctaaatcagaacagtcacagggcagcatgtgcactgaaacttaaccataatattgtccttggttcatcttgtagggttatacgcaatagcaagatagtcctgtgtttcctgtaattccggcccttcagccggacctaccctgacacaaggtgacctcttgtatgtgctgcctagtctgccggagttatctaagcaatctgtcgacctttaaggtttcagctgtctctgtagggtaattgtctgatttcgagattttgggggttgggaacttcataaactcccttagcagccagttttgaaaagtttggggttagccataatcttttatcttcgttttttggaccttcaggaaaatagtatataaatgataagcaaccttcttataaaagctctttataaagtttaaaataaatatgaaatcctttcttagccttctcatttcctctctaatatcctcaatttcctttagctatttttaatcattatttcctgaaaagggtgatgtttgattgcatcacatttctgcattatgttttgtgtgtccaagaacttttgcttattttatggatgtagtcttttaaatcagagttttggcagtaaacatttctggtaacttaaaaaaaaaaagctttcaagggtaaggattgttctgtagttttgagagttttccagttggcttgtacaagactgaataaagaaaataaaaaagcagtatgtaattttttggatacagccttttctatgatattataatgattatgatggattattttggaagaacctcattttcacagccagaaagtagtatgatgctttcaggtacaaacttccatgaagcaagctaccatgatcttaagaacaggtgttctcaagaatatggctaaatagataatttgtagacaaaaaaataagcatgtaggtttttttctcttgaaagaaacctttttacttcatgaagtaaatgtagacttttatatttgtctcgttaacctatagttgtgtttttctgtatgtttagattctgatttgagatatttaaaataactagttgattctgatatattttattactaggcttttcaattgtaaataactccttactttctttttcagttaagagttaatagaagggtcataattttttattgatccaataacattttctcattgagttttagtttcatattgggaagttaatagttttttatagtggaagatatattgttctttttcattttttcttgaagaatgcactgtacttctgtatttatagttcagttttatatgcctataaaacaatgatgcatactatgataagtatcatttgtttgaatgtacgttttagcttttactttcagtaaacttaaaaggatttcaatttagctttggtcactgggtttttctccttttgtagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagaggtaagtctttatctggtgttgctgactagacattccagttttaaagttctgtaattcagatgcctgttagggtgatcatcctttaaaagctagaaatgttggaagtatagtttctacatactgaatcataattgcatctatggttcattttctttaaattgcttatgtagtttcagacgaatcattatctgcatcataattcttgccaacctctattgagccactgttctaagcattttacacatttatatcattcaattcttatgatatccctgagaaggtagcactgtttttattctcattctgtgtttttcagactccttctaccataaaatttttgtgtaaaacagaaaaaagttggtccagttgagaacaggttggggagcaactctagtgctccttttaacttaatttaaaatgcactgcttttaatgatccttagtctaaaacattcccctgtgactgggaaggtgttagccatactcccttctgaagggaatgaagtaaatcatttgattggcagagtgtttgttcttcttactccaggcttctagttctgtgtttgtgtccagctctggtgagatgtccatgaagaatattgtagaaaccttttctttccagtatttcttctgtcagactgtttctgttctacacacacacacacacacacacacacacacacacaccccttcagctctgcctttctctagggaacatactttattaaatgcacccaacacatgtaaggtcctatgtaaatattccgtctttcctagaatatgaacttagagtgaaaacttaaatctgtgggctgttatttccacatatgagggaaatgatggtggcctgaattgatggcatatggtgggatcaggggtggtcctggggtgcaatttaggcaaggtgaagagaattatagaaacagatctctatgaaaatacaaaataaatgtccaaatgtatcaggcatatttaattaaatgctagttctgagttgctgactttatagcttgaaaattcaaactaaattaaaacagattgagttcttctttttgctccttttaatcagaccatattatgaattatttcagctgagtggctgtctagctgaaatgaaatgttagtatggtcttccctgagaagccataatgtgacaatgatacatacattaaaatgctgatcattatttttcatacttaggaaaattctatttccatatctccaaggagaaattacttctcttacctggagtagtctaaatagttctagcagctaagtaaaaatttttttttttttttttttttgagatagagtcttgctgtgtcccacaggctggagtgcagtggcgtgatctcggctcactgcaggctccgcctcccgggttcacgccattctcctgcctcagcctctcgcaggcgcccgctaccacacccagctaattttttgtatttttagtggagatggggtttcaccatgtcagctaggatggtctcaatctcctgacctcgtgatctgcctgcctcagcttcctaaagtgctgggattataggcatgagccactgcgcccagccgtaaattttataaagaaagatgggagaagaattataatttttatgtttttgtgttttgttggtttcctatgagatagcatttttccttggctttctccaggatgttttgtttttaggggagagtagttatatatgtctcttcaaatgccagaactcttgacttttaacatcttccagctgttgaaatatttgttctgtctcagtagaccaagagctttaactaaaatttgatttaaatggtaaaatgtacactgacagtaccaagccaattttaaatataaatgtaatttcgattatgatgactttggtgacttaatgaaaatattaaaggtatttaaaccagtacagtgcaacttttgttcttgaatttgcacagacctactcaataaatatagactattgaaagtcagaattaaggtatatgctcttctacttagtagcgtactttgcccttcacagatggtgttgctctcctagctatcccacatttatttgctcaggtaaatttgaacttgtattattaataaagagcaatgccattgggagtctttgagaattttttttttttttttgagacgggcgttttgctgttgttgcccaggctggagtgcaatggcatgatctctggttcactgcaacctctgcctcccaggttcaagtgattctcctgcctcagcctcctgagtagctgggattacaggcatgcgccaccatgcctggctaattttgtatttttagtagagatggggtttctccatgtttgtcaggctggtctagaactcctgacctcaggtgatctgcctgtctcggcctcccaaagtgctggaattagaggcgtgagccaccgcacctggcctttttttttttttctttttcttttttttctttttcttttttttaagagcaagatacacagctccaatggagaggacaacctgagtacctaacttggcctttaccaaaactagaattttttttttgccttaccaattagttcattatatttctagggtgttcttaggtaatagtattggagacctaattgtttatgacctgaatatgtggtgaggttacatgcaaaccacagaagcttcataaacagacttggttaaaaatgtacactatgcctgaccgtatttacatgatagcttcaaggaggcgaactgcaaatgctttgcatgccagaggcaacagtaaaggagatacaacaaccctgaacaaggcgataatttaggcttggccacaagttacagataaaggaaaatcacctgtgccagcgcttgaggactgatctagccacccactgcctaattctaattccaggtttcagtcaaggaacttagcagctgggcttccagtggttttcctcttcagggaggtttttcagctactgagaaaagctgctcgggaggacagttactcttcctcctccgatccagactggcagaaggtttatactgggcacattccatagattgctgaggtgtgtggaccccctccacttcacagtgcatgtatcactgcttgtgcttgtaaagctggcttgatgagtggccatgacactgtctttgtgacaggaattttcacttttttagaacattaaaaacaagcttattttaattattaattttttttttagagacgggaccttgttatgttgcccaggctgcagttcagtggctattcacaggcatgatcatagcacactgcagcctcacactcctgggctcaggcagcccttccacctcagcctcctgagtagctggggctgtgggcatgtgcctttctctttacaagaaagtttaaagttttcattagccctggctgctagtgagtcactctgttaatagcctggttctaccagatttcaaaaggatacatgattgattactctggatgagggatgaggacatgaacactttggtatttgaagctttgactagaagttatctgggtactgcaagagcagacttctcaaccttggcacgattgacattttggggcctgatgtttctttgttgtagaggactgtcctgtgcaataatgtaggatgttttagcagcattcctcgtctctatccactgttcgctagtaacagcccccttacaccctagttgcgacaaccaaaaatgtctctggacgtttttgcctaatgtccccatggagcaaatccctgctagttgacaaccactatactagcatggtagtaaactaaactagctttgcctttggagtagtgaaggtgtgaaaatctatcagactgacacagcaagaatagtaatattgtattataaaagtaatttattgtcaagttatactcatagattaacaaataacattataatatccaatatgtgcctactgataacttattataataaagatgaattacagactgtaccttcatgtataacctatggtctaaatactgttgttcctagttttgaaatacaaaactgaatccaagatctaactaggttcaagctactaaaagatttattttgtaagatatagtcccttctatctggcttaggtcttctctaccaatatcacctgaagctgaaagcaaaattttccttcctgtatttgtttccttactgtgttagtttcttacagctgctgtatcaaagtgccacaaacaaagtgagtggcttaaaacagtcagaatttattgtctcacagttctggaggccaggattatttccatttcacagatgaagacgctgaggaaaagagagataaaatatctttttcaaggtctttcagcagagccaggattctaatctgagtctttgtttccagaggctcaatttctttatgttcattacttcttcattttatttttctagaatatttcacttttcccctcatcctataaagttattgggggaaaaaagcatagaaacttacaacttttttgtttgtttggagaaacatcttttccaaagtaagcttttgttgagtatttttatagttttactggttgtaggagaaaactagaaccagtaccaaatcatatttgtgagttttcctctgccattagctaatctagcatcagaatctggggaagagtttccctttgttaacatttccttcctgcagacatttaagacaggagatttctacttcctgatttctggttccataaatactgtgtatagcttgagccctggttacaactttctaggttttataaaaaggttttcaaaatttttaatttttttttcaggttttataaaattttctgtaatagcaaactactaggtcattatcataaggtcaaggacttaagttcaaatttggattttcccaaatagtttgaacacccagtggctcaaagctgtgcaggctcccttgaaaggttcatggcctggtttggttccattttttgctttttccatgagaatgctctttcctattatagaaagctgaaaatcacctgatacctgtttcatctgcagaataaactcgttcctagggaagtcaagagtatcctggctaaaggaaaggcagtaaaaatgattgcaagctcctttgttcctgaaacacatgaagcttgcttatttctgaccattttggaattgagttctaaattcaagatggcaagatggggtggaaaagaaatgggagccctgtttcctttttgctcctttttttcttccgctgtcatttgcagccttgattcctctgatgttatgaggtattgtttcccctgcatctgtaaggagagttggcattgctgttaaatgttgaaagctgccactactgagaagcacaatatcgatgcctggggtcagaaaactgagctcaaatcctgggcaaattacttctcgtctctcagagcctcagtgttctatctgtaatatggggataataacatcatcttcatcatggagtttctgtgagaattaaatgagataatgcacataaagctcttactacagtgaatatgaatagtcctgctaagtaactgatacatgctatcattaagattatttttggtattgtgttctctctctaaagattttgccgtaaatcaaattattgcccttctgcttctagaatattttattgtttttaaaaaatgattttaaacctttacgtaattgctacatagctgaaggtacggcacgctctaggaccagacatgaatttatggcctccagaacatgagcagtttaggaataaatgcctttaactctatgcctttccctcctcatgaaacccatgtcaggcggcaagtgagtgaggaaaaactattggtcaatttttattctttataaattggtgtaaatcatgtgtacacgttgtagtagcagttttttttttttttcactattcctaaatgactaggagacactataacattgttgctgaaaaatgtgaaataaatagtatatttttcctttttattgatgtcgtcagtagtgtggtactcctgaattggagtgtggggttgctgtataatttggataaccttgttacccacttaagaagctgtgcctgctcttcagggcttgcttagttcagcttatcccagggagagagcttcagaaaggtggtgacagcctctcagaactgtccatctcctctttttcaaggactatgggttcagagcatcccatgagcagccacagaagtgctgggctgtggcatctggtgacccttggtgacagggatggggcttcctggcccttttctgggtcactggccatcttttttggtggcagtcatactgatgaatggggatcctcatctccactatttgttatattattaacaatgaaataggatgtatgtggcatgtttgttagacttcagaattagcttgaggaactgagcaagtaagcctatttgaaatcagtttctggataaatattgtgccttgttttgctggtctgagcacttgccaaattgtggatttcttgacatgggtatttagctctaattatgcttggtccacttgtgcatttgcaaaacatataattatcaggcttttaacaaaatgtcaggcaatttaaatggatggcgttctgttaagaaaataaaaaaaatagctgacatttactgtaagtcaggcatgattgtaagtgccttacacacaatgaggtaataaatgtattatctcatttaatcctctcaacaatccagtcaagttggtactgttattcccactttacagatgagaaaactgaagcacagagaggatcagtaacttgctttggttcacaaagccagtgagtgagtgggtttctttctttctttttttttttttgagacggagtcacccaggctggagtgcagtggcatgatctcggctcactgcaacctccaactcctgggttcaagcgattctcctgcctcagcctccggagtagctgggactacaggtgcttgccaccacgcccggctaattttttttttctatttttagtaaagacggggttttaccatgttagccaggatggtgtggatctactgacctcgtgatccacctgcctttgcctcccagagtgctgggattacaggtgtgagccactgcatccagcctagaattgggtttcttaccagacattccaaatcatggctctactcttacctgctgtgccatatttcattcctttaaaattgtatattattccactaaaaacatgttagtagtataattctaaaaccaaattgaaatggaaatcaacctcagtcaagtgaaaaaaaatttttaactccttgacttaaaataaatttcagcataaattcaatgtccttcatcccagcaaagtttgactagagtgtttctgttccatttaaacacacgatcaagtgcgacggtttaggaatcatgttttttagaaggagaagggaaacaagttgaaatctacagaacactttttctcatacatatattggaggaaagtaggaagaatttcctttgatctcataaaccccattaactcctgtgtatcagtgctactgggggggaatgtcagagccattaaattcctcagagggatttaatgcacgacagtctagaagaggatcttggagagtgtccccaaagaagaatgacttagaaatgtcacagaaggcattagaagatagagtttcaggattcacagttgctcagtgtcactagattctgtatacatgcaaagagaaataatggtgaaatccaggtgtttaatttggtggggtgatgggccatggtggccttcggaagccatttcactggcctgtaagcacaagggtctgaaaaaacgcaggcagctgctaactcaggaaacatttgttgtggcaccagcacattctagtaaatatttttttcgggacagaaaagctatgtgaatgttctaaagcctatggaaaggaaactactgaataggtaaaaaataaatgtcactatcttgagaatatatgccaaaaatcatatgaatatcaatgatgtgataaatctcaatagcatcttttcttttaaattaaacctttttacaaaaggaagaactggaagtgctgcttgggtttccatctgtcggatttgggccataaaacagagttttaaaacaatgtaagcgggtacgtgagagttacacctacagctggggctgagagacgtgggttgtgggaaagctggcttgtgcagtctaaccctttcccttgcctccccatcaccatccttcctttcactatcctgggtgcatcttggtaagctagcctattttccattcctgttcatccgtattaagtatctaaaatgcttgctaataaggattaagatgagaacttgccctaaggtatgtacatgtttaacagcacctctctgaccacaaggcaggccgttaaaggtctgtatccagcagaaagacctgtcttgtcacttagtttttcttcacaactctttatgtacccagagcttgggtccaaggaaatatcctggtttaaggagtgagattgggatcaacattttaaaaaaatatttgatatgtttccccaaatgtcccaatattatttattgattaacccattaatttttttagagatttgaaatgtcacctctatatccccagacatgtctgtgtcaactcgcaaacccactattctgcttcacaattcatcagtcaactcgtgcccttgtcccagtctttgaatttctgcagctttacagtatgtttattttttaattttttaattttaattttaattttttttgaagcggagtctcactttgtcgcccaggctggagtgcggtggcgcaatctcggctcactgcaaggtccgcctctcaggttcacgccattcttctgcctcagcctcctgagtagctgggactacaggcgctcaccaccgcgcccggctaattttttgtatttttagagacggggtttcaccgtgttatccaggatggtctcgatctcctgaccttgtgatccgcccgccttggcctccctacagtatgttttaatacatcataaggctagtttattcttttttttttccacaatctttctggctatttctgcatgtttattttttttccgtgttttacaatcaactcaactatttctactccctgccatctctcaaaaaacccttgcttgtgttttcactgggttgtgtttaaattatgtattaatttaggaggaattggtatcttgataatatcaagcttttctattcattaatttgggccttcttctaaagttgtttaaggttatctacatatagaagaaacctgttaagtttaatccatattaagggttttgtgggttttgtcataaagtgggttttgtcataaataaagtgacatcttcattttatattctaactgggtgttattcatatatacaaaagccattttttaacacctaatcactttactgaattcactctcacttggtagtatattttcagtcaatgatgtcatctgcaaagagttagttgttagagggcagaaaagacattccactatcaggtagtcacttcagttgcatccttaagcagccacagacacctagagtgatgatagctgtcatatctatgtatttttgatgaaattcttgttttttacttttacttgtaaaatggttcaaccttgcagaaaattatcaaacatgaacatacctatcatccatacttaacagatactttttgccgtattagtgtcagatccctcctttttaaacaaaaaaaaatatataaaacacttcagattacccaaagtccttccaccctcagcccttcttcctcctcttctccagagtacctgctccgctgaagttggcatctctttattcttgtgctaactactgcagatacatatatggagctttagtatttttaaaatgtatgcaagttgtatgcaaatttttaaatgtcttcctgatttcaaagtaataaatatatgctcagaatgaaaattctaacctttatagaaattatgggacagaaacttaaagggcttcataataatctccttaagaaagccactgttgataataaggtatatcatttttctgcctttgatgttatgttgcgtatagtagaaccaaacactgacctgcttaacaaagaatgccctccagagaagaaaaaaacaatcagaatatgtatttaccatcatatcctgttctctactagtagttctttattttgttaaaaacaagaaaagaaagaaatctcaacaaaggttactaggaccttaagtggatttcaacagaggaacccatcactgtttacacttcaagcaacagacttatatagatttgattcagttgaagcacctgataggagctgctgcttgcacaaagcagacgccttgatgagcagctggtaaacttggagcacatataagacaatcaaaggaagtctccatataaacttctccatgcaaggaaagatggtttttccatttgcccttttctgagcactttaacttcctcattacatgttccaaattgtttcagagactatataaaccatatgtttgttaaacgatagagacaaacatggggaagtctgattagcatcagcttccctcaggaagggggtttctttcccaaccctgtttagcctgctccatacttattggacatggggtaaataagcagagatgggaaacgggctttaaacagctgcacctggctatagagtttctgctcctctttctactgaagcactactgttaaatggaattgtttctttttatagtagatttcctaaaagagcagtaaggaaggtgtaaagacctacattatttattgcataatgcagaagtttactggcctagacgaagtaatgatattggatattgggtgatagtaaattactttaaaaacaaacaaaaaggccaacatgtttcctgcattttgttttggacccagaagtccagtgggccaagttccttgttcaggcatattcaatgacacaactatgcagatgtgtggaaataaacacttgaggtgaaatcatatagctgtgattagggcagccacagtttatcattcaaactggacatttgagaggactacaggcataaactgagcccagcagccatcctgggtcttaatcagtggcattgtagttgtcattgcttaagagaacaattaataaacattttaaaaaagtatctacttctgtctttatcccccaaagacaagaaattaaagcatttatgactgaaaattgaaaaagaagctggctgggtgtggtggatcaggcctgtaatcccagcactttgggaggccgattacttgaggtcaagagttccagaccagcatggccaacatggtgaaaccctgtctctactaaaaatacaaaaattaaccaggcatggtggtgcatgcctgtaatcccagctacacgggaggctgaggcaggagaatcacttaaacctggcaggcggaggttgcagtgagctgagagtgcaccactgcactccagcctgggtgacagagtgagactccgtcacacacacacacacacacacacacacacacacacttaactagtttattcatattagcttatattcattttctgtgaacccttggttttgaattctattgggatgacttgataggtgaaaccactttatgttgacaacattttcgaatttgagtcatctcaaatgatgactttatagcatattcatttctttgacttttatttctttggaaatacctacaacgcctacacacatgtcattgtttagggccttaccccatgttcacaatattaggttgcttccatttctctttctgaagcagaattgtttttaaacagaaacaggtgcctttgactaacaggttttttaacttgtaaattggaccaaaagagtaatcataaggggcagagagaaaatagtaacaaagaagcctcagttcatcctctttttctcttgtttttgatgctgttgttgttgaggttttgttatgtttgctgttttatcctggttttggtttttatcctgagtcctatgctgttcaatgcatgtctgatatagtatctatacaacatgataaacttgttctgtgttgctaaaaattgactgctttgtttctagtaaacatagtcttttaaaaaatgaccgtatttgtttgtaaagcgtattattcaccttcctctttttataaacatcatgtctactttgataagtctcattttggatgtgagaaatatttgacatatccaagtgtgggtgtgctggtctgtaggcagtctcaggagaactttggagataatcgtgccacacaatcttttaattaatacagattactatcctaggaacaattaggcttgatcagaaggcaatattttgcttttatagataactgcatttgctgttttttgagggcagaatctatcaaaccaaattttagaaaagattataaagtttttcaaggagcatgacaaaagagtggttgacaggtagatgtccattctgaggaaaataaattccaggaaatcttgagcaaagtggcctgttctgaaattcctcctagtgtactggactaggcacaaggagttttcttttctctaagctcccctgacatcattcatttgcatttattattaaatgaggtaattattcgatattcctagcgtatattagaatttattgcatattcatccacttatgtgacagttatttattgagcactctcatgttcactcgcaagggtgcaggtgcagagtagaggaaaagctgtatgtcaccaggttcgggatttgccaggcaaatacaatcaaggagatgaatgtgtatgcaagatgtgatttaactgggtaccaagaaatgcaagctagctaatttaatatgcatgaacaagaggacatgagggaattaagggggggaggcggaaggttgtagagtcaatgggttgtaagaactggtgagttaaataatggttggtgttgaggattagaggaggtgagttggaaagaaaggccatgctggttagagagtggtatgtttgacactgggattacagagagtttgtagttgatggtaatgacaaggactaaggtataaccatggatttgtggctgaagtagggcagaaaacaagatcatcggaggagagtaaagtcggggaattgagggtacagggtaatggaaagatcctttacaggagacttcaagaaagaagtagtgttggggacttgatgtaaatgaccgagagagagagggagagagagagagagagagagagagagagagagagagagtgtgtgtgtgtgtgtgtgtgtgtgtgtgtgtgtgtgtgtgtatgaagaagtattgttggagagagacagagagccagcagtgaaactcaagggagaggatcggaaacgatccaggggtctatagatgactgtagttatgagttagagactgatgccatgagcttcaaagctgatgatgtttcaggaggaggaagtgatcattgtatagaagcaggaataaaaagcaagcaggcagagagctctcaggagacgccttgttctctagggagagccaggtttcttttaaggcaagaatgtgaagggagggttcagagacgaggccaagtatttagaagactttactagtttcttaaatgagggaattgcattcccagagggtacagtggaaggggttcaggaaccagctgaggagtggaaaaaagtggggccagattgggcatgttcacagtgcgatgggaatgggagtgcaggagaaagaaggatattggggttcctgagcctaagcaggaatggagggcataatgagattagtcctggtggtttgtgaaacaggtggtgaggctctgagtgtgggacacaaggatgggttgggtgtcttgccagaagcaagcagacctctggggctcttctcttcaatgcatggtcatttggagatggggggtttggggggtgaggtcttgttacccagagcatgagtagaaggctcctccttcattctgcaaatagagatgtggaagctggggaggtacacctgctggagcatgaccaagatgcatgtaaggatgcaaggatcacttattataacagttccaggatgatgtcaatacttgagatgcaatttagtgtgttacatccataaaaatagtaattaggtttaattggagggggttacattgattcataatcagtagatagaattcaaattccaattcatagtttaaaataagtcattctttccctctccttcctgcccactccttgctgtttccaccaaaatgtgcctcgaaaactgacaatgtcagtcttatctgctgaataattgacgtgttcttttccctttcctttacagtgaagaaagttacaacgtcaatgattattccttaagagatcagctattggtggaatcttgtgacaatgaagagcttaattcttctccagggaagaacagctccacaatgctctattcaagacagagctctgccagtcagtcacctctttactctgacagtccttagtaaccacgcgaatgagaaagtggagatgctactaggagctgagacgcagtaagtatatgtggggaaaagattggaatagctgatagtatctccctgacctgattttctttggtttacagacttcctaaaaacagcagctactattcatgtttttgttgagcacctactgttcgctaagcactatgactgggtaatttttacagatgttgttcttttcattgtaatcttcttacaggagaaggatgttgttattttttccctataagtcctgatagatgcactgtgctttaggtgatgtctttatttttatagagtggtttaaaaatcattttacttttttcattgacaaaaatatgatacactatccttaaggaatatgactcaactggtattttgagtctaggccataagccttcttaggtaatggaattcaggtcgtttctcagtcacctaccttcaaccagagagcagaaagcccaatgatttctgtcaaaagagctacccagtttacggaaatatactgataaatcctctttctaatccagagtttatgcacgaccaaaacaggcgtcctgttggtgcctgcagtttcgccagcagttagtgtgcacttagttctcacattggatgagtggcagtgagggttaactttcaagtccaccttagtgattttttggtccacttaaagatgactgaccaatgtttttgtttagaaactggaaacttcctcttgcaataatcatcatgggcagatattatattgggtcagagagtggaacagtggagggaaaggagaagttccctaattctttgtcctctcagattcctgcctccaactccatgtctgccagggttcctaaatggtgtggttaaaatggatcagcagctgatgaataacaaccctaaaattgtagcaagatcttagagaaagtgatcccaaagaggtatcttcaccttaagactgattttaacagtgttcctagatgattaacgagaatattcaagaaaagttattgaaggacacttgctaaagcgcagtaagcttcgcagcctttatgcaaggtcatcttaacaggcgtaaggaccattgcagcaacgtctccagtaggggagagagattgggctcaacttccaacacagcatgggcaagtgggaattcatagccatagggcaggatggaggtcagtggatggaaacttactgagaggaaatatcagagataagggctattctggctaaactaaccaaacaggattcttgctgaagacaggccagggtaattagacatcataacctctgggatgatggagaataatgaatcttatcagatattgaggatggggtaggggatattcttgccaaattgacttagtagggttctttgctaaaactggattttacgaagaactgtacagatgagcctaggagaaggtacagaaatctaactgaagtttggccaagccaagaatctttgtcaagagacataagaaaaatgtgaaaattacaaggcacccacataaaatgtcaaattatttcatatcttttggcactagaagtagcatttcacaggctagagaaaaaaccaaggacaggttggtgaaagctgtagcatattccaaatgagctggagagttcaccaaggtaatgaaaaaagaaatatatttcataaggctacagctaccatagacagtggttcctctgatggatctgggcaaagtaaattaaaagccttctggaaaagattcaccatcgtagatgtcattaaaaacattcataatttcatgggaggagatcaacatatcaacatgaacaggagttgggaaaagttgattccaactctcatggatgactttgaggggttcaagacttcagcggaggaagcaactgcagatgcaatggaaatagcgagagaactagatttagaaatggagactgaagatgcaactgaattgctgcaatctcataataaaacttgaacaaatgaggagttgcttcttcaggatgagcaaagaaagtgaagttgctgtgagcattgtggaaatgacaacaaaggatttagaatattccgtaaactgaattgataaagcagtggcaaagtttgagacgattgactccaattttgcaagaagttctgcagaggataaaatactatcaaacagcattgcatgctatacagaaatctttcatgaatgaaagagtcaattgatgcagcaaacttcactgtggtcttaagaaacggccacagccacccaaaccttcagcaaccatcaccctagtcagcagccatcaaaaaaaaaagggagcttcatcttcatgtgtttgtttacaaaacaaacaaatgcctttctctgagatcccagagttcttcccctaaaggtgctgaaaagcgctgatggcattccaagcatgcccctctgtgtttgcggctgtggggaggtgagcttgggtgggcgtgtgcttgctgatctgtgaggtgaccagcaagtgacacacccaagaccagggtcaaggggaggcattacttgaactccaaaagtggtttaaacctcttggccagtgaggacaaactagacttcctttgtgtggggaaacttctcctcaaaacagaatttttagtatgcctgtgctttggattttatatgactttaaggatgagaatgactttaacactttggaaatcagtaattttccagtgttccagagaattctcagaaactagagacttccctttccccgtatagttagtaatggtgaaagtgttgctggttttgccttgtgttttccttttctttggtttacaaggattgtttgttctttattcaggccttgccaacatctcaacagagattttcctgactgtctcattcataatttatgtagtctccaccactcatttctgagatgattccaagagagtaggaggtgaactgacatgtccagcttatttcacgccaaggctagatcctttcctgggacattctgtagcatttgttccatccttttgccttttaatcttgccaaagactgaatggttgttcgtttcctcaatcagacatgttctcagaatatttagtcatgtcacttggaaacccataggtctgactcatatttgtagttatttaattaatagcaagagaacattccagaaggggcatgggacagaggtctccttgggtacagagggagtgactctctcattctctttgctctccccacccccaccctcaattacagttgagaagtaaataaatggacatgctttcaagacataaaatagtattggtgttgaaaaaatatatttaacaactaaagacgcactttccttaaaaataaaaaagactattaaaaaacctggcaaattgttacatgccatgtttgcaaatatgcaggttagctttgggctaccgagttttgagcaattagagttttgatatgcatagaatgtgttattttcttccaacatttgtgaaatgcatcaataagtatatattgtttaggttttctttcttttatgtctttttggttaatatggttcattggcaatctagttgaaaaaacaaggtttgcactaccattctagccttaagtaattgaagaacttagagtcaggtatataatttcactacttactctttgacctgaaaaataatgaattttacacctaaatctttactttctttgaaaaactgttgtcactaaaggccacctgaggatatacaacatgtaaaatcagcagtaggaggggtgcagctgtttggcacaaggacaattcaacttcataagacagtgaaattgtggaagaaaaatcaatggctttgattacgtaaagaatgcagaaatgctcaccaaaaggagttggggcaaacagtgagcatctgggatatgccaggcactgagccagctatagaacatgacgaagggacccatgggtgtttctagaggaggacagaattttgagctgaagaaagcatatagggaagtgatcagacatcttggttttcccagaatcagttgttcaagtttgggtccgttgtcctggtgaaattatgaatgatactctttttgactctcaaaaggtcctcgtttatacaatgaaatatatggtgaccctaattatatataattataatattacataaaacaaaatattatcaataacaaattataaatatatacacatatttataattatatacatggtccaactctctcattttcttcccccatgtgaagtgactcacaaaggccatacaggaagtgagttattgccaaagctggaactagaatctggccttcctgacagtctagcagtctttctagtaacaaattttattctttttacggagaagctgccaaccagtaggctgttccacccccactttgctgctcagtttggcttgttctggatttggaaggaaacctccaggaagtcagtcgctattaactgtgagaaactactaaaatatagaattttttaagtccaaagactttattattttttattttattttattaagacagagtttcactctgtcgccggggctggagtgcagtggcacgatctcggctcactgcaacctccccttcacgggttcaagtgattctcctgcctcagcctctcaaagagctgggattacaggtgcttatcaccatgcttggctaatttttttattgttagtagagacggggtttcaccatgttggccaggctggtctcaaaactcctgacctcaagtgatttgcctgcctcagcttccaaaagtgccaggattacaggcgtgagccattgtgcccggcctcaatccgtaggctttaaaaaggaaaaaagattgtggaaacctagatgttaaatttaggatatcatatgggttagaatattttatgataaaatgctaaatagatattgcatccccaaaattattttccatgttaaacttccttttttgttcctttgcctgtgtttttcatacttcctggaatgccctcttcaggcctcctcagatggccagatggctcctcttagggcccatgtcaagcctttcctctgctgaggagcctctcagtactgcacactgcagtctcatcttgagaatgcccagtgctcgctgtgtgtgccactcattagttcacttttcccctcatgttttctgtctcacccaccctccactgtatgactccaaactcccagcctcctgctacatccttcctttcctttacagaacttctcaagagagtggccttcatttctccagattaattcagtggatttttgtcaggcacctacttcccatcaagtgttattctcagtgctgggatgtagcagtgaaccatacggagatcagatctctgctcttaggcttatatccaagtgaagaaccgatccccttgggcttcctgctcttaggaagggtgactttggatggaagggagctttggccagtctgcctgggcaaatggtctgcaatgagctaggatgatgggaaagtatttcttcatgatccagttaaaaataaaggatcatttcaggtagtggtaagtgcagtgaagaccctaaagctggtgatgtgatccggagtgagtgctaattggggggtggtgaggataggtactctaacttaggtggtgcagaaagacctctcttaagaggtgatatttgagccttgagtgaaaaggaggagtcaacccttaggaaaatgcagagtcagaatgtttcagccaaagggaacagcaggtgcaaaacctctaaggaaacgaatttagtgttctcaaacttggcttgaacatggagaatgtggctggagcagaataaaccagggagaggggtggcagtcaatgggcaacaaagtccagtttgtcttcagagctaccccagtgctgtctgtgggccatcagtcctcaagtagttaccagcctggtatgtaggaagcagtttgacatttctgaggcatcaaaacttgtgattattttaacaattaatttatttttactgtatttctaaaaatgcttggtctgcaatggattcaaggggtggagactggttctctaccagagatatctcgagaaacactgatttagaaccacataagccatagcaggaagttccaggaacaacaggggccctggggacagaagtttcagtggggcaaacaataagaaccctaaccctaatcctgttggagtagtcgaggggagtcccgatgttggcttggaccgtgatatgtaggaggagatagaaatgttatattttggagacaaaaacaacaggaccaactgatggattggatgagttgaggtggcagtaagtggaagagaggaatcgatgatatttagatttttggcgtgagctgctggcgtgagctgctagcttgagttgtttcttaatcaaggtaggggtacgtgcagtgagttgttagctagttgagttgtttcttaatcaaccttggcgtgacttcttcctctggcaccctgttgaggcctctccatcagattaacaggcttcctagtttcacacccagcagtccaatcttcctttctttacctctagtatcatttagttttattgaccatccagctctttcatgctaaccctttttttgagattatgtttttctcagcctcttatctatgctcttagtttgcctctcacacctatgaccattcctcttctctgtctcttcagaaatgcagcctgtccaaaaccaaacatcaacactgcccgtggctttccccgacacacacatttctgtaaatggtactattgacactcttttgcgttatccagtctggagacttggtgctgtttttgatgcttctgtgtcagaacagatccatcacctgccagttcttcctgtgtaaaagtctatttcatctttccccatctttccattccactgcctccttcctaggtcaaccacatggcttttgaactaccccaatggcctcctagccattctcctctcccatcaatacagtagttttatcactaatccctaagctcagctctagttttgtcctttccttgctttgtacatagcgagtaggttcccaataaatatttttgggattgacccataattattataactagcttttctctatctgagacaaggtagaagagtaaccaggtgtggagaaaaactgcttcctgtctctatttactgccctttttgttactgctggagcaggtttttcccaaattttacttgtttttcaattttttgctattaaggattcagtcaaatgttttttaggatgtacgtcgaagtcatgtatactgtgttatatctgtttgtccatgacaggccctaagtcatggtatcgtcaatgagacaatactctgtgaaaaatacagaagtctaccctttataaaaggacaaaggaagaatgttttaccactgtcattcttttttccctctgggcctttcaagaggaatgtgggagccagagagccccctttgtctgccttcattaaaatgaagcacagacagctgcagctggcacacacaacaggctgtggcaagtggagtccttggcttcctgcatttgcagtaaaatttagatgtcatttgggtgtagtgtataccgtcatgaaacatctaggacatgttcagtgatgaacacaaactttcctcactcattatatgtcagttataggatatgatgaccttagcccataatcaaatatccttctcaaaatttctccctcacagagctagaagcataatgaatgtggttggtgctgtcaaccatccagacaccaattcctgggcctcctgataaaggggcattgtttgcagggagtctttgagcttttcctgcttctgttaatgatttaattaacaacaggaagtacatggaatggaataaaattgtaaatagtatctctgacatagtcatatacttcatccttttagaaaaatcacaacataaagacagtatacatggaaacattttatttattgtagggtatagcatttttttccttgttaaatctaaattctaagtccagtcataatcttacatttatctagtgcctgtcaaaggatctgatcttaatgtggtcctcatcaccaaccccaataggacaagaggtcttttatcagcaggaaaacatcattgacccgcttcaggttaactgaaggactctggaccagattttttaggtctgagctaatgtaatatgataaacaagaaataattgatttaactatatagcatgtgacaaaaatctaaattttagaactcttagtgggctagggatattattttgcttcagttagattttttaaaatttggcaaattgaactgatatctagttttttaaggcctggtctcagcatttttaatgactttttttcacgctatggggctttctttcatggatcagttttctgaactaatctagttgaattgagtttgtgagggaatgaacagaaacaactatcttcacaatcctattctttacaaaggttcgaaggactttagagaaatcaaaaggaaccacaggtaaatgtgtaggctgtaaaaagaaacacaaaaggtaactggtcaaatgccactttgggagggataaaaggaaggttaaagagcaactaagggctatttttttctattgagaaatcagaaaaccctgttagtgatggagtcctcagccaatgttctgttctgtgcagcctcacctgcagccctgtctctgtgatttcaaagcctacttcctactttctcagtatgtatctatgttttgtagctgatgcctggtattccataagaagtgagactttgctgtatctttgaccttcatgcaattaagttaaacctactgtgcataatgaattatatgagagacaggacaaggtgctaccatagctgataggaaactgtagaaacatcatttcatgccatgcatggagaacttgagggttatgaaaagactacatttatagacatttaagttaaaagagtctcttttcaatttagtcgtctttctctacgtaggtcaaatgttttggtagagtgttccatttcagcacactgcatgctgtattggattttgtgagtgttttctgctctgtgtgttccctcatactgagggcggtaaaaagcaagggactccagtgtatttgctgtgcacctctccaagctagcccagggcctgtgcaaagtgaatgtgggtagaggaaggagtggtaaggcgagtcttcaaagttgatatgccacagatgggattcagtgcagcattgcttactcttgtcactttgtgcaaagggaaaagtctgtgaactggctgtgtggtagattgtgaattcatctcaattgttttatatcgatacgtccctggagaaaatagatgtctgtgagtgagccctagacttcatgtctaaatttaatcgtgggtaagtctatgccctggtttttcctgtccctagaatccatcttataacaacttagttcctgctttagagatgtagtactttctgcttcatagctgggggagctccttagcaggctctttttttttgagacggagttttgctcttgtcgcctaggctggagtgcaatggtgcactcttggctcaccgcaacctccgcctcccaggttgaagcaattctctgcctcagcctcctgagtagctgggattacaggcgtgcaccaccacgcccagctaattttgtatttttagcagagatggggtttctccatgttggtcaggctggtctcgaactcctgacctcaggtgatccctgcctcggcctccaaaagtgctgggattacaagtgtgagccgccccgcccggcctcttggcagactcttgaaagccccaggggaagtcctgtggatttgacagcatctaagaggggggggtgggactcactcaattgaaagtctcaaaaagctgctccttttagtgatagcaacaaggagtgtcttgttctatcctctggagtccctgtgaggggtggccatgtctaagagatgctattagcatccaggcagcatgccacagaagtgaaagatttcatctggacttctggaaactggctgtagggcaaagccactgctgatactggccactcagtgccagagacggtgtctgtgtacaggaagatctgcctcactggctccaagttgctctaaattgctccagaagacagcagtataggctatgtataatttgtttcagtatggcatagagagacacaaatggatcattttagatttctcttggtgagcaacacttctattcatgaggtattttgttttcgattggctttgtactttgcaaattccacttgagcctgtgtaaaaaatagatcttattcccaataaagacatcatagcaaagatacaagtgtttgcctgggaattattttacatgaagttgtgctttgcttatttcttacagaactattgtaaagccctttgtcctgtattagagagagagagagagagagaggttttaaaagcaagacaggagccttggcttctatataaattgtgcatattactacttgacacaccatcttgatcaaggcccagcctcatcttaatctttgaaaatgcctgtctttcaagataccacagtttccacccttcctgccttccatcattattttgtaaacacctgctgcgtaacaccacctctttgatttcagactgcctgggttaggtgcttaacataccagacttgctttgtcctctgaaaaaaatagaaataattttggtaatattttcttttcaagattgttgtaaaaattagattagatgatacttgcaattgtttagtaccatacctgacacataggtgcttcagaatattatttagaacaaggcccaattcctgccattctggagtttatagcctggtaagagaagcagatgagtcagtaaatgattgggctcaatatgtgatgagttatataattcattcattagcagacatatactgagcccctgttacgtgttgggcaatgttgtagagataatgcagtgaaccaaatggataagctgcctgcttttatgaggcttactgttgaccagcaatataatagaattgtgcagaggggtgccctagaaacaggattatcagactgggatggagatggaaggattggtttatgtatcagaggagcccccactggaggaagtgagccttgtgttttcagcattgagtggatatatgttgagcaaaagaagccaaatacaaaagcatacatactaaaggatttcatttgcaaaaagtacaaaagaagcatggtaatagaaattccatggtaatggaaaacaagagcagtcacctttggacagaggttattgattggaaagggtcagaatggaaatgcctggcgcatctgtgtcttggtaagtaaacacagagctgtacacgcttatgattaactcagtttatgttatgtatgttaagaaattttaatggcaataatgagtgggcttatctacgcaaaaacagggaaggaataggaaaggctggggcaagggtgctatgttccaatgcggtaagtcatcctctctgcctgggttggaaggatgcatatggggatgaaggtggggtgacagcgacaagcatctgtagattcaggctgctatgagagaagagtttttttccccaggtgttggtcatgaaggcattttttcttaagaatgtagagtggcacagtagaaactgactttggtttgaattgcttgcctctgaacttctgtctgatcttagcatccttcagatgggcttttgagaggattacatggaatagtggatgttgagtgcagtgtctgacatgtagcatgtgtttaataaatacataagagagttaaaagtatgtgtgtggcggggcagtatttaattaattgtaattttaatacttggtgctcaaaataaaaaaccagggtgactgcattatgtagagaagtgcttgcttatctgaaacttttgatcctttagttgaataattatttttatgtaattatagcttaatattatattaaaagtattggtcatttttcctgtgctcattaaaccattttaagcatttgggaacagtgtaaaagtggccaaagaatttctatttcagtaagactcatatttggcaaaattagttgtatgagggatgagacaactaaatatgtcaagtttctcaagtttacggaaaggtttgagtgtgtgggaagggaagtggggaggaagcagagaaattagtaggatttttaaaaaatgaaacttaactgcttttgaaatgttaaacatcaaattatgggtatgctaaataccttttggagttataatgtgttcgtgtaatcagctccttattaacttttaaactgtcatatgggaagttccttttaatcaataatgagccaagttcattcagactcttttgacaatgatgactagtctcctgcttattttagactttccagcttatcacttttaaactactctcaccctgttttaccatacctctctagagaatctcttgttttctgggagtgcctttgcattggctgcctagaaaacactccattctgtgtttttacaccttgagtctctcagttggatctgccctctgttttaggagcgagcgagcccgctggataactgccctgggacacagcagcgggaagccgcctgcagaccgaacctgtaagttctctcaaggggaagcccacttgggaacatggatgggctctgccccctgctggacgccgggttactaacgagttatattgccacaatacttgcctaagtttcctccagggcttccttctgctttacaccaaaaatgtatgatccttgctttggaagtcagggggtctgaattcaaatccaaggtgcatttctttgttgtgtaaacgtgtcaaatcattgcttagcattgcagagcctatttaaccatctgcaagtcagttacaccattatatacaacatggggttattgtgaagattaagttaaataatctatgttaaaagccctacttgaactgtaaagcccttaaatttttagctattatcagtgggcaacagttgatcatgtttaaaccttctacatactgacagtctggatttaagctgaaaagtatttttaatctaaaagaaaattacctaagaattctttttgaccttctaagaaagtgtgtttcactattctagagaattagaaactggcgcagtgaaggggggtgttgtatgcctattagcttcctaactttgatgctgtggtttcttagattattacagttgcaaggtcaaatccaaagaattagaacaaaacattgttatcctggaacactcaaaaattatagctttaagcttagattaaaagccaaaatgactggtttgaaagttcccggaaatcaagctttgtattaaaaagcaaattaagaagtcacatgtcagcattttgtttgtttgttttgagatggagtctcgctctggtgctatctcagctcactgcaagctccgtctcctgggttcataccattctcctgcctcagcctcccaagtagctgagactacaggcgcccgccaccatgcccagctaattttttgtatttttagtagagacggggtttcaccgtgttagccaggatggtcccaatctcctgacctcgtgatccgcctgcctcggcctcccaaagtgctgggattacaggcgtgagccaccgtgcccggccacatgtcagcatttctgaggaggtctaacatgacttctcagcttttggttggagctcattttatttctaaacttttttttggaaactttcatgtgctgctgttgggatggggagacactctgatgagagccaggagaactgtgtctgttgcagattttgcatggccttggcacatcagcaactctttcatgtctcagtttccctaatgcagagtggctgttttctgttccattgtgtgacatgactaatgactcctgatcaacctgttattgaggggaatcatgcatcataaaaggcctctcaaatctgagcttctaaaattctaaagcttatagccaagcaagggagttgctagaaaagatgttctgctttttattagaagcccaacttgtttctctcaatgctggccctgaattgcagagaaaaataagtaagtgtacattattggattgcacatgttttttctctgctactggaaacttagtatgtcctcttttggcctcagcactgacccaggtggaaatcgttaggtcatttactgctaagcagccagatgaactctccctgcaggtggctgacgtcgtcctcatctatcaacgtgtcagcgatggtgagtgggagcgttcttatgggacactcgtggtccaggatgcagagtgctatagacccgaggagtgtcattttgtcatcattgcccatattccaaatcttgacatgttaatgtttgagatcacatatatgtactgtcttctcatctctaaggctaaaccatgacgttttcttttttccccagtccctcagtgacccagttcttatctctaaatattcgtcctttcaaaaatagcattcttcctgctatcctttacccaaagcatctcctttcccagctcagcccaggttcaaatactctcagccttctcacttcagggcctctgctcacgttctttccctgccatgtcattcattccccctcgaaagctttccctgtcccactttctcttctcaccgtagcacttagcctggggagggatgctgcctctcagctttttcatatccttggagcctggcacactccaaatacttgttgtttggtgtggactctgttctttttcacaggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaatt

SEQ ID NO: 38750 - DNA, 17227 bp, Homo sapiens
agagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcagcgcgggcacccccgcggcccctcccctgggcgcgcgcgcgacctgggtgccatggcggcagcggcggtgacaggccagcggcctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtgaggacctccctgccccgccgcgctccaggccctgcacggctgagcccgagaggaccggcgctcagcccgggtccccacgctgcccccggcgctgctctgcgtcggtcccgcgcgctcccactcactcgcctgctgtcgctctccgggccggggcgacttggcccttcttgggcagcgcggtctggcgccccagctgcccgctgtgcgccttttccttaggtggggcacgagcgtaaggtccagctggtcaccgacagggatcacttcatccgaaccctcagcctcaagccgctgctcttcggtaagtccgccagatactcctgggaagggccaggggctgcggtttggtggccaccttgaggctcgttgtgaccacgtgacctctattttgaaaatggctgcttcagagcagcccttccagaggattaccaaagtgaaggaccttccccgtcctcgaaatagggtaacactccctcttatcccaactccctgcagtccattcttccatcacagggctggcagggtgagcctgaggctggtgtctaaacgtttcattgcacctgtcttccgtgccaccattaattctgtcaccttctagaactgggaggaaggtgggagactgataaccagctttctgccgacctcaggacctctggggaaaatcccactgccgaagtgggccttgtggtctgatgagaagcaggccgtccaaatgtagataaactggtacccccccagcctcctccactggagtaccagtcagaggctcagcttttgctgccagcactctgagattcttcttaaggtgaagtctttgttcagccatcatgggcaaagctttctagggtgactccagttggagccacaacatagctcatcgtttctgagctctagttatgtgcttgccttcatatgattatttcatttaattcctgcaacccctctgtgaagtgggtgtagatcctactcaggccagtgagggggaaagttagggacagagagctgctgtggcttggccaggctgacacggttacttcagtggtgaagctaggattagaacccacatagcctgcctctaaggcctatgcagtaaagccacagtgcgagctgtgaagaccccagagtccttcaaagaccaccagtgtcaactgggtggggacccctagtcccatggacattgtccagggtgtttgtgtagcccagccctgggtacctggcctccgtgacaaacatatttgcaaacccagggccattcctgcctgccgggggatggaatgggttaggagctggggccaaagtagaacatctgagcacaagtcattacctccaaggcagagggtcctggttggggattatgcctagacctgtcagaatgatgtcatatgcatgctgtttgtagggaaatagattatgctgtcagtcctgttgtgggagaggcacccaaagctggttgttgttattattactattactattgagtaacgttgaagtctgtgccaggcactattttaggtgccaggaacacagcattgaactaaatataaacaatgaaacaaaaccctgaagctgacattcaaatgaagaggaaacagacaataaacaaacaaataaatatatacattggtgtgtcagatggtgatatgtgattgcaaacaagtaaggcagattttttttcttttttcttttttgccaacataaaatagcagacagggccgggcgtggtggctcatgtctataatcccagcactttgggaggctgaggcaggcagatcacttcaggtcaggaatttgaggccagcctgaccaacatggtgaaatctcatctctactaaaaatacaaaaattagccgggtgtggtggtgtacacctgtaatcccagctgttcaagaggctgaggcatgagaattacttgaacccaggaggcagaggttgcagtgagccaagatcgcaccactgcattccagcctgggcaacagagagagacccctatctcaaagaaaaaaaaaaatagcagacagtaaggcagaagttcagctgggattagaactctttttttttttttttttttttagactaagtttctctcttgttgtccaggctggaatgcaatggtatgatctcagctcactgcaacctccgccttccgggttcaagtgattctcctgcctcagcctcccaagtagctgggattacaggcatgcgccaccacatccggctaattttttgcatttttagtagagacgggctttcaccgtgttagccaggatggtctcaatctcatgacctcaggtgatctgccctcctcagcctcccaaagtgctgggattacaggtgtgaaccaccatgcctggctggaacccttaataaggtagccaaggtggacctgcctgaaaaaaatatttgagcaaggctgggcgcggtggctcacgcctgtaatcccagaactttgggaggtcgaggcgggtggatcacctgaggtcaggttgttcgggaccagcctgaccaacatgggggaaccccgtctactaaaaatacaacattagcagggcgttgtggcacatgcctgtaatcccagctacttgggaggctgaggcaggagaatcgcttgaacccaggaggcaggggttgtggtgagccaagattgtgccattgcatccagcctgggtaacaagaatgaaactccatctcaaaaaaaaaaaaaaaaaatctgagcaacgacttgtgggaagtatgggataaagccagatgactgtcaggaaagaggggtccaggaaggaactaatactcaccccattactactacactactaacgactactatgaacagacacatctgaggaggcactgttttctctcagcagccttcctgggatctgtatatatctaattcatattgatgttaggttaagtaagccatgaagccaaagtctccctaataaacagcttgtcctataaagcagagaatgagccgggcttggtggttcatgcttctaatcccagcactttgggaggctgaggcgggtggatcacttgaggtcaggagttcgaaaccagcctgaccaacatggtgaaaccccgtctctactaaaaatacaaaaattagctgggcatggtggtggatgcctgtaatcccagctattcgggaggctgaggcaggagaattgcttgaacccgggaggcagaggttgcagtgagccaagatcgtgccactgtactccagcctgggtgacagtgagactccatcacaaaaaaaaaaaaaaaaaaaaagcatagaatgagaaacccagatctaaagtcaccaagggcaaattatgaaaagcagaagagatttgacaaaaggtaaactggttctggttaagccatcagatggatctctgtttctgcagatgaacttcaaaaggcataaccaagagattgcaatcaatgattacaggaagtccagatgtgtgagagggaagagggtggtcatggtggggcagttcctgaatactgtggtattggatgactacaaagaaggatgcctcatccccagcaggagcagtgtctgtcttctgggcctgcctgtccctctgtccattggtctgctacccagttattctaaatgggcaagcagggcccaagaagagtggacctgctatagattctgccccctctgccatgctgttcttggatctaaacctgtgacctgccagcttcagggacccaagatacctgggatcgaagagtggatgctaaagatgtgagctggggcaagggaactggggtccaccccaaggtgcctccatctctgtagaagggaaccctagcacttctcaaggaagaccccgtgcagcccccagtctctccttgagaaatatttcctgtttcccacccttgtttctaaagacacttggcaactgggacctgggccacaaaaggcccacgcttgagctcctggcaaatacttccatgactggtaggtcattttcccttggtagggaaataaaggatttggaatattgggtgtcagctgagggcaccatcctgttcagaacagaagtgctccatttctgaaccattgccacctctctggggacattgctttcttacatgtggcccacttctcccgctgtcctaccccaccccacactgattctgtcatagcagatcagatctcatggctctctctttttgttttgttttgttttgttttgtttttgttttgagatggagtttcacttttgttgccccggctggagtgcaatggtaccatctcggctcactgcaacctccgcctcccgggttcaagtgattctcctgcctcaaccttccaaacagccggaactacaggcacccgccaccacacctggctaattttttgtatttttagtagagatggggtttcaccatgttggccaggctggtctcaaactcctgacctcaggtgacccacccaccttggcctcccaaagtgctgggattacagacatgagccaccgtgcccagccgctcatcactctcttaaatgtctccaacattttccatttcacttctaagtctcatttgatgcctaaaagccctctcgcctcttagactcatctcctgcccccacccccgactccatttactccctgctgatcctcagacaccacaagctcactactgcctcagggcctttgtatgtactattccctcactaaaaggcttagacctggctcttcccacagagcgtgccttcagctccagcaggcctctgctcacacatcccatcctcagagacctcttgtcctcaaacccatcttaaaaggttcccaggcaccctgttgcatcagcctgctgggttttgttctcaaatgcttaggactgctggaaactattttccgtatttatttgtgtcatttgtacctctgcccacaaaggtgagctgcatatgtaagaggactgatttgtctcagctgtgtgtccaatggccagagttgtatctcctgctgatttttttttttcttttgagatggagtctcgctctgttgcccaggctggagtgcagtggtgtgatctcggctcactgcaacctccgcctcctgggctcaagccattctcctcctgcctgagcctcctgagtagctgaaattacaggcgcctgccaccatgcccagctaatttttgtatttttaccagaggcagcgtttcaccatgttggccaggctggtctcgaactcctgacctcaagtaatccgcctgcctcagcctcccaaagtgctgggattacaggcataagcctccgtgcccagcctcccgctaattcttggctggctggaggagttcactgggtgctctcagcccagtccagcatctgcctgctggcttagagcatcctccacgtatccttctgacttggcaccctcttcaaaggcagcagggggtactaccagtggccagcaagagttttaatccatttttcttaacaatttgaggtaaatgagtaattgccaccagtatacaaaacaatttattttaaaatcatgactgctttatcttaggatttctaaatgtattctttttcagcttaagaaaacaattaggcagctacatcagaccatagtcctcctcatgacaaacactggaggcccaaaagtagagaaacaattttagtgtgcgtatcagttcaaggttgttgttttgttttgttttgttttttgagacggaatctcgctctatggccaggctggagtgcagtgtggtgcgatcttggcccactgcaacctccgcctcccgggttcaagcaattctcctgcctcagcctcccatgtagctgggactacaggtgcgtaccatctcgactcactgcaacctccgcttcctgggttcaagtgattctcctgccttagcgttccgaatagctggaaatacaggcacccgccaccacgcccagctaatttttgtatttttagtagagatggggtttcaccatgttggctaggatggtctcaatctcttgacctcgtgatccgcctgcctcagcctcccgaagtgctgggattacaggtgtgagccactgcgcctggctagttcgagtttttaaggaatttagctcaggctgctgcattgccacacacacccctgctctttcataggcctgctgcttggcaaagctacggaccggtaaaggttaatcaggtataattaagtctgtccggggttcgacaaacagcatcttgtccaaggtgagcatagcccaaggctatgtgcctgcccggagactcagcttggggttccgaggcatgtgggcagtagtagcaggccactagccaggctgtcatcctaggcctgggaaggacagaaggtggttttccctacccagcatagacagctgcctgggagcctgtctgtcctcttggccagacagaggactacctgctcaaaaagcagttcctagctgtgtccatggaaagtgtacttccaccctgtttgagacttgtgcctctctggattctggtttgtaaatctccttggggggcggcagaaagagggttgtatgtgtttccatggaagcacacacaatttgcatggccactgcagaggccatggctacaaagtcccaggctctccctggcggggttagcccctattcttggcactggtgagggtgccaatggcgcacagccagtcgaaaattttggtggccctggctccaggcataggccgtggttaccaacagccagcaggcctccatcttcccactcaacacataggtccctgtgtgccttcctcgaaaaagattgtacacacatgtgacatccagctgcagccagcgttgcagggtgggctccagctctgcagggggcagtggtcctgtcttcagcacctctagtctggagtacaggttgcagtcccaggggccagaggaagtactgttggtcctggagaacctgaccttcactgctgagtgggaacagaggggccggtgaggagatgggcctctaggagtcctccctaaacccccaagagtgtttagtccatcagtcccctccacctagtagactaaacccttttgtctgatgctctgcccttagaatcagtctgccaccttccttagcagaatttttggtttcattttgttgttttagcaatgtcctatgcttgtaaaggaattttttctttttgttccaaccaggcatagcatttggatattccctcttacactgcctcagccccgagccaggagctgcaatggaggcacttggaaggggtgtgtaaagctacaggcccaggactcatcaaagtcactggtgcagagagtgtccagaacctccttggaggagcctgcatcctgcaactcgcagtccctgcagctggcatgcagcgctgggaagaggggcaaggcgaggcactggccagtgtggttgggggtggagtgaggagggggtggagggggctgatccctccacttttcccccttttttaccctttttgagacggatgcctgctgtaggtgacattgagtacagtttacctgatccctgtatgatttgaatgatttgaaaggggtggggccgagcaaggtggagaccagccatgtgcagactcacatgggcggtccaggcgggagccgttgttggccacagcagtgatacagagatcatggcccaaggggaagcgtccacaatgcaggatggctggccaggggtagctgtagcaggccatgatgggctcgcagctggcctgcatggcctcgcacaggctgtaggaggggtagatgaccctttgggggaaagggtcgggggctgcaccgccacaggctgagcacccagatcagctggaacctctccatgttcctacccctgtctcgtggcctggaactctctggttgctgggcaacgacactggtcgcctagcaacagccccgtagcctggctttcccacttgccccacatctcagccctcagctctgcctcttcactcccgccctcccactcaggtgccttgccagctttccagtgcacctctccctccggctctgtggacatccattgtctgcaagaggtggcctgcaccttgggcctttactctccatcttaaagtgaggaaacagggccctccctcttgtcctgaaaggccttcggggcaccgcagccagggctggggttggcaaacagttcaagggcttgatcctgagttctgctgacatggccacccagaggctcttgggagaaaccattgttcacaggataggttaggctggggaagaggaaacagccttgggatctctggactctctgggagaaaaggccaccagaagggcctctgctccatctcttgccagggtctctttggacagacatagcttccacgcctcattggagaggaggttccagcccgcctgcccccaacccccagcctgaagcgacttgtccacctgccctatcttgacattcaagagcccttgaccaccattgatggtctcctgcctaagggcacctggttccctctgtctggaacactctaacaaaacgatccattttcctctctgtgcctgtcagcgcccagccctgataggtgctcaggtgctcagcaaggattactgaagacctgagccaccagagcagggccctgagggagccctccagggccctgcacctggaagcccctgtcctacctgtcaaggcatacaggggtaaatagcagaggaagaggcgggcatcggggtggcactcccaggcaagcaggagcagccagctgaccaactgctggatggcctcagctgctgtgatgtggtccagcaagttgggcagacgcatctgtgtagccaatgtcgtggcatagggccatggcttggggaatgggcatgcacctcatgcagccccagggagcccctgaccctgctgtcatcccacagcatcaccagtgtcaccagcagccacagcccctgctccatcactgccttctgtgccttggccttaatgaactgaggttgagggttttatagggctgttcctgcacccagggagccaacagaggagatcctgcaggggtttgcacagctccgaggtgcccggacccacctggtgaggccccaacatgctgactgggctgtttgtttttgattagcacacagcaggggactgtagaggctggaggcacctccactgggcttgcagattactggcacctaataaactgaagaaacctgggcctgtgttttcttttctttttctggcttcctttttctttctttttaaattttgtgtgttaagcaatcaagaggtgactctgttgatttgcaatttgatctaatccattgttccacagggctgtctccccttggatcacaccctttctgggtttgctggggtcacgggatcatgcaggccaagagtgggggcctttgtcctatcctcagtgttatcacatcagggtcacctgctcctagtagctgaatctggtcatgagcatggtttctggaacacagcaggctgggtggccagtggcaaggcactgatttctctgtgcttgggtttcctcttagataggaaggttgaattaatggggcctggcctcctagggtaagtataaggattaaggagttgatgtgtatgaagtgcttaggacagtgccttgggcagagtctgtgctacctaagtattttctgctgtaattactattaaaaaccactccaggccaggtgtggtggcatatgcttataatcccagcacttttgagcccgaggtggaaggatagcttgaacccaggaaattgagaccagcctgggcaatatagggagactccatctctacaaaaaataaaaaaataaaaaaagctccaaccctggtgctgagtgaccattttccttcctcttggcaatgactggaactttgtgctggaagtgtaactgagagaagcggcaggccactccgcaggtagcagtgctgcccttcctccagtcagctcctctgcgtgcttcttgtcctccagtgaagaccgctctcccaggaacaagggaaggaagcagggcccatgctcctgctctggaagtgtctggggctaccagaatgtgggctccctagatgtgaggctcaggttctagctccaccaagccacctaccagctgtgcctggtgtgcaggcagccagccactgaagccaagccccaggcctgactgatctttactcaggggtgtagaggcatagagtaggcactaagtgaacatttgtaccagggaaggaatcaaggaagcaaaggacacctgggacatcttttcagagaccagtatctgcccaaaacctgagtaaccctcactgatcttccagcactgggcaactcagccctggtcagatggccagcacccatctttgcaggaaattggaggggaaggcccttggactggcctgaaacattggatgtcttgtgctgtttttatttgaataatgctgaaaagttaaaatgaaagcaagaagcagccaccatctccccactttaaatatttatacccagtaaaaagtagcaatcaagcctctgcccttcaggatcactctctagccttcagtcccaacccaaagatgggtcagcccatatccaggttagctctggctcacctcccagggctctcctggaaaatgtgtgctctcatcatcaagagaggtcccacatttccaacgccagccagcctttgcaggacaactcaatcttgacaagtcagaatcaaggggtctgtaaaatcctccatcctccagacctggtggccactgagggacatgcagtaccccaggaaccctgaagggaggaaggtactgggtgcaccagcgccctggctcagtccttggcctcacccacctcctcttctggcagaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttggaatcctgggacctgagtaggctcagggtgggagtgcccagaatcacctttctggtggccaggtcacttgtccagcccaggcctggtcccaaaagtcagatactacccagacctgcctgggcatgcccagacccaggaggtcccctttccctctggagagctcttggctaccctgggaacctcagaagatggcaggagaatccacctgggggtgatggcatttatcaccatagttttggagggatgcacctctgtagcctgcattccttgctctcatggctgggggccccacagaactcatggtggatggggtggcagctctgaggtggccagcagcctgcctctctctctgcataactctcacacactctacagccaggctggagggccaagcttctgagagaagtctggcagggtggtggtgcggggcactgcccacacagaacaccccactgagcctggtctttctgagggatctggtggtcatgccctaaccaggtctccccctggtgcctgttctcccttaacacccaggacttggctttccccatctcacccggagtatctgagtgggacacaggcctgtccttcactctgcttccaaccaacagtgctctccatgaaggccacggggccttagtccgggaatgcaaatggcctacgcctcttgacccccagcccccggccttctcctcagatgctctgtacctttctacctgcactcactttggcccaatgggctctgccctgtgtcctcatccatgccctcacctgaacactttgctccacaacaagcactgggccatctgttctctgctggctctccatcactggggtcacccactgagggaccctcttatgctttaggttctggcccagactcgcctgggaaatggatggtggatgactccagagagcattcaggagatgtacgccgcgatcaaggctgaccctgatggtgacggtgagctcacacctctgcacagtcctatccccgtgagcctcctgcccactcccaggtgcacaattttgaaaacttgggcccttcccccacagccaggcagcctctctgcacccctttatagtggccagagatggggaggtgaagatccagccttgctttttacccctgggaagtaggcaggcagccaggccccccgttccccttggtgatggtctcgagggcagttcttggagacccttttgataacatcaggcagagttgagagcctggggacaggaagtagggctgctagttggcagagaacagagtgggtggagcaggagcaaggcgacagtgaggccagctagagcttggctgtttaccctgctccatccatctctccagccagacacgaggtccaccccagcagacagcttccctggtctaagtgagatctcccttgccttcctcttgtccacctggagtcatgccgaagcgcctaaaatggtagtgctgctacctgtgctaactgctggggaggggtgggcagggaagctgtcatgcaagtggtgccccctctggtaataactctcaggaggtttctgaggtgtggtcatcaccctcatgcccaaattctggaccaagagaggaagatacagcagttagaaaggacttggaacagtggctttgcggctggtgaaccagagtgaagaatctggccgtgacctgtggctggatggctgccacactgctataggccccagaacagaggtggtgacagtctcacagcccttgaatgtcccccaccctcagaggaatctgggccaaagagtggaaggtgatgtccttgggtcagccagaataacatggagcaaagataccaactactcttccagaaccccaagagggtagaacccctgcttaatggtttgagcagggacagtggagaatgttctcatgagagggggtggcctgactttcgttgctaaggtgggctggtaacgcagtaggcagggctggcgaagtaggttccacccaggatgaaacctggggtcatgaggaactccccgggggctggccctgcttgcaccctggcgtatgtatgtaaggccctggatgaggcccagcactgcctgctctctcctcaccctccacaggccggagagtggccaccactctatatagccaggctggaaggccagggtcctggccatatggctcaagcttcctttggagaaccttctctggccactctaatagggggtgggcctctttcttcttagggccaaattagggcttaaactgagaaaaggaactgctctgggtcttcctgtaaggcctgatgtgacagaaaccaggttcatctgacccaaaagtccaggtgggggacaagtgtacaaggcccctcagtgcctgaggtcaggggctgctgctgcctttggggtaggtagggaagtgcagcctgccactgttgcctcccaatatgggcttggtgggcattgatggtgggtgccctgtgcaggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagaggtgagcacctgaagctgttctcactggagcagggggagaagactgggcagggcctccacagaagtccttgtctggggccaagaggacagaatggattaacccatttgggattaagttccatttgttagaccaggattgggacccactgaaagacaggcaattaacaaaggcaaattagccctccttgcaggcacacaatgggcaactggggttagatagagattgagcacttctttctgattagataaatgacctcttatctttgaccccttatctgaccccgtcacagcaggaaaagggtttttaaataaacaactttcttccagggaggaggacctcaggactccccgccccctttatttagtggaaatgtcaacatttccacatagcaggtgtctctgtctttggcatctgagggagaaggatcatcatgagtaaccccctcctgctcttacagggccagtctgagatggcttaagggacttccaggggaggtgggtaggggcaaagcttgtggcaggcctagggtccaccttggccagctccttcagatcaccaccttgcctggggctgcccagccaaatgcctgctgcccaccagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggttagtgatgccctcacctctccccacaagttgtttacccaatggctggaaaggggtggctactggtcatcgtgaccactggagtcaacacagactgatgtacccacagacaccaaaacttgccccctgagttctgaagcaaggggcaaggctgggcccctagcttgtcctgcccattcctccaggtgttgatcttgattccacttagagaagctgaagctgtgcctccctcccctgtcaagccagttctttcctcttcaggtggctgttctggcccagccccttcccatccccaaggagcccttcagcgcgccctgttgcttctgctagcctacctttccctgccaggcccttgctcagggccatggcatttaactaagtgcacctgtgatcttggccaaaaaaccattgcaactcacagtaagagactgggtttcggggaaggaggggctagggacattttggcactggcctgccctattgtctcccatcctagtctgtcctggtccctggcaacaggaacctgggcagcttatcctgcccacaggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatggtaagggtcaactgggctattactcttgtgggctggcaggggcttagacaagtgaagtacacacctctccaggtctaaggatgtgggcccaaattattccttgggcatatctggttggtttccctttggtcacccttggctggcctggccatagagtggggacaggttgaacaccccaccaccctgctgcccacagagtctgattcaggatgacgtggacctccgtgacacacggaggcactgtgacaagggaaacctgcgtgtcaagccccaacagggcacagcagtcttctggtacaactacctgcctgatgggcaaggtgagggcctatggccaggcctggggggggtgccctgagtacagcttccctttacccagcccccgtctgccacaatggagggctgtttctggctgctttccaaatagttttctgctcctggtgcctcccaaaggccatccttagtgactttagcagactgccccaggacctgtactgcttattgggttatatccatccctatcattccctgatgccccagccttcctactccctggggcttgggacacatgtcccttgctaacccaggatgggaagggatatggacaggcccaacagcaagaaagctggtttcagagggccagtagtgttgactatacattagtgggctgagatgaggagcctccaaggaagctttaggtctgggtgtttgctacacaaggaatgcatagctggacccaccttggtcatgctcttggtgcctatgaggccaagctctggccagcccagcctaggatctcacgtcaccctcctcttctaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggcccgacaaac

SEQ ID NO: 38751 - DNA, 103000 bp, Homo sapiens
agagccgcgagctggaccagccgtggtgagtgcagcggcgcccaggcggggagcgcagtgcgggtcgctgggactgagcgcgcgagcggggtgggagtcgggatgggggcccggggcgctgggcggagcctctggagtcgcgctgggccgagagccgcggggacccaagcatcaggggtcgtgggtgcaggcggcggcgcggcttgagggtagggggtgcgggcctggccggcgcggcaggggagggcctcgcgcggatcccgtggtcacggcgggagtcagctgtcctgggttcgagtcccagagctgtcgctaacttgtggacccccctcacttcgtcccttgggcttcagcatagccctttgcaaaatggggccaatagtatcagatccattgatgggttggttggttcattcattctggcgctttactaggttctggtgctgcagatggatagacgaacttgcccatgaggggttcactatctagtaagaaaaacatttccacctggatactccacaggcgtgtcaaattcagtatctcctaaaccgcactacttttctccacaaacctaccactcaaatctaaatgactgaaatcactattcaaccagtcacccaagcacaaaaacctggcttggttcctcctctctcacttactacagtcaatggaccaccaactgctgccaatttctactttctaaagctttccaaatccatcctttatcttggtttgttcttttaggagcctacagattatggcaataacttcctaatggttctctttagctttaattttagcttcttccagttcatttttcattctgctataaagtggtcttttaacagttcaaatatgattatatcactcacctgcttaaagcccattaaaggtttttcattgtcttcaaaataatagccaaagtccttagtgtgggttcaaggtcttttctaatcccacctggtcttcaatcctttatctctaaaccactgtttctcaaagtctggtatagtggtgacctccattgcaaccaacatgggagtacttgttaacaagtgaagatgacagcttaattccagaacaaatgagactcttgcgggaaggggcagttcccaggattctgtgtttttaacaagttctgcactaaaggttgagaacccctgttctagacactccaatttttactccgctgttgatgagattcaggacacactgccgcaaaatatgactcgttggcattagaggaaacaactgaagcaggaaagtcactttgtgtcttcccacttttctcccctgaagcaggccataaaagaattgtttgaccttcttctgtataagacccttcagtgagaggtgctcatcctgtaagtataggatcgaggaaaggaatgcccttatctttgaagacacaggtacacagagaagaatcagaacaaataggccttgctaaattctccccagcgtattactgttagatcataccccctttttccagtctcagccatgaacctaattctcccctcaactatctacgtatgtttctctcaacacactttactgtcttttatgcctttgtacactctcagtttgggctactgtaaaaaaaaaatagcaaaaactgggtggcttaaacaacagaaatttaattctcacagttccggaggctggaagtccaaagttaaggtgccagcatggttgagtgcatggtgatagctctcttcctcggtttgtagagatctgtcttcttgctgtatcctcacaatgcagagagaccatctctgtagtgtctagtctcataaggacactaatccctttcatgggagccactcttatgacccaattatctcccgaaggctctatctcctaataccatctcaatggggatagggcttccacatcaccatttttggggaacacagcattcagacaatagcatccacaaaactccttcgttactttagtgatttcctcctcattattcaaggctcagggaagacttcattgactgtgcaccaccccctcagccctagaccaggttaggttcattcttgcagactctcacaaagccttgtgctgactcctcgacatttatcccactgtactgcaatcataattgtataattgtgttagcattgtgggtttgacagttgtgagcacttgagagaacgcatgagacccattcttctctgccctcacccccagcacagagcctaccatataggtgtttattaaagggctcttgaatgaaggagtgatttagggccagatggagaggagttcaagaattagttgggcctttggaatcatgtgtcagcctgacggtgtatgggattcacaggaagatggtctccctggcactggcttcactgctgcttttgataaggatgtttctacccttgagaggaattttaaccaatgggatttaaagggagtcataaaagaactggacttttaagtggaaacagttttttttttcttggtctatatacctcactaacagatagtcataaaaaaattttgcttaaatttttgtttatctagaaaataagttcattttcaaaaacttagaaagtacattgcaattttaaaaataaacatcacccaccattccacaacctagagggatctactttaaaatttcgtttttgagccaggtgcagtggctcacgtctgtaatcccagcaatttggatggccaaggcgggaggattgcttgaggccaggagtttgagaccagcctgggcaacatagtgagaccttgtctctaacaaaaaaaggaaagaaaaaaattagccaagtgtagtggtatgtgcctgtggtcccagctacttgggaggctgaggcaggagatttgtttgggcccagaagttatagtgagctatgattgtgccactggactccatcctaggtgacagagtgagaccctgtctaaaaaaaaaaaaaaaaaaattgtttttgtttaattgtattggttttctttttaaatttatactcatgtttgaacataattggtataatgccaattatatatggctttttatcctgctaattttacttaacattatgttttgggttttttcccccatcagtaaaaattttgggtaaaaaaatatttaattgctatttaacttattcattgaacaaatatttcttaaacagctattgtgtgccggatcttactttaggcatgggatacagcagtgaccagaattatgtccttactctcatggagtttacattccagtaggattaggctaataaatgagcaaatgaatataagcatcaccaaataataaatgtcatgaagaataaagatattctatagtgtcactctgttttttagtaaagtcttcctaatttaccttctttaaaggagtgtatgagtgtctatcattttgttatgtcatcagtgaatatgatcatttaaaaatttattttggtcaataatgatagttctttgtaatatgcatgtctgattattcaggaagttgaacatttttagatagccatgtacattgcctcttcattgagttttctatccatgttttctgtttcttttcctattgaggacctggtattttcttctattttgaactcgcccttcatattattattttttgggacacttacattatgatggatagacaaatgtatactcttaaacagtggtacagtgaggctgtaaggagttagaaaaaccagaggaagcctggaattcccttcctctctttctgcccctccctcttccttctattgcaatgaagaaatagtgatcagagagggaagaagtataggttaggtggaaatacgtgaaggaagaaagaaaggtggatggatgtgtgggtggatgagaagatgaagatgatggaaatagaagggagaagatgagctgaggccagaggagaagtggtaaggaggaagaggagtgagtgggaaaaaaaggagtgagagaggataaaagaatggaagacagagtaatagggacattacatgaagaccatggataaattatatttttttctctttccgcctctactaacctagcaaatctctagaagatgacggtgttctttaaaacgcttcgaaatcactggaagaaaactacagctgggctctgcctgctgacctggggaggccattggctctatggaaaacactggtaactatctgacagccccatcccacctttgcatctgcagcaaaacagccccaaagggcctcaggttaaaatcttgctcagctgtgcttatccctataaaacatgtggtgtaaaagaaaaataaatgctattcaaagcaaaaacaaagacttcttgtaaccagagctggaactacatgcatacttatatccagtggttagagaataaagtagagacatcagaaaggaagctatttttattcattatatttatagtggaagagattaagacatcttagagaaagagaagtcctttcccaagttagtagtgtgaacccccaaaatctgagacaggtcttagtcaatttagtaagtttattttgccaaagttaaggacgtgcgcctgcgacacagcctcaggaagttctgatgacacgtgcccaaggtggtctgagcgcagcttggttttatacattttagggagatatgacacatcaatcaatatacgtaagatgaacattggttttggtctggaaaggtgggacaacttgaaacaaaggcaagacaactggaagtaggaagggagcttccaggtcataggtagataagagacaaatggttgcattcttttgagtttctgattggcctctctaaagtaggcaatcagatatgtatttatgtcagtgagcagaggggtgactttgaatagaatgggaggcggtggggcgcagtggctcatgcctgtaactccagcactatgggaggctgaggcaggtggatcatttgaggtcaggagaccagcctggccaacatggtgaaacccatcactactaaaaatacaaagattagctaggcagtagtggcgtgcacctgtagtcccagctactcgggaggctgaggcaggagaatcgcttgagcctgggaggtggaggttgtggtgatcccagatcgggccactgcactctagcctgggtgagggagtgagaccctgtctcaaaaaaaaaaaaaaaaataaagaatgggaggcatgtttgccccaagcagttcccagcttgactgtttttctttagcttagtgattttggggccccaagatttatttttcctttcacagtagtaagcaagtactggaactcatgtctccctggcattttattccttccatttcttactatagtctcttgatctgtcatcaagggacacttactgaatttgttcctccatcccctgttactatcctcatctgtcccattagcctacattaatttaaatgagaagtagactttcaaaccttttgtttaaataaagaattcagaggagtcatggattttattagtcttcctgcatggagggagaagaaagtgccagagctcctcttttagtttaatatggtaataagatttaaataaacagagaagtttttttgtataaaaattatacaaaagacagccaatcaaattgcagtcttttggagattaaggactacattttaagtatgtagcaacactgaaatccagatgtcttaaatgactgctttgttgaacagaaaacagaacagttactctttgaattagaagtctccacattggaaaagagattcatattgatattttgtgaacactcaattcaccactgtgagaataactttatgatataacatgatgtctgctttttttgcagctgtggaaaaattgcaatacattccccttcttttctttctaagtgttgtcaaggccaggcattcaaattccattagccagcatctaaggaaaaaagcagacataagaagcttaaaatttgtaattaagaaaagggtggagcggatattttaacaaatggagcatggaatgtttggcttctcctttttctaactacacttgagtcctcaaggcccctttgctggagcatccaatctaggccatggctaggtcagtcggggaaaattcccacccactgaggattactgctgtttctacgactaggtgaagatttgaggaactgtgtactctgttcaggatgtctttagaggaaccatgataagttcttgcccatgtagccttgagaccttaaaaaaggaccattaagtcttcaggactaatggaggccttgttctaaattggatctgaaacagcttgagccagaagtgtggtggcagcctggaggcctcattttgctctgtcttcacccttgacattcaatgttactgccccaaatgcaaactcttgttgtcctattgcttttctttttctcagactgttctcttgcatgatttggtactatttagcctttttaaaaaattgtggtgaaaaaacacaggacataaacattttcaccttaaccatttgtaaatctgcagttcgatggtgttaagtatattcacattgttgttcaacagatctctagaactttttcatcttgcaaaactgaaactctgtacccattgaacaactgcccattcccgccccaacccagctgtccttgacaaccactattctactttctgtttctaggaatttgaccactttatactttgtgtcagtgagtcatatagtatttgtatttttgtggttggcttatttcacttataatgtctataatgtttatattatctttaccttttcttttttttttgagacggagtcctgctctgtcacctaggctagagtgtagtggtgtgatcttggctcactgcaacctctgcctccgaggttcaagtgattctcttgcctcagcctcccaagcagctgggactacaggcgcgtgcaccatgcctggctaatttttccatttttagtagagatggttttttttttttttaaccatgttggcccgctggtctcgaactcctgacctcaggtgatctgcccgccttggcctctgaaagtgctgggattacaggtgtgagccactgcgcctggcctatattatctctaaatgtaaagatatattctttacgtttaaagaggtatggtctttacatctgtcaatggacattttggttgcttttacctcttgactattgtgaaacatgctataattaacttgagtgtacagatacctcttggagatcctgtttttaattattttggatatatgcccagaagtggggattgctagatcatatggtagtctatttttaattttttgaagagctttcatactgttttccattgtggctcatcattttacaatcccacaaacggtgtacaaggttttcagtttctccacgccctcatcaacacttgttattttctgtttctttgatatgggctatccttatgagtgtgaggtgatatgtcattgtggttttggtttgcatttttctaatgattaaggaagtcaagcatcttttcacatgcatgttggccatttaaaaatctttggagaaatgtctgttcaagtcctttttccatttttaattgagttttgttgttgttggcctgtaggagttctttatggattccagatattaatcccttgtgagatatagaattttcaatatattgtctcctattctgtagctggcctttttacactattgatcatgtcctttgatatatattgtttttagtttcgttaaggcccatttgtctacttttgcttttgtttgcctctgcttttggtgttatattcaagaaatcattgctaaatccagtgtcatgaagcttttccctatgttttcttctaggagttttatattgggtcttacatttaggtctttaacagattttgagttaattttttttatatggtataagataggggttcagcttcattattttccatatggatatctagtttttccattaccatttgttgaagagactgtcatttccccattgcgtggtcttggcatccctattgaagatcatttgaccatatagatgaggatttatttctgggctttctgttgttcattagtctatatatctgtatttatgccaataccacactgttttgattactattgctttgtaatatattttaaatttagtacatataagacttccatccttgttctttttcaagattgttttggatgtttggggatttcttgagattccatatgaattttgggatgttttttctatttttgcaaaaaatgccattgggattgcattgaatctgtacattgttttgtagaatagacatttgaacaatattaagtcttctaatttatgaacacgggatgtctttttattgtactctttaatttctttcagcagtgttttgtttttagcgtataagtcttttacctacttgcttaagtttattcctaagtattttattcttttgatgcaattgttaatgggattgtgttcttaatttccttttcagattgttcattcttaggatatagaaatataactgatttttgtgtgttgtgtatcctacaactttgctgaatttattagttctaacagcttttttttttggtgtagaatctttagggtttctacatataagatatgtcatctgtgaatagagataattttacttcttcctttccagtttggatgcctttatttctttttcttgcctcattgctctggctagaacttcctgtgctatgttgagtagaagtgatgagtggacatctttgtcttattcctgatcttagaagaaaaacttccagtatttcaaaattgggtatgatgttagctgtgggctcatcataaatgacctttattatgctgtgatacttttccttttgttgccctccctccgtttttttttttgcctatatatccccaaccttttcacagaacagtgctcacattctttataccaaacttgtttttaccctgagaagatcttaccctgtagtcttcttgagtggaagctgccttgtcctttctttcttcttcttcttttttttttcccccatcaggtcattttattattatggtttttacaaattttgttttattttaatagtttttggggaacaggtggtggtttgtggttacatagataagttctttagtggtgatttctgagatattggtgcacccgttacccgagcagcgtacactgtacccagtgtgtagtcttttattcctcaccccactcccacctttccccctgagtccccaaagtcccttatatcattctcatgcctttgtgccctcatagcttagctctcacttataaatgagaatatatgatatttggctttccattcctgagttacttcgcttagagtaatggtctccaactccatccaggttgctgcaagtgccattctttctttttttttttttttttttgagccggagtctcgctctgtcgcccaggctggagtgcagtggcacgatctcggctcactgcaagctccgcctcccggcttcatgccattctgcctcagcctcccaagtagctgggactacaggtgcctgccaccgcacccagctaattttttgtatttttagtagagacggggtttcatcgtgttagccaggatggtctcgatctcctgacctcgtgatccgcccgcctcggcctcccaacatgctgggattacaggcgtgagccaccgcgcccggcccattatttcagtttattttatggctgagtagtattccatggtgtatatataccacattttctttagccacttgttggttgatgggcatttaggttggttccatatttctgcaattgcaaattttgctgctataaacatgcatatgcaagtgtctttttcatataatgacttattttcctttgggtagatacccagtagtgggattgctggatttaatggtagttccgcttttagttatttaaggaatctccatactgttttccatagtggttgtattaatttacattcccaccagcagcgtaagtgttcccttttcaccatatccatgccaacatctgttattttttaattttttaattgtggccattcttgcaggagtaaggtggtatctcattattttttttaatttgcatttccctgatgattagtgatattgagatttttttcatatacttcttggccatctgtatatcttttgagaattgtctattcatgtccttaggccactttttgatggaattattttttttttcttgctgatttgtttgagttcctctgtggtggagtgccagtagggaacaaggacctcttctccaaggccctatgtgatcacagaggctgcctgcctattggggtttaggtgcaactttccctactgtgtccagtgctgcaattttgtctctgctgtgagaaactacccacaagcagaaggatctggaactcaaggcctgctcttcagattcttttgtcccatgaggcgatatcttgatgtggtgctctcctgctcctcctagggatggggcttcctgagaaccaaagtgcagtgattgttactggtcttctggatctagccatccagcagggatagcgggctctaggctggtgctggggaatgtctgaaaagagtcctgtgatgtaatccatattcaggtctctcagccatgggtaccagcacctgctgtggtggaggtggcaggggaatgatgtagactctgtgaggatccttggctatagataggtttagtgtgctggctttcttgaatgctggttatgcaagcggtgaagttgtcacatggatagactcaggacctttggttagccaggatgttgcaggcagtggtattagctgttgttttctccttctcgggagcagtgttactctgtcatgagttgcggtaatgtcctgagttggttggccttcagccaggaggtggcatttgcaagagaacaccagctgcggtagtaatagtgggatttgaacttgccataagttggggcaagtattctggtttctcaggcgatgggtggggccataaagctcccaagagtttctatattttgtgttcagctaccagggctcatagagaaataccttcaggtgggggcagggttaggtgggtctgagctaagactctccttggggagggcttgctgtgaccacagtagggtatggggaggtggttctcaggccagtggggttatgttccagagggcattatggctacttctcttgtgccgtatagttcaccagggaagtaggggataactgatagtgaaaggcctcatccagctcccacgcatttagtgtggctggtctcacttccagagtgctctgctaacagtgccaagtttagatccaggcagcctgtgcgcagaactcagatctgccccaggtcataagcttccccgctgagaaagcaggcaaggctttcaggccatgcttctcgctgtctgctcacaatgttggtggctcctgcaagatatagtcagggatggcatctttgggcttgagctggagactgtgtgcctacaaggttttgcccactgctgcttctacttttttatttcacagagtttcctaaatttgttccagctctaggtaaggttaaatccttctcctatgatctggattttcaaattccccagtggggatgtgtgttcagaggtgggttttcccccctcacactttggggaatcacggtttttcgtctgtcttgcagcatttgcaacagtgtgttgcttctttcaaagcatctgtgaattctttcagttttcctggtacattcctgtggtggttcttggaacaaaagatcacagtgtgattctccacacactgttctgtctgtccaggtgggagatgcaatgcacattagccctgccttttatctgtcatcttgctcccatctctgtcctttcaaatgggatcagggtgtaaggatgttgggattctcctggcccttcagtagctattccaaaccatttatcttccatcttatacatcttccatccttcaagacttttatctggctatccaataaaactataaatcttccagccttctgggatctcagttacattcagcttaggctttggcgcctggcttatcaatgccattttctttctaagtcctgttatcttcccggacaccctgagtgtccatgtggatgacctacctaacaacttgcccccactttccttgacttcttctgtatctgtgactttgacccactactccaccttcttccaacttcacccccttctcattggttgaatgctaaactttatcatcacttgctcctgttccacttctgaaatatggaacttcagtatcccattctgtcattacggccttctattattccagtttttcattccattacttctgctcttcagtgttattaggatttcttgtcccttggctcctctgttttcttcccaatccatcactcttccttgcttttcatctttttcatatcgtagattccttgatccaacacatcatacgttcctcaactccatttttcacatgtcattcctgggctttttaagctctcatttcctctcgttttcacaactaaaggtttgtttctgttgttgttgtgtttagagatgggatctcgctctgtcacccaggctggagtgcagtggtgtgatcataactcactgcagcctcaaaatcctgggctcaagtgatcttcccacttcagccgcctgagaagctgagactatatgtgcatgacagcacaccctgctgattaaaccttttgaataggttctctctgctttcctatctccctctcatgccacatcctctccaattttcattataattattttcaccagttttattttgcattcttcttgaccactgtattagtttgttctcatgcttctaataaagatacctgagactgggtaattttaaaggaaagaggtttaattgactcacagttccacatggctggggaggcctcaggaaacttacagtcatggcaaaaggggaagcaaacacatcctccttcacatgatgacagcaaggagaagtgctgagcaaaaggaggaaagcccctttaaaaaaaccatcagatcttgtgagaactcactcactttcatgagcacagggtggaggtaaccactcccatgattcagttaccttccattgggcccctcccatgacacatggggattatgggaactgtagttcaggatgagatttggtggggacacagccaaaccatataaaccactcagctttagacacagttgactctcctcgaaatgcttcatttctttgtcttttgactcccatattcctgtttttcctcctctgtctctggctgtttcttcttcttctcctttgttacttttttttttgagacagagtttcactcttgttgctcaggctggagtgcaacggcatgatctccactcaccacaacctctgccttctgggttcaagcgattctcctgtctcagcctcctgagtagctgggattacaggcatgtgccaccacacctggctaattttgtatttagtagggacggggtttctccatgttggtcaggctggtcttgaactcccaacctcaggtgatccgccctcctcagcctcccaaagggccgggattaaggtgtgagccaccgtgcccagcctcctttgttactcttctctgcccttctactcagacattagaggagtagttctctaggactctgccctaggccttcttctcacattatattctcttcctgcatgatctaatcactcatgatgtcttcagttaccagcaatatgaagccatatcccagatttttgtctctataaagacctcttttgaattccagacctgtatatacattcagctacttgtctatttggatgcttcacaggtgcctcaaacttaacagatggaaaataaagtaaaaagttttcctgccaaacctgttccttctcagtaattggtaccactcaccatccatctaatttcccaaactaggctaggcttggtggctcacacctgtaatcccagcactttgggaggccgaggcgggcagatcaactaaggtcaggagttcgagaccagcctggccaccatggcaaaaccctatctctactaaaaatacaaaagttagctgggtgtggtggcgcatgcctgtaatcgggaggctgaggcaggagaatctcgtgaacccaggaggcggaggctgcagtgagctgagatcgtaccactgcactgcctgggtgacaaagagagacttcgtctcaaaaaaaaaaaaaaattcccaaactaggaatttaagcatcatcctttatcctccttcattccctgcatccaggtcatacattctaaaggattttgctccctctacatctcttaatgtattgagtttctttatcctgtcctcactgtcttggcttttgtccatactactattgtcgcttgcctgggttcttaataacagcctcctcactgttctggcacctacttttgcctgttcctaatccattttggataccgttgctagagtaatcctttgtaagtacagattgctattgctttgagactcaagcacaatattcttaccagctctacatgtgcttggcccctgcatacatctctagacttgccacattttatactttaacacgtggacctttccgatcttcggaagtgacatgttctttctgtttcaggatttcttggaatgtccttgcacatgttgttctccgcggaacattctgactttctcttcttcctgagacaactatcatttctccaagtctcaaatgttatttctttaagcaagccttctttgtcctctctagtcaggattaggcaatcatcttacattttctccatagtactatgaactcctcctatatattattcattgctattgtgattttctgttgtttgtttcttctgttataagactctacaggcaggggtgctgtttgtcttgctcagtgttgtcctgcaggcccagtacatagaagatacttgacacacattttatttatgaaagatggaacaaacaagagaatgaaaggatgagtgtgcagagggcaaatatcaaccttattgtctgaccattaggaattcacaaacctaggctgttgagtccttctgaaggaaattataccctaaattcataggttactctttcaatttctacaacatttattttgaaatactcatgaatttccttacccgctctatgttctctatacttattcttagacaacctaactcctagttcaaagagaatataaaaaacatgggcagttaccccagagtgcatattgatgttctgtctctctgtctcagtggctgaagctgccatcctcctgttcagcccctctgactctcatcccattgtttcacctcccattggttgtccatttcctcacttgtatctttagtctcagactttcagtttctctctcccctatttgtcagaatcttgctcatacatcttcactcaagtctgcattcccatgtgtttggtgacctgttctcatcttccattgacaccgtcctcagaagtgtacctcacacttgcagtcctacctccattttagaataagcttagtaaaatggcttgtatcccatcatctgattgaacctgctcttgatgaggtcattaatggcctcttagttgttaaattaaagggatacttttcatgccacatttgattttcttggcccatatccttttaggtatctttagatatcttcctgctttgtttgtgccttgaatgttggtgtccctcatgttccattctcattctacacactctgtaagggatcacaaccacacagttgttttcaggtatgatatatggattttggagtcatcatatttttgtagcccaggtactgcttctcttgacattttgtatgaatagaaaacaaatattttttggtaacagatttgtgaaaaattgcatattttaatttctttttatctgaccccttttgattactgctcttagtttgtcttttggtatcagatattatttatttggaggttctattccatttttactgtatttataattttttttctccattgagaattccacccccttctttttctcccttcccccaagtttcaaagaaaaaaaagtctgtgatatttttcccctctgcataatttcccctcagcaggttgcagcagttgacaagagcagcagggactgctctcaactggagaagagcaattgcagaggagaaaatgaccctgtttgctgaaagtaaagacagtttaaggattgctcattcctcttcaactgcttttaccaagctttccagcttccctggggaagattatgttccaggttgttcggtttatcatgtcagcagtttacctgcaatagtctgtcactcatttctggtccttttagtagcaaagagtctgctaataaaaagtagcataagaaaggaggcagtggagtataaaagttgtctctggagttggactgaactgacgcttcctagcagtgtgaccctgtgctctctaagccttaggttcttcatctgtaaaatggggataataataatatctcaatgggtcactgaaggattgattaagtgatataactggaaagctgttagcatcctgtctgctagatttaagggttgaataaatgctagtaattgtgagtaaacttgatataatacatactcagccctgtggaagttaaaaccaagtgctgctggtgactgggttgtgagtgacttgagagactgccagtgggaagggagatgtggatctgccaggtggtctaaggtctgagccttttatttatttcgcctttcatatgtaacaagacagcttggaaaagtatagtttcaagactgacccaacataactacaaaagaggcctgccatacatggttaaaagcagcaagccgtgtcggaagccttttccatctgatttgggctcagattattcctgcatcactggggaccttgtcctcgctcttcccagctctggtctgtctccgcatgattttggctggtgagctttggcacaactccccaactaactcccttggctgagcagttaacaatagcttggctcctgcttagttctggcacatggttctcagtttactcctttggctcagtgcttctgacaccagttctgctacccacctcagcctgtgacccagggccatcccatttctttctttctttttttttttttttgagacacagtctcactctgtcacccaggctggagtgcagtgacacgatcttggctcactgcaacctccacctcccaggttcaagcaattctcttgcctcagcctcctgagtagctgggactacatgtgtgtgccaccatgtccggctaatttttttttgtatttttagtagagatggggtttcaccatgttggccaggctggtcttgaactcctaacctcaagtgatccaccctcctcagcctcccagagtgctgggattacaggcatgagccaccacgcctggcacctcccatttatttctatggagcatctagcttctcagcttaggatcctggtactttcctggagattttaaaatcccacagacaccataaattccttgacattaagcttgcaaagcaagtgtgctactgtagcaatggtcctggtccttgtgtttaagggttttaattaatactggagttttctttctccaaacataggaacattaattttgattactgtatattggcttttctaagcattggtgcaagccacctttcaagttctatggtcaaaaacagtttcttagaagtagtaaaattaaatggttatgagtttgcctgaggggtgtgttcagtgtcattcgattttactgagaacgtactactaataataatgataggctgggcgtggtggctcacacctatagtcccagcactttgggaggccgaggcgggcacatcacgaggtcaggagatcaagaccatcctggccaacatggtgaaaccccgtctttaatgaaaatacaaaaattagccgggtgtggcggtgtgcgcctgtagtcccagctactcaggaggttgaggcaggagaattgtttgaacccgggaggtggaggctacagtgagctgagatcatgccactgcactccagcctgggcaacagagcaggactctgtctcaaaaataaaataaaataataataataatagctaatacttaatcagtgattgccatgtgcgaggcacagttctgagcactttacatttattaactcatttcatcttccttataactctatgagatggttattaatctcatactcatgtgagattaatagccctatatagatgaagaaacttaggggcagcaagatgaagtaatttgctcaaggtcacacagctggtatcagagccatcatacaaagccagatagtcctgatcctaacctctcaaaatggccactgtgtcttaggagcgtgagagagatgaagaactgtaagctgagattaccttctgtcataaaatccatttggaataagagaaattgttataccacaatgcttcagagtgtgagcttctgagccagtggagtctgggtttaagtcttgcctttgccactttctggatgtgtgacgttgggcaagttatttaacttgttaaacttcacttttatttacctgtgcaatatgtcacaatattatcgtgatgctaatcactgctcctggcacatattaaaaatagtacctattttaggccaggcgcagtggctcacacctgtaatcccaacactttgggaggctgaggcaggcggatcacgaggtcaggagtttgagaccagcctggccaacataaggaagccgcgtctctactaaaaatacaacaaattagctgggcatggtggtgggcacctgtaattccagctactcgggaggctgaggcagcagaatcacttcaacccgggaggcggaggttgcagtgagccgagatcacgccattgcactccagcctgggtgacagagtgagaccctgtcaaaaaaaattacctatttttattagagatgtataaggcactactatgtgctatgttctgttcgaggggtacaaagtacatgttaaggatgtctaaagaaaaaaattaatttaaaaaactttttattatgaaaatcttatgcatataaaaattagagaatagtataatgaatccccaagtaacatttactgagctatagcagatatcaatatttcactaattttgtttcatctatgtcctctacttttttttttttgtttttactggagtagtttaaagtaaacccagatattatatcattttacccataaatattgcagtaccttactccaataggaagggacctaaaaaaaaatcacactgtcaatgtgattatcatgaacttgaaaaaaacaaaaattcttttatctaatattcagtctgtgtttctatttttcttattgtctccacattgttttactgtacattttgttcaaatcagtatcaaaatgagtttctgtctcttaagtctcttaaagtataactcctcttcttttgataatatttacatgttttagaaactaggtctacgtttgccctgtagaatttttcataccctcgactgggcagatagcttctgcatagctgtgcagagccatatgggagcctgaggcaagaagaaaaaccagtgatactggccctgactttatttaaaattgtgttattatattcattataacttttttgcattcatttttgattttggaaaatacctattaaaatatttatctccagtactgtattttttggcacacctttaaatggtgcccttgaggcaagtgcctcatcactgtgttctagccccagccatgagttgcttaatttgttcctctatccctcctgtgtcttgtcagctggtgattagatccacattctggagctttgctattcacagtgtggtcccgcagcataagcatctcctgggagcttcttagaaatacagactcttaggccccatccagaacctactgagtcagaatctgctttttaaccagatccctagatgatgtgtttgctcattaaagtttgagaagtactgagtggagccataattagattccagtgcaatttatttggcaaggatgcttataggcctgtggtgaattgcttattgtataactttaagaggcatatattgtctaggtgtcctgtttttggtgatactaagattgatcagtagatcctcatgtgatcagcttgacccatccatgaaagttaagaaggatcacttcttagagttcactagagcaaaatggttaagaaagggggctctagagcccaatagtatggatttgaatcttgactttacacagcaaagcaaccctggatagttacttaactgttctatgtttcaagtctctatctgtaaactggagataatagtagtacccatttcactggtcatgcagattttttttagaacaatgcctgacacaaagaaagctctcagacagaaataacacttcttttcttcttctttagtcttttccctcctcatcagagaaagcatccttacaaagatatcatttgagttaagtcctgcagaatgagttggacagtgttctaggtgatattaattacttaattataagcagaaaatgggaattcactccatatttttggagagtggcaaagaattagacttgactgtaaagttgcatgttttcaggaggatgggggaaaatccagctgatggaaggctttggatataggaagtctgtagtatttggggaacagtgaaaatttttaagggaagagaatgtcatgaacaaagtagcattcaagaagtttcatgcagcacacctgtgcagcaggatacatttgaaggaaaaaagtctgaaggttaagagtgcatttaaatagtttacacaaaaggtaataaaggcctaaaccagagtgatggcattaggaatggaagaacttgtgggtggatgtgagattgtgatagtgtgaataatacatgagcatgggtgccaaaggcagggggtgtctctgctttgagttttgctgcttactagctatgtggcctttatcaagttacttaaccacctgaacctctgagcctcagtttccttataagtgtaatgggaataattacacctgtttggcaggttagttgcaaggattaaataggtgtgtcaagtgcctggtactgtgctcagcttatagttatccctcaataaatgctagttattattattactaggtagttgactgggcatatgattgaaggagaggaaggtagtagaaatgattttttggcttcaagactaggataattggtgatatagaaataagaaagttgccagggagaattggtttaaggaggagattttatattctgttttagatacgttgagtttgaaaccccgacaggctatgggggggggaaatgtgttggatgccggggtaaattatgcataagccacacttgactagactcatagatttacttttggtgcagattatggtttcaataatggtttgtgctccgtttttcagtatctttggggtttctgacaaagcagatgtcttaccttgacatcagttcagattagactctgactttgcagtcaatggtctggggcctggcggcttcatccacagctgaaggtagggaggtttttttccccctcatggcttttcctcattcagattctgctgacatttgaagaaagcagtttgttttgctttttagccatttcaaagtttatctttttctctctgtgcacaggctgatgctgaaattggggtattaatgggtgctatttaaagaagctcatttatgggcaattaaataacatgcctgtcagcccagatttgatagggaataggggaacatttttaaatttttattttaagtacaatgaagtttaattatatttcctttctttcaactcttttgttagattatccagaaagcagatttcttcttttaaaaaaaaaatctatatatttattttgcttcctcccctctctcttgggagtggtgggctgagatgggcagccagtatatttaatttatattctgttttgttgatttcacatgattttaagggagttttatatcaatggttttacacgttccaagcgttacagagagaataatccagctgatgctaaaactagaccctctgtaggtagtaactgacatctcaaacatttcatgtcccagaacagcaaaaagattgacagtagtagctgctaacttatgtgtttataggccggaagttgtccagatctgtcacgtattctggaacccaaagtaaatatcatttcacgcacgctatttatagagaacaacttgtgaggcagagggacgtggggacatagggactctctcattctattctttcttctggagtagctgtcaggagctctatgtaatctgttttctctcctttttctttattattattatactttaagttttagggtacatgtgcacaatgtgcaggttagttacatatgtatacatgtgccatgctggtatgctgcacccattaactcgtcatttactctcctttttttttaaatgtaaatagatttgagtaccttgtatgtaattgagtctcattatatatatttgtttataattgtatatgcaaatacataatggctgatggcacaaaaagaactagtaatttggttgcctagtaaagataatgttacacagtatatggaagaacagtatatggcataaagtatttaaattggagtgttggatggaagcaaataaatgaaaaaagagcagaaaaatggaagaagtgactggaccatgaaagaatgtcagtgcttatgagaattaggggtagaaatcattgaaaaaatggctggtggtagaaggtcagagaaggatgcccattagtggtacccagagctttgcctgatggtggtacagtctggacttcagcataaacatagcagccagtcagaggcagaactttttccccagtgcccacagaactcagctgactaacgtgggctcctgtgaatattaggaacagaaattgatatctcgcggagacctgaggctaggataagagagtgaaaatagaaaaatttcatgttctaacaggagaaaaagtgagctatgaagacaggcttcctccacttccatttctcttggtcaatagaatgaggggataaactgcagaactatcctctggttaatgaaaaattctgcagaacagaccaaaatgattagcttagttatgtgagagaagcctccaggcgatacatttttcattaagtcatttcccatcctgaactggagagggaacaaattgtgtggagaaaatctgagaaattagaaggtacttgaagtattcacaagtagtagcttgttccacctgagtgcatagaagtgtagagtacagtggttgggatttgataagaagggaagttgtggttttgggatttctatactttatttcagggagcgagaaagaataggtaccaaactggagctttactgcagcctttagctgttattttaggtgaggttattaggttatttaggttattttaggtgaggccttcccatggagggcagacgtggcgttttggctaataagtgttcttgaattaatgaattcaagtggggttaggtttagctgggctttttcctaaacccacttgcagggaagaaaaatggtagtaatcactatagtgataaatcataaattgaggtgacgtaagtgtggcatttgccagtacatatggtggaacagtggacagcactttcttgattgcgtttttgtcatttgagaatgtctgtagagaacagaagagaagcagagtattgagggggaaaatgccatgttgagaagcaggagacttcagttctaggcctaagccttttagtaacttctgtccaagtgggcaaatcaccaggccagatgcttttacagactaggtcaattagttattttctgggagctctaaggagatgacagcatcctgcttaagtgaacataccagaatcacttggcacttagagacctgagcttatagaattacatgtgctctgtgtgtgtgcccaaatgagaattattgctgtattgaactttgttactaatgggatattgtcatatatttgtttcaggggtttcagggtgtgtagagaggttgacaagcattggactagataatttctaaggactcttccaatctgaaaaactaagatttccaggaaatggaaattgggcttagatgccttttacaaaggcctttttttttttttttttttttttttttttgggcctggctgcttctagggctttcaaactttcacagaaaataaaaataattatagtaaaaacagggattttagacctgaaaattgctgtaaatatttggaagccatggttaaacagtgggtaaattcatatctctggggtgaatcacaatctcatgtaatgaggtaaaacatattttggcaaaaggctgctgggaggattgactttattgagacacaagatgctgcagccctgtttgtgttggttcattcctcattccttggaatagctattttgtcaatttaaatgctgaattaaacaatgaacttgctaactatgaacttgacttcctcccttctttccttaatgcttccccacttcttggaacaaaaatgctcttggcttgctttctattaatattaaatatgttgatcgttgccttgttaaatataccactaactaaagaaattcattcagaggagccatttgtaaaccaaaaatatatcaataaattttcagtgccaccaaagaaatagcactggaacatacatttaattttctcagcaaggcaatttttacttctatagaagggtgtgattcatggatggagcaatggtgagagcacacctgaacaaggaaggagaagggattcttattcctgatgcaggtagcccctactgctgtgtcattcccttgttgtctagggttggaccacacagtctaagctaattccgatctgctattttaaagagagcaggggtaccagccagagtggcagggtgagtagtttggcaggaagggcagttacagaacaggtaactcaggatgagtcaggatggagcaggtgaccaggggtgactcaggtcaaagcagatgaccaggggaacagatttgaactactgattagaactggtgggatactagatactagatactggatactagatactgatactagagacaagggggcgaagagtaccaggaagttaaaccttaaaatggagaatcaaagaataagagagctgaacatactgacatagtgattctttgaagacaaacttggagttcactatatctaacaaaaaataaaattcaggccaggcgtggtggctcatgcctgtaatcccagcactttgggaggctgaggtgggcggatcacaaggtcaggagatcgagaccatcctcgctaacacggtgaaaccccgtctctactaaaaatacaaaaaaattagctgggtgtggtggcgggcacctgtagtcccagctactcgggaggctgaggcaggagaatggcctgaacctggaaggcagagcttgcagtgagctgagatcatgccactgcactccagcctgggcgacagggtgagactccgtctcaaaaaaataaaaaaaataaaataaaattcaaaggtctccccagccccctcaactatctaagtggactccctcctcagccagggcactctaaaatttaacctgaaagactggtttgggccatgaaaggaagagtagcggtgagagggacaggcctcattctgtctttccagggttaacttcagcaccaaccttaaggctgataagaaacatttacaatccattttctctgaagcttgctacctggagatttcatctgcatgataaaaccttggtcttcacaatcccttatcttaattcagacattgctttctacagataataactttcaaccaattgccactcagactatgtttaaatctacctatgacctagaaccaccccccagttctgtagtaggacttttcctaagttcagctaaagacagggtccttgtcatgtgaccacaaaaaattaggcttgcagacaatttgaagggtgagaaaaatggaatttattgggcaaaaaggcaaaaataaagggaaacagggactgtcagcagagtgagagtcctgctaccatagccttcctgccttgcggactgaattccaggttccgccccagagcaggagaggccagtctcctccctgctgcaaaaggcaggaacttcctgaggcttcaccccagtgtgcactccacccagtgcacaggccggttggggtttctcggggaccccttagtcttggctgtctcaattcaagttgtcctgcccttccagatcgaatgccccaacataaatcttcttttttttttttttttttgaaacagagcctcactctgtcacccaggctggcgtgcagtggtgtgatctctgctcactgcaacctcccaggttcaagcaattctcctgcatcagcctctcaggtagctgggactacaggtgcatgccaccacgcccagctaatttttttggaatttttagtagagatgggatttcactatgttggccaggctggtctcgaactcctgacctcaagtgatctgcctgccttggcctcagtatcacgcgcgtccatgtgaagagaccaccaaacaggctttgtgtgagcaataaagctttttaatcacctgggtgcaggcgggctgagtccaaaaagagagtcagcgaagggagatggggtggggccattttataagatttgggtggatagtggaaaattacagtcaaagggggcttgttctctggctggcaggggtgggggtcacaaggtgctcagtgggggagcttttgagccaagatgagccaggagaaggaatttcacaaggtaatgtcatcagttaaggcagggaccggccattttcacttcttttgtgattcttcacttgcttcgggccatctggacatatgtgtgcaggtcacaggggatacgatggcttagcttgggctcagaggcctgacattcctgccttcttatattaataagaaaaataacataaaatagtatcgaagtgttggggcagcaaaacttttttggggggtggcatggagagataatgggcgatgtttctcagggctgcttccagcaggagtaggggcagtgtgggaacctagagtgggagaggtcaagttgagggaggattttgtagtaaggggtgacattgtggggttgttagaaggagcatttgtcgtatagaatgattggtgatggcctggatgcagttttgtatgaattgaaaaactaaacagaagacacaaggtccgaataagagaagaaaaacagctattaaaggactaagaattgggaaagtccaggacatccaattagagagtgcccaaggagggtcagcatagccctgccagcaaagattatttatgtactttaagagggagttaagagtggcagtttggggatagcaccaggagatatcagctatgatggcttggagaaacagtgtaaaccggcagtgtaaacaagagcagggcatttatgagtagttgagaatggtgaataggagtatgactagacagaagatagtagggatgacaagtttttggggcacagtccaagttgggctggtgtctggaatgagactggggcctaataaaaaggagcattcatacaggagctcaaatgggctgtaccctgtagcattccaaggacaggcccgaattctgagaaggcaaagtggtaaaagtattgtccagtcctttttaagttggtggctgagcttggtgaggtgtgtttttaaaagaccattagtccgttctaccttttctgaagattgaggaaggtaaggggtatgagggtttcactgaataacaagagcctgagaaactgcttgggtgatttgactagtaaaggccggtctgttattggactgtatagaggtgggaaggccaaaccgaggaattaagtcttacagaagggaagaaatgatcgcggtggccttctcagtccctgtgggaaaggcctctacccatctagtgaaagtgtctacccagaccaagaggtattttggtttattgactcgaggcatgtgagtaaggttaatttgccagtcctgggcaggtgcaaatccccgagcttgatgagtagggaagggagggggcctgaacaatccctgaggagtagtagaatagcagatggaacactgaaaattgatttccttgaggatagatttccatgatggaaaggaaatgagaggttctaagagacgggctagcggcttataacctacatggaagaggctatgaaatgacgacagaatagaatgggcctgtcagcctggaaggagatattttccttggtctaagaaccatttgccttgtgtgggaagagattaataagtggaagtttcagtaggggagtaggtgggagtgaccaatgagaaggagaaaaactggctgtgagggacagaagttggaatgctagtggcttttttagctaccttatcagcataagtgttgccctaagcaatgggatctgacgccttttgacagcccttgcagtgaatgactccagcttccttcggaagtaaagcagacttgagaagagtttttattaaagaggagttaatgatggaggacccttgcatagtgaggaaacctctttttgcccatataacagcatggtggtgcaggatatggaaggcatatttagagtcagtataaatattgatgcgtagtccttttgcaagagtgagggcccgagttaaggcaatgagttcggcttgctgagaggtagtggagtgggggcagagtggtagcttcaatgatagatgtggaagatactatagcatagcctgcctttgctggtgagtggcaattaggcctggtagaactgccatcaataaaccaaatgtgatcagggtgaggaacaggaaagaaggaaatatggggaaattgggtgaatgtcaggtggatcagagagatacagtcatgggggtcaggtgtggtatctggaataatgtgggagcctggaatgaagtccggaccgggaacaatggtaattgtgggagactcaacaaagagtgagtatagctgaagaagccagggagcagaaggtatatgtgtcaggtgtgaggaagaaaatagattttggaagttatgagagctgtagagagtgagttgagcatagtttgtgattttgagggcctctaaaagtattaaggcagcagcagccactgcacgcagaccatgagggctaggctaaaacagtaaggtcaagttgtttggataaaaaggccacagggcgtgatcctggtccttgtgtaagaatttcgaccgcacagccctgcacttcagctgtatgtaatgaaaagggagtgagtgatgagttagggagagctagtgtgggagcagcttctaaagctgtcttcaaggaatggaaagaggagtggggaaaggatttaggatctatggagtcagctaggtttccttttatgagtgtatataatggttttgttaggatggcaaaaccaggtatccaaaggcgaaagtgtccaaccatggccaggaaggaaaggagttgttttgtagaaggggttggggtttgagagatcagtcggacacgatcggcagggagagcacgtgtgtttttatgaagaattatgccgatatacgtaacagatgaagaaatttgggcttgactgaagtaatgggggctgtctgtgaagtcttgcggcagtacagcccaggtaatttgctgggcctgatgggtgtcagggtcagtccaagtgaaagcaaagagaggctgggatgaagggtgtaaaggaatagtaaagaaagcatgtttgagatccagaagaggataatgggttgtggagggaggtattgaggataggagagtatatgggtttggcaccacagggtggataggcaaaacaatttggttgataaggcacagatcctgaactaacctataatgcttgtctggtttttggacaggtaaaatgggggaattgtaaggagagtttataggctttaaaaggccatgctgtaacaggcaagtaataacaggctttaatccttttaaagcttgctgtgggatgggatactggcattgagcgaggtaagggtgattaggttttaatgggatggtaaggggtgcatgatcagttgctaaggaggaagtagaggtgtcctatacttgtggattaaggtggggagatacaaggggaggatgtgaatgaggctttgaactggggaaaagggtggcaatgaggtgtggctgtagcctaggaacagtcagggaggcagataatttagttaaaatgcctagacctaataagggagctgggcaggtggggataactaaaaagagtgcataaaagaatgttgtccaagttggcaccagagttggggagttttaaggggttttgaagcttggctgtcaatacccacaacagttatgggggcaagggaaacatgcccttgaaaagaaggtaatgtggagtgggtagcctccgtattgattaagaaagggacggacttaccgtccactctgagagttacccaaagtgtctgtgatggtccaagaagcttccgaggcaactggacagtgtcagtcttcagccgctaagtcaagaagatctgggaaggagtcagtcagagccttgggccggttggacagtccaatttccagtggggtcctgtacagatgggacatagcttaggaggaatcccgggctgcggacattccttggcccagtgaccagatttctggcacttgaagcaagttcctgggggaggtggtcctggaggaatgcctggccgctgcggtttaggtgtttggaagttcttgtgtgctggagatgtggctggggtttctctcacagtggagacaaggaattgcaattcagaaatacgttgctacttgcctgcctctactctattattgtacaccttgaaggcaaggttaattaagttctattgtggggtttgagggccagaatttaatttttggagttttatttaatgttgggaaccgattgggtaatatactgtatattgagaataagacagccttctgacctttcaggatctagggctgtaaagcatctaagggttgttgccaaatgggccatgaactggactgggttttttatatttgatgaaaaagagcctaaacgctaaccaatttgggagaagttggataaataaaaaggagcattaaccttgattatgcctttagctccagccacctttttaagaggaaattgctgggcagatgggggagagctagccatggaacgaaactgtaagccagaccgggtgtgaggaggggaggtgataaaaggattatagggtaggggagcggaggctgaggaagaattgggacctggctcagcctggtgaggagcagcctggggaggaggggagaggtcagatgggtccataaaaaaggaagattggaaagactcagcaatacttggggttgggactgaggggacaggcaggagggaaagaaggaagatttgggacaagttgcattgggaacagagactaggaagggaccgatgtgtaaaagaatgcctggacatcaggcacctcagaccatttgcccattttacgacaagaattatctagatcttgcgggatggagaaattgaaagtgccgttttctggctttttggaaccattgttgagtttgtattggggtcaagcagtattgcagaagaaaataaggcatttaggttttaggtcaggtgtgagttgaagacgttttaagttcttgagaacacaggctaagggagaagaaggaggaatggagggtggaaagttgcctatagtgaaggaggcaagcctagagaaaagagatggtagagacatggagagaaggggtgggggtgcttgccccccaggaaagtggagaggagagagagggtagagacacggagagaaggggtgggggggtgcttgcctcccaagaaagtggagagaaaagagagggtagagacacgaagagaaggggtgggcggtgcttgccccccaggaaagtggagagaaaagagagggtagagacatggagagaaggggtggggggtgcttgccccccaaaaaatggtggttgccactaagggtgaaggatctaggaaggtgtccccatggttatcagacacctcttaaacatgggtgaataatcaagcaggcatccccacagtgattaaacaccaagggaagattgtcttcctgcgtccgtgactggtgccggagttttgggttcacggataaaacatgtctcctttgtttctaccagaaaaggaaaggaactgaaattaagagaaggtagagacggaaagatggcaccaagattgaaaggagaaagaggttgagggatagtgagagaggttggagaagagagtaaaaagaggccgcttacctgatttaaaattggtgagatgttccttgggctggttggtctgaggacctgaggttgtaggtggatctttctcatggagcaaagagcaggaggacgggattgatctcccaagggaggtcccttgatctgagtcatggcaccaaatttcactcgtgtccatgtgaagagaccaccaaacaggctttgtgtgagcaataaagctttttaatcacctgggtgcaggtgggccgagtccgaaaagagagtcagcgaagggagataagggtggggccattttataagatttgggtaggtagtggaaaattatagtcaaagggggttgttctctggctggcaggggtgagggtcacaaggtgttcagtgggggagcttttgagccaagatgagccaggagaaggaatttcacaaggtaatgtcatcagttaaggcagggaccggccattttcactttttttgtgattcttcacttgcttcgggccatctggacgcatatacatgcaggtcacaggggatacgatggcttagcttgggctcagaagcctgacactcaatgtaaatcttaaatgtattgattgctgttattatgtctccctaaaatgtataaaagcaagctgtaccccgaccatttggggcacgagtactcaggacctcttgaagctgtgtcatggctgtgtccttaaccttggcaaaataaactttctacattgaatgagacctgtctcagatattttgggttcacacatttgacctaaaaattcctgaacacaagttggtgtagtttttactagtgtaggaggcagtgctgtatatttgtcctttgcatttgatagtagaatttttagctgtttttcttttgctaaacttttcaccatcagcaatgcagatgttgaaattttaatgcaattgcctctgtggcccttattttcactcacatcttctaagcactctaaggggcattgaaatgaagacagccaccacttaatatatggttgtcaataggatttcttcctgaccgtttatgctttcatgacattaggaaacttctttgttgcattgggcttgggagaggtaagaagatacaaatttctttggtagcaggtagtgcatgatggtgtggtttggagaacaagaagagataaccttgtttggttaaatggggaagaccagactggtaggccctaaaatccttttaaaaatcattaacattttcattgttcccttggctttctgacctgttacactgcataccttctatccaaatggagattctgtcggccgaaaagatcaagcattcttccttagcaagatgcatttcctcctgctggatcagctgtctttctgtcagaaaggcagagctggtcactattttcccattatctgtttgggtagggagtccgggaaatggggagggctatgcaatatatagtttagaaaagctctctccctctgcacacacttttaagattcatttttgtctttgctcccatttctttcattcctattgctccatgggcaaccatgggcacagccactggcaatatcatgattaattattctaggaagcctggataagttgaagtggttgttataaacgtctaaacttgaaatctattttttttaaagcaaagactgtgtttgcatgcaccaagggaaaagctggtggtagaaattgctgtacaatttgcctctagactgtagttggaaatattctttttgggaaataggacagatcaaggtggtttttctctccatgtaaagttgctattggaataacaacttgtcttattttacagtcctaaagtaataaataaaacatttatgacttggaataaattgagagcatcccattacctatagtagcaggcatgttcttattcttttcaagcctcaggcagagtgacatcagcagatttttttcattttctaatccagagccttctaatttctttctgtcaaagaacctgcattttaatactgagcagatctgcagggaccctttttgatatgactacgttttgtagcacctcttttaaattgtatttaacttcagttctcagaagacagcatggtgtagtggaaagaacatgggcttagaatttatagagtgtacttttttttttggttggcttggaaatgaggtcttcagttcacattcagattcttgactcattagtaatctggaattttctgatgaccacactcagagttcttctagctacagggccacttcttgtggtgcttgtggtgtgtcaaaaggaactccccgcttagcctctttagagggtacttcttccattacactctacacacccacacaccctgggagcttcttgatctggtaacgtttttgtgcgtttggaattttttagtttttcatcctgtactacaccataatgactcttacccttgccctttggtgattatcacattggagaaacatccccgctcatctgtgctttcagaatgccaaatcctcatacaaagaataaccttcagtttctcctgcaggacaaagcatgcctgtctgagcacagtgagtcaatctctcctgttcaaacatttgccacttatttattaaacaagtatttaccaagtaccctctatctacgagtgtgtgctgtgggctgtggatgagaaaatggtgaattatccatgatttcaagaagtctataatctaggaaggaaaataagaaaagcagtttttgtgtggtggggtaagggcatgggttgtattgtgcttggccttttttaaaaaggaagggataaaatgatccaatccttgaagatgtaaagttcgttgtgtctcttaagaacagcaaaacatgcagtttgccaagagcagaagcagcatcaagggggaatggtggaagataaggaaaatttttcctcagttatctacctgatttttcctttgactttcaaatgaagtacagggtcattttatttgagattcatttggtattctctgtcaactgtccatgatcagggtatctcttcctcctacttttcaccctactcgtatagatcatcatatccactctcattccttctatcaacatgtagctaagattgctatacagaacttcagacctgcatttccagctgtggcctagacacctccacccgggttctcaccccacctcggatagacagacccagaactaagctcagtttcctctctctcacacttgcactttctgcttcattccatctctgtgaatggtactgccttccagcaattgcttaatgcaggatgtgggcgctatctttgacccctcaccttttctttaattcccaccagccatccctcaaatttacctcctgaatatctgttgagtctgtcctcttctctgtgtcccctctgccaccatcctagttccagtcatcatcaccgactgtcactgagggagcctctgaagtttcactagattcagtcttacctctgaccaatgccttcttcacacactgcagccagaataatccctccaaaatgtaaacctggtcacatcaattctcttaaaacctgttaatggctccttatggcccttagggtaaaatccaaattacttaaatagctgaaaatgtccttggtgacctggcctttactggctcctcccacagcgggtggcctccagcggttccgaactactttctctttcctaaattggccatgttctagcacttgtacgctttgacatgctgtttctcttgcctagattctactccctatttttgcctggctactttttatttttcccctagatctcagcttcaatgtcatatcctgtaaaaagcctctaattctctcaaaactaggttagatgcccccattatgtgccccttttatggattacctaaaagtgaaattgcatcttgattacctgttgaattgtcatcgttccctactaaactataaacttcactaggacagggaatgttgggcttattcaccagcgtgtccaagacacccagcacagtgcctggcatattatttatcaagaaacatgttttactatgccaccaatatttaccaagagctgttcttctttaccacttgatcctaagcttcttcagggcaggaccaaatcatatttgtgtgccataggcagcactttgtgttaaatgagtttgtttcaacaactaccttcagaagcattattgcatctgaccttttaaaaaatattatgtgagtgtgaatataaattgaaaaatttaaattagatgagactatgcaatttaaaaaatgtgctataaaacatacaactaaatgagtaattgcccattgagtattgtctgaagtttagaagaaaaagcatctgctttccgaccctactgttagcagaaaggggtcccaatccagaccccaagagagggttcttagatcttgcacaagaaagaattcagggcgactccatagagtgaagtgaaagcaagtttattaagatagtaggccaggcacagtggccacacctgtaatgccagcactttgggaggacaaggcaggcggatcatgaggtcaggagttcggttcaagatcagcctggccaacatggtgaaaccaatacaaaaattagctgggtgtggtggtgcacacctgtaatcccagctacttgggaggctgaggcaggagaatcacttgaacccgggagatggaagtttcagtgagccgagacagcgccactgcactccagcctgggggacagagtgatacttcgcctcggaaaaaaaaaaaaagaaagtaaaagattaaaaggttgactactccataggcagagcagcagcatggaccactcaggtgcttattcttgttacttcttgattatatgctaaacagggggtggattattcatgagttttttcagaaagggatgggcaattcccagaactgaggattcctcccctttttagaccatacagtgtaacttccagatgttgccatggcatttgtaaactgtcatggtgctggcaggagtgtcttttagcatgctaatgtattctaattaacatataatgagcagtgaggacactagagatcactctcatcgccatcttggttttggtggattttcgttggtgtcttcactgaaggttgttttatcagcaaggtctttatcagctatatcatatgccgccctcctatctcatcctgtgacttagaatgccctacctcctgggaatgcagcccagtaggtctcagcctctttttacccagcccctactcaagatggagtcactctggttcaaatgcctctgacacttaccacttagtaactctgtgtttttgggcacgtcactttccttctctgagtcttggcttcctaatatgtaaaatgagaatattttctgttacctgataatgcctaccttgcaaggttgttacaaagattaaaggtttatgaaaacaactgccatagtacttggtacaaggtagttgctctatgaattttaagttttgtcttttattctgacaatgctgatattactgaaatatttttggaatttctttgctgagatagttttcagagcttgctatagatcatcagactatctcaatgggagaaatcttttttctttgaggatgtgtttgatttttaggaatagtcgggttcagatagcaagatcaagatggttaacaccatttttgatattaaacaaagttaagtatgattttttttttttttgagatggagtttcgctcttgttgcccaggctggagtgccatgacgcgttctcggctcattgcaacctccgcctcctggcttcaagcgattctcctgcctcagcctcccaagtagctgggattataggcatgtgccaccatgcctggataattttgtatttttagtagagacggggtttcaccatgttggtcaagctggtctcgaactcccgacctcaggtgatccgcccatctcggcatcccaaagtgctgggattacaagcatgagtcactgtgccagacccaaagttaagtatgattataatgagatcttcttttgtaatatcaaaattggaacatattctggctctctcacaggtggcattgacaggatattccatttggcacattaaattcagggaattaactatcacaaaatctttttattttgaatagcattctgataaattaatcaaaattaataaactcaggagagctgaaatctttaataatatatttaatcacaagctaataatcagaattttacttctagcaacaaagaacttagggaaaaaaatgatctaaggtgctaccccatattcttgtgcatattcagggctattgtcttttcagctaggtccatggaaatcagtgtgcctgagttgtggcaagggtaatgttctttattaatagcccagaggagcctgttgccttttggagacctgtccttcatagtagaggaggagcctggaaatgggcaggatatagagatgggattgtagcttttacagaagcatagagggcttgtgcagaaaaaatccacagggcgagtttttaggagagattggaggtacaaggtaattagtctactaaaggaaagcattgaaagcagtggccggtgggagcacagtccggagaggctggaagctgcgttcccagggcctgtgcaagttggactaggggtcagcacagtccagggggagggtcagtgacaatgcccaggttactatgaggaacctcatattattttgttatccagaggttactgtgggttcagtgttttacctctttattgtatataaggtcataaatgcaaagtatccagtaagctataaggagttagtgacatgttaattattttcaagatatttcgctagtttctaccctgaatttacctcatcttgtatatttttgttgttgttactgatgttagaatgattcagtgagagcatttgattgggagggacgcaagaagaaaagtgaaacatgaatatgtgttatttcctgtgggtcattcaaaaaaacatgaatatttgtgaatactgggtgtggaggaagagaaggttgcacaacgctctttgccacctgggcacaggggagcagagtcacttaagccaatggggactgggctgacttgtgctggatttcacaaggggtgagtctcctgaaaatctttgttatcaaacaacatcagcttttggggtactgatgtcatgataatttcagtaaaacatggttcttaagttgtttttttttttttttttttttttttttgagacagagtctcactctgtagccccaggctggagcgcaatggcgtgatcttggctcaatgcaacctccacctcccgggttcaggcaattctcctgcctcagcctcccgagtagttgggattacaggcatgcaccagcatgcccggctaatttttatatttttagtagagacggggtctcaccatgttggccaggctggtcacgaactcctgacctcaagtgatctgcccaccttgtcctcccaaagtgctaagattacaggtgtgagccactgtgccctgcggttcttaggtttcagatttcagattcacagcgtccatacttccctgtggatggtgttctcttagtgaagccgcctgctttgtgaacttcaggggttgttttgcagcctggctatggaatcactgagcagcagcctttgacagcaactctggcaaaaagcaaagcttgcttattgtttttcattcactgtaaatgtcaaatcacccagaagagcctgttgccttttgaattcctgtgaaaatgcaaaatttaaagttttcaatgttataaaaaaagtctagaaagagaatataagcaaaataaccttttttcaagtttttctataaattggttattgttcatcttttctgggtatttgatttcttaacttttgttaaccacattgaagttactatcttagcagtgccagcaatgtgcattagcacaagctcttagatgaagattctggagccccggaggtgactggagccatttaaaatgcttttatggtagaaacctattttagagaccttgacgttaaataggtgatcacattctgacagaatgctttcatttttggaagccaaaattttgcctcatgacaaaattctccatttatgatttattgtctgacagtgatataaaaaacaagtgatttagataagacagtagcagaagaaacttaatatcaaatttacttgtggcaaatgacctaatttccactgggtaagaaaaatgcaggatatgtatattagttttctgttgttaccttaacaaattaccacaaatttagtggttcaacacaccacaaatttcttgtcttgcattctgtgaattagaggcccaaagcagctctcactgggctaagacaaagtgtggcaagggctatgttccttctggaggctctaggggagaatccttttgcttttccagcttctagaggccaccacattccttgactctcttcagagccttcttccatcttcgcagctggcaaagttgcatttttctgaccattcttccataatcacgtctgcctctgatcacaaccacgaaactctctgttttgggacctttgtggttagattgggcccatcttggatgatccaggacgatctcccatgtcagggtcctaagttgaatcatgtctgtaaaatccctcttgccatgtaaagtaacatatcctcaagttctgaggattcggatgtggaaattttggggggatgtggcattattctggttaccataatatggaaatatttaacacagacttttattcggaggatgtatttttcaaatgtgatgataagttgttatcaggttttttttgtttttttgttttttgtttttttcagcagagtctcgctctgtcgcccgggctggagtgcaatggcatgatctcagctcactgcaacctctgcctcccaggttcaagcgattctcctgccccagtctcccgagtagttgggattacaggcacccaccaccatgcccggctaatttttgtatttttggtagagaggaggtttcaccatgttggccaggctggtctcgaactcctgacctcaggtgatctgcccacctcagcctcccaaagtgctgggattacaggcgtgagccaccatgcccggcctgttatcaggtttttaaggaactttcactggggtgtttttagagaagaggtgcctatattaaaaaattaaaaagctcacaaattttgtttggatcataatctattaaagctaatgattattctcttttgcttactttgatagtgataacctcctaaggagagcagcctgtcaagaagctcaggtaatactacttaatgtgataaaattaagcccctccttatcttcattgtgcagaaaacttaagctctttcaggggacttgcacagtgtcttgcatctgtgcagtctggctattttttagcactatcaggatgaatcacgctgggagccaactctgagtagaactccaggaagttaaccatctggtgaagagcagttctgacgcccacccctatagactgtttgtttctggattggtcccaagaacacagaactggactggtagaagctctgggaatttgtttgtgtctgcagttgtctttgtagatttgtctaacccctgaatcatccctgatctgaataacccccaaggatatcagttcagagcaagtgttacctctaaaagtcaaatcttcttaaaattgttgattcatatttttaaagctcatctccaagttcaactgatccatatcatgtacactgttatattccatgagattttacttaaatattcatttatatggctaattatagctggattataatatttgtcctttcaaatataagacagcatttttgcccccccactgcaaaaatgtgcattataccttgcagatgaaattctgagactgagttgcctttttgttttatatcatttgagcttatgatgtcagaaataccaaaatagaaacatgaaaatcaaaagtggcaaatgtgtgaagcatttagtaataaaaataggtggcagacctcatgtttgtttctgaaatgttttaatggatgacagtgagaatagatactataaattaattcctctctttagcgattgttacaatagatactataaattaattcctctctttagcagttgttacagtatatactataattcctctttttagcgattgttatctagctgttctaaacctgtgttttacgaatttgattacttctttgtttaaatgtattatctttcatatggctctaagttgttttggaaatcaattcaaataaactttaatattaaattaaaggtgatccccgtcccaagccaatcattagcgactggaaaatcttcctggagtacagtggtgtgatgttggctcactgcaacctctgcctcctgggttcaagcgattctcctgcctcagcctcttgagtagctgggactacaggcacacaccaccatgtccagctaatttttgtatttttagtagagataggggttctccatgttggccaggatggtctccatctcaacctcgtgttccacctgccttggtctcccaaagtgctgggattacaggtgtgagccaccacacctggcccctttctttctctctttaaggaagagtagacctgtgtgattgtagggccctccctttcttgttgaaagtaaatgcctccacctctgttctaaattctctctcctcatactttttcagggatgatgttcctttagttattttctccttctcatgtatttctttctttctttctttctttttttagacgagtctcgccctgttgcccaggctggagtgcaatggcacaatctcagctcactgcaacctccgcctcccaggttcaagtgattctcttgcctcagcctcctgagtagctggaattacaggcacatgccaccaagcctggctaatttttgtatttttagtagagacggggtttcaccatgttggtcaggctggtctcgaactcctgaccttgtgatccactcgccttggcctcccaaagtgctgcaattacaggtgtgagccaccttgcctggccttatttctttctattctaattctccacttcccctgcatgtttagttccttccatctcacaaatggaagtggatctgtccttatagcctcagctggctaattttcctatctgtgtacttccttttacagtctaaattcttgaaaacatgatatttaataacaaatctcacataaacttaatgtagtctcacataaactccttagctcactgtgaatctgagatttgatttgcaagtaggtaccaactttagacactaagaaatgagggcaaggaggaataatcttactaccataggtgtggaatctgataggccagagagaatggttagtgatatcatttctgccacattccagaaatagtatagatagaaaaaggaaaaattacagtatttggagatttagcagcaaaatgttaaagtctaagtaagaatgaaaacagaatagaaattataatgttccagaaacttcttacaaagaaatagtctgtctttttctctacttcagaaaaaaagtatttttgtttttgtttttgtttttaaagcaagcaatagacaataataagaaaggctccaaaatgaactgtcagggagatagcagatttagagtaagttattcaataaaaaatatttgcattactttttttcctcctcctatctttactttgtacttccatactagaattctgctttgttggttcaggccacctcccaccattcaagaccccaatttttgcccattttggtactttcctattctttttgttgacatcatttccaattcagacataatagcaagagttcccattcatttctcatttggactcctcacatctagtcctctgccttttaattctacctcatccttgatcctctctttagagcttagagaggctttggaattagaagatgtgtattccaggcttgtaattgatcaactctgtgactttcaggaacttaatcttcctgattctggactttctaatctggaaaactgagattattttatacctccttggtttctgagaactaagaataatgtgtgtaaaaatgtcaaataaaaggtgcttggtatatattagttatgtttcttttcccctgccagttgctgctatttagttatcatacagggttgcaaagaagagaaggcaaatagagtattcggtttattttgtatgtgtgtaaacatatgaagattaactggtaacacaaagattcttcatgaacaaattttagtaatgagctggaaagaatattgtactctgaaaactaaagacatagattaaacttctctcctgacagactatggccttactaattatatgttataataaacctagctatatcttatagagaaaataaatgttatttgcctctagtagataaagcaggatttttttattccaatacaaaatacagcttattgtcattaaataatgttactttttgttgttgttgatggtgttttcgttaatatgagatcatgaaagaatatttttccccaagggtagataccttatgtgctgcaagtacattttttttggaatgaaagaatacatgtgacatttaccaaataaatggacttttactgaaaactttgctcttttcttttttaggtgtttggcaatcaactcattcctcccaatgcacaagtgaagaaggccactgtttttctcaatcctgcagcttgcaaagggtagttccgtttgtgacttgttatatacttgctttttctaagggggaaagaaatcacagactatcaggcagctagtgagattgtgtggaattggaagaactaggtttagtactcttctagcaataagattcatttgtaatgtagaaataacagttaaatgagaaataactataaaactaatggatgcttagcaaacttgtctaattgaagtttaataatcattccatgattaacacctacaaagatgtcttatttgcttggaagtagtcccctcgggagcgactgctgtactgctaggacgtaaatccttaggccatctctgtccacaggatgttcagaaatggccaagaatactgtgggcttgggagatcagaaatgttctttccaaaagagatgatccttgagctagacctgggaggaagcaggcaggagaagactacccattcttctcagctgaggaaacagcccatgggacaggggcctggagacaggagtgacctagttatggctttgttatgacacaggacagcctttaactgaactggctggcctggaaatgtcatgtgggaattgtgggaattaaggtgtgaagaattgttgagacttgggtatataatgatttgatcatggcagttcattgattatacaaatgaaccacactaaaacgtggagaggctgtatgtgggggtggggagtgggtgtgtggagactcaaagtctgttaaggaaaaataaataggcaaaacttttttttacaatgttagatgtaactattattcaattggaaaggtgaatacaaagaccttgatggctttagaataaataattaacattttattttgaaaaaatagtcagaattaaagggttgagtgttaaaaagtgatatctcttatgtccctaatgtcgagaacaattctttttggctttttgggaatcagaaaattagcagtttgggtgcagtggttcacgcctgtaatcgcagcactttgagagcctgaggtgggcagatcacttgagcccaggagtttgagaccagcctgggtaacatggtgaaactctgtctctacaaaaatacaaaaattagctgaaaaaatgcaaaaattagacacacgtggtagcatttacctgtagttgcagctacttgggaggctgaggtgggaggatcacctaagcccaggaggtcgaggctgtagtgagccatgatcgcgcaactgcagtccagcctgggcaatagagtgagactctgtctcaaaaaaaaaaaaaaaaaaaaaaaaaaaaagaaagaagaaagaaaattagtaaatatgtattaaattggattctataagatctaagtcaagtgacattaaggtaataagaacaacaacaagaaagatagtttgggctgaattgtaagtggtaggcataatgttgtctggagtaaaacacagggtctctgaagtcagtttttctagtcatttcttgagaggcagtgagtgtgacttcacagacaggaggacacatcctgctttatttctttgtaattcagtggtttaattcagattgtctaaacagactattctgcctaactgaatcatatctgctgggctttgttagagccgcttccctcccccataaacgcaccagtcataatgcctattgatcatttttgtttaatatcaatactaaatcatgccaacaaatcaacaagccctaatataacacagtcaaaatacctaagataagtaaattgtcagtggtggcccgtggctgaagataacagagaactcagcctgggtctgggagtttgaggaatctggtctgtttactgttttgccacttactagctctatgatattgtgggagttaattcacttcttaaatccccagtttactcatctgtaaaatcagaaaggcaatagtacatactttaaaaattattatgtggaatagggacctttggtattaaatgagataatgcttattaggcactatttccatttcataataagcacacaatgtaagaaatataaactgctgaaattgttactcttgactatgggttaggttcagaacagtcttcacttcgctatcccatccttcccagaagctcttgtacctctccttcgacctacttcagtgtaactcttctattcctttagagacctaataaattaacaacctgctaatttctgatgaaacttatggcaatttgtttaagcaataaccagttattttgagttcctgcttctaagaggtatctacatttttaaaattaataagcaaatttttcagagcaattttagggtctttttacatgtaaatatatttgcatttttaaaggtagattcttgtttaaaactataacatctttatctaaaggtaagctaaaatactgccactgaaggaaagtcttttctaaaggtgttgtctcctttaacaaggtgaagaatccctgcgtgcttctgggaaagtctgaaactctccagcatcctttctttttttcttttaaaagctttcactatttaattgcactatttttgtcatcatagctctgtcctgacacataatttataatttatcatgtagctatttcattatgtagtactggtttaaaactacataagagctttaagaaataagataactgtgtgtttagcattaataaataatacataaaagagtaattattttttgtatgtgcctgagtctggaaattgctaaaagtacctaaggtttttatttagcctcggtgttatctcacccttaattatgtaataaataatttatttcttattagtaacacttgtttttcaatcttttatatagaaaattagaaggaaaaaagtcttcaccttcattttagaggttttctgaacttataacatcatataaagatgtgaataaagacccaaatattctaacctgatttcttaaactaactcagaggaggttacagatttgttgtgattgatatggcagattgagacttcttcagaattttgcttttaggaaatagatctgatccacttccaactgatcctttcctatcaatctagtaatgaaagcaaccctggaaggagaattgtttgcagtaccactagctcagtgctttaatgttgggttaagcccccagaaatggtgagctggaaaggagaaattatcatttacccttttatgttcattctaataatcattcagagcagtagaaaggtagaaaatatttaatttgcttataatacactcaggcccttggtttgagatattcttttggatggttcttgtgaaaatttgtgcaagcctctcaatttctattttaattcacaataagaagtgatttgtgttctatatgccatttggtggttctttttagtttaaagaatattgagcttggcctgtgcataactatacgtgttcctcattagctgcctttgtagctgaatataaaatgtctcttctataaaatatccttaaattcttgtataaagtatccttaaggtcaaaggatacagccttagtttaaaaataagacagaggactgagtaaatgtggatataaaagttaggtgtttgacattgattgaaagtactggatttttttttccttatgtaatagttgaaatatttgagtaaaaggtcaactaattggtatgttttaacattagtttgactttgagactatgccattggtggaagagattgttttgcaacttctgtgtccctggattcctagactgtgtttttgaattctgacctgaattggacaagagttcactgtcagaatgatatgcataatacttttgaaatatgcaaactctttgaaggctgttttttctcttcttataagacatcgtgttgtttccttttcctcagaatttacatgtctacatttggggcaggtttattcattcgtttgtgcattaattcatcagatacttagtaagtactttctaattgtgccatacataatcctagaggtcaggggattcaaggattaataagatttggtatttatttttagaacgcttccagtctagtcctgacaacagtcttggaagtctctaatcaccatacagtatgaaagtcactaacagagatgtgtataaggtactaggggagcacagagagggcatgactgtgcctgggagtttcagactagcttctggtgaattagtagtttggtctgctttgttatgttgtattcctagctcctccacctgtgtctatcacacagtaggtgctcaatgaatacttgagtgaatcaagcattgttgcctgaatggaaccatatctagtgttcgttcttcccctagaggaactactttgtgaactataagcctcccaaatggataagagcttattgcattagataaacagcaaattctcaaaggccccagagtttaaggttctatttttccattcatattaactcattacttgttgttaaactttctgtgcttgaacaaataaaggaaacccgtattgcatagtctttcttattctgccctgaagaagattgtaaggctttttgttcttgctcttgataacctgtgttaaaatgtttatattttttcctttgttaacagaaaagccaggactctatttgaaaaaaatgctgccccgattttacatttatctggcatggatgtgactattgttaaggtaagaatggctcctgaatgtttatttcacccaagcagctgcctcttataacaacctcttctcttggcttcttagcaaaaattgcttgtcacaagagcaaagaaattaatgttgtatcctgttctgacaattaataaatgtagttttgtttttttccaaatagtgtcagcttttcattttcagaataggattggatggaggcttggagaacttgacacctttcatctgagagataggatgtggaattacatctcttggaagatgaaagttgttatagctgtaagaattcttttcctgaaaatacacaaccttcaagtctgagtaattaatttaatttcttagtagttccacaaacaggtaaaccattttctctctggtaaggaattatctttggtgaagaattttaaatggtaaagctttagaatttgtgagatttagttaagaagaaaaggaggcaagcataaattacaaggaattgtactatttcgaagatgcaggactctacttgttgaattttaaatgagatatatgtgggtaagtacatacatgtgtatatagtgaaaacctctcttactgtggttataagtctgttgaccaatttctaatattgtacacttccaggaaatcatagaagttaaaaaggatcatttagtctagtttaccatgcaatgttgaaccctcttttccaacttttctgtcatgattttccagttgtttgcccccgggggtaggagaaaggggaagaaaactaacatatttgagtacctgtaatgtggcaggtatgagagacccaagtatggttatgtgagactgatgtttgtttcttcaatgattggtgaaactcacagctaaaaccatctggatctggagctttccttgaggggagattttcttgtgtgtgtgtgtgtgtgtgtgtgtgtgtgtgtgtgtgtatgtagagacaggagctcactatgttgccaaggctggtcttgaactcctggactcaagtgatcccccccaccttggcttcccaaagtactgggattataggtgtaagctaccatgcccagccttttttaccttttttaaatttttaatgtacattaaatttctttaacagttctagaagtactcaggtttcattcttcacttaatttttgtaaggtaaattcttcaaggaatttgtttcatctaaattttcaaattaattgacatcaggttgttcataatatcttctatttaacttttaaatttctatagcatatgtaatgtctcattttcattctcaatattgtttatttgtaccctctctttttcccctcagtaatcttgtgagaggtttgtcaatttagcccttgccaagaaccgttttttggcttattgatcctctcatttatatgtttcattcatttctgatctttttttattgtttcattcattctactttttaaaaaaatttttctgctgtgctttttctgacattttaacttcattgcttatttcatttttaccttcctttcttattgtatgtatttaagctacagatccactctactgcttcagctgcatcctatactttttgatgcataatatttttattatttatttttaaatattttcaaattttccttgtgatttttcttgatctatgtgtttttgaatttccaaatctaaagtttttctgattgtctttgttaatgatttcagacttaattgcattttggccaaaaaatgtagtctataaaattctagtattttaaagtttgttgaaatttgttttatggtctaacatgtgctctgttttcataaatgttgtatctatgcctaaaaatagtatatatcagttattgggcactatattctatatatgttcattaagtcaagtctgttaattgtgtgggttcaaatcttctatgtccttactgattttttcttctgttttaactatataaattctcaagagggggtattagaaatctcccactgtaattgtggatttgtctatttcactacatagatttgtccatttttgcattttgtattttgagacttaggtcattagatgcactaaagtttcagattatttcatttttcttacatttcgaccctgtcatagaataactatttttagcacaaatactgccttttgtgatagtctatcttatctagtactattggtaatttatactagcttgcttatttttagtttttgcctggtatcatttttatatccctttatttttatcttttttctctcctgagattttagatgtattgttgataaaagcatgaaagcaggatattgtaaagcccattttctcatcttttgacttgactgtttaattcattccaacattctataccagttatctattgctacagaacaaaaggcctcactgtttttctgcttatgattccattggtcagtagtctcgcctgggctcatagtggcatggctgaggaagggtggtcttcgatggctttactcacgtctccaagttgatgctggctgtcccctggctcatgttgtctccactatgtatcttgacatggtagctcggttccctgaagtcagttacagatatcctctaattttatccctaaatacttttatgtgtatttttaaacaaataagaatacttttatatttatctacagtgccattttcatacttaggaaaagtagcgattctcttttatcatcttacactgtctaaccccatcttatactatcaaatgtcctgtgactcatgtatttgtgattttttccagtttaagatacttatcaattatatgcaagtactaatatgtacattacatatacagaaaatagacatttagaaggatgagattaaaaaataaatagaaatactaatgtttactttttatgcctcagtagaaaccactactctttacagggtttgttttctttcttttggattagcttttattttgaaataatctcaaacttataaaaaaaatgtacaggaatatacaaattcccatatcacttacccaaactcctcaaatactgtattaacattttaccatgtttacacatgctctctctttacatgtatgtgtgtgcatatgtatgaatgtgtgtgtgtgtgtatatatatatatatatatatatatatatacacatacatacacacacacacatattattttctggcttgtttgagagtaagtttcagaaataatgttcctttatctctaaatatctatatcctaaaaacaagggcactctcttatataactgcaagaacagttatcaaaatcaagaaattaacattgatgtactattatcttgtagaattttttttttttttttttttgagacagagtctcactctgtcaccaggctggagtgcagtggcatgatctcatctcactgcaccctccgcctcccgggttcaagcgattctcctgcctcagcctcctgagtagctaggattacaggtgcgtgccaccacacccagctaatttttgtatttttaatagagacaaggttttaccatgttggccaggatggtctcgatctcttgacctcgtgatctgcctgcctcggcctccaattgttccatgaatgccatttataacaaaagaaaaaacactttttcttgttctgcatccaatctgggatcacatattgtatttagttgtgatatttgtttaggcaactttaaaaaattcctcaatttttttttttttaagaacgtccttcagtttgggtttatctactgttttgttataattagattcagattatgtagtttagtggaagtaccacaaaatgttgtgtctttctcaatgcataatatatgtatgacagtcctgtgaattctttaaattaaatttttagcttgagatttttcagattatccaggtagcacgcatttcggttacttatgtaaggactagcctaaagttatggattctcagggaagatgtttatcccttcatttagcaccaaatttcagaacacgaaagtttctttgcagtgccctgggaatcgtcgaggagtatgagtgagtcaaccccgcttttattctctctaaactgcacatgcagtcttttgggtcctggtttatagtgggatgtggttctgtactagattcactaatcttgagcaggtcctgggatttttgtttgcttttcctagaacctggtgaagctttgaaaaccaacattcagatctacctggtttactagatgccctcagaacatttactgcataggtgctagttttatatttagtgttccttactttattctcgtttattgatgcatcaaagatgttttcattattttactcagtagctttaattttcagtggcagggtacctagcctaccattcttttagaaatggaattgtagcacttcacatagctggttttatttaagtcacataaagctcagtgaagttgagtgttatcatctttattttgtgaatgaggaaattgaagatacaaacatctagaaacctgctcagttatacaattagtagtgacaaaactcatttaaacctaggtctgtcgactctaaggcatgtgctttctaccttaggctttgtctcccatttgacatgaaagctccaagacaacctatttcatcttaggatagcactattagaatattcttcctaattttgagaagaaatctgtttcccaagagtttttacacatagatcagtggttttcaactctggctgaatatcaaattacctggaaatgtttaaaaatgtaagtcgtacccaggtcacactccctagatataactaatgtggagtggagtctgtctgtatttacaaaataatttcattcattcatttacttgttcatttgtttattcattcccaggtgattataatgtgtagttggattgagaatcatagacttcaggcttggttctatcccatgggttcatgtgaaacaagcctaatctttcttccgcaaaatagtctttggaataatcaagaatgttatcctgatgctcccttgagccttctgtggtttaaacatttccggtttctttccatgaggtatgggctatctaaggaagagtaaagcaagaccaccaagtctcttgttccatatactattctttcaaacagctcaagctcagagtcttttgttgttgtcgatatatcatattttgagtcatattggactcattatcttgtttgctatgtaccatcaagccactttataaaaaagtagactttattttttagagcagttttaggtttaaggaagaattcaagagaaatcacagaaaacctatattccttctctcccctgcccacaatttcctgtattattaacatcttgcgttagtgttataaatttcctacaattgatgagccattattcatgcattattattaactcaagtccatagttttcatttgcatttgctcttttcatttgcatagttttcatttgcatttgtgttgcacagttctatgggttttgacaaatgcataatgcattgtgttcaccattatattatcagacggattaatttcactgtcctaaaaatcctctctgttcttctgctgtacctattcatccttccctccacagctgtttttactgtcaccatactttgctatttttaaaatgtcatatagttggaatcatacagtatgtagtcttttcagattggcttctgtcacttagcaatatgcattttaggtttctccattgtgttttcatggcttgttagctcatttctttgctgagcaatagtctattgtctgaatgtgctacagtttatccattcacctactgaagtacatcttggtcacttccattttagcaactatgaataaaattgctataaacattaatgtgcaggttctcgggtggacataaataagttttctagtcatttgggtaaatgcctaggagtgcttttgctggataatatgataagactatgtttggttttatcggaaactgccgttcaaagtggctgtaccattttgtattattaccaccagtgaactagagttcctcttgttccatatcctcgtcagtctttgctattgtcagtgttttggattttagccactgaaataaatgtataatgaaatctcattgttttaatttgcaattccctaatgacatataatgttgagtgtatttccatatgcttattatccatctgtagatctttggtgaggtgtctgttcagatctttgcccttttaattgggctggtttctttttgttgagttttaagagttatttatatattttagatgcaagctgtttgctatgcattttgcatatattctttctcaggctgtggcttgtctttttatccttataatagtgtttttcatagagcagaagttttaaattttactgaattttaatttatcaatttttttttctttcatggatattgcttttggtgatgtatctaaaaactcatcaccaaccccaagatcacttaaattccctcctgtgttattttacctttaggcctatgatccattttgagttagcttttttgaaaagtgtaaggttagtgtctagattttttttctgggagggggcaactgttaggccacctttttatccttcctcttttagtgcatttgggattttttttctaagatcagagcctcaaatatattaatattatctctattaatctttgaaattatggtctgtcaaatctgtcaagatcttttaaaatttttattcttttattcatacaccttttcacatttattaatgtgtttttacaaatatttatttagtgcccactatgagctaagccttgttctaggtattggggatatagtcttaacaaaataaattccctatccgtccttaaagagcttcatttcaaggtttgaaagcaagaatgcaggtgagaaacaaatatatcaataaatgtataatttgtcagatggcaatgagtgctaagaagaaagattaagcagggtaaggagacaaaggttattttacttattactattaactcctaataggggtgttattttactgcagatggtcaaggaaggtgggtctgacaagatgagctttgaacagacacccaaaggaaatgagttagtcatgtagatgcttgaggaagaagtatcacagtatcacgagctgtgatactgcatgtccaaaggccctgaggcatgtgtgtatttgacatatttgaagcatggtaaagaggccagtgtagttggagtgaaatgagcaaagggtgagagtaagagaggatgaggttagagaagtaaggaggggaaaatgtcagctttgtatcatttatgtatctagtaaattacctttcacttccattgttgacaaagtattgcctaagaaaaggctgaagggggaccctcaatgaaatgtcctaggaatcttccagcaatttgacatcattccaatgagcatcacattttggacatagatattcagttggtagctcatccacttacttgttttctagcatgttgtttccacatgtcttcaccttgtccacagggatatcataaagtgacttgccaggcatcttgctaaagacctgatgtaatgtgtctgtctaatttccaagatctactaatgtagctaatctgtcaaagaaggaaatgaggacagtatgaaatcacttggccttagtgagaacacaggctaattcctcatgatcacttatttctgggtgttcatgaaccatccttttcatcaggattgacatacatacatttttttaaaagtcaaatatttgcgaatatgtaactataaagcccataattttatttttagaataaaagtggaactattcatcctaaaattagatggtagtattttaaggagtcttcctttttcctctgtgttcactgtgaattaatgtcatataggacttactggctcagatgctggagtcttttcttgcactagttggatgtccaacaattcaattcaatttgatggaattcaattctgataccaacgcctggagttagtgcagactccaaggggttaagggctgagtttcacaagactgtccacacttcaggcgccagtctcacatcttggggaaatggtcacctgttcttctgacctgccaactacaaatccagggttctcccaacctcccctcaggttcggtaactcaaactcaggaaagcactttacttagtttaccagtatattataaaggatactactcgggaacaacaaatggaaagatacataggtcaaggtatgggggcagagggattggcatagagcttctatgccctctgtaggtgtgcctcctctcaacacttcagtgttgaggtatttgcttccagcctggaagctcctcacactccattgcttaggaaggttcccttaagcaggcatgatcaattaaatcattggccattggtgagttaactcaatctcaggcccctcgctcctccctggaggttaggggtggggctaaaagttccaaccctctaatcaccttgctgatctttctggtgaccagctcccatcttgaagctattcaggggcccaccaatcacctcattagcacaaactggcaagattgagagggccttgccatgaataacaaaagacatttttatcgctcaggaaattccaggggttttaggaactctttgccaggaaccaaggacagagaccagacatacatatgtatatatatgtacgtatgtatgggtttttttttgttttttttttttcctgagacagagtcttgctctgtcgcccaggctggagtgcagtggtgcaatctcagttcactgcaacctccacctcccaggttcaagcgattctcctgcctcagcttcctgagtagctaggattacaggcgtgcatcaccatgcctggataatttttgtatttttagtagagacggggtttcaccatgttggccaggctggtcttgatctcctgacctcgtgatccacctgccttggcctcccaaagtgctgggattacaggcgtgagccaccgcacctggcccagatatatatatatttttattatgccataggtgcttaagcccatctgaaatccagacatttaatttttgtctattagtatgtatagtgtgatatcagttggagggagtgtttcctattttaatattagttgcattatgtctattgaaatttagtgtttggttttagaagtatacatattattggtggcttaaatggttcattgaagtctatgtatgtatctgaaatcaaatggtatcaataaaaatggtaagtcttaggcattgttttgtgactactttgaatcctacctgtatttctttatgtatggtcataacaaaacaataataacctccttttatttagtgcaataccagttatgaacagttaccttaccagttgctttacatactgctttacaactggtttactgagaagttatcattattccctccctcaacacacataatttcagtgatgaggaaattaagatccatagaatttaaggtcactcagctaaaaagtagcagagttgagatttaatccaggtctcttgggctctgacatctgtgctcttgtcattacatctgcttcttcctatttgcatgtacacttgacttcctataaaggatgtaatagaatctgcacttgactggaaatgatgcccttgactagctagctgtgtaagagacaaattattgggtttgaattttattttcaaagtatggagctgactagatggtttctgaggtccctctggctctaaaagtgtaaaactgtaacgactatacataattgctttgatagctatttttttcatgtctatcagttatgtaaaatttacgaagacagtcaatgtaaaactttaaagaagatatcccacatttttaaacctttaaccttgtggctctaggttgataaactcaccaaaggcttccttggtatttcagacagattatgagggacaagccaagaaactcctggaactgatggaaaacacggatgtgatcattgttgcaggaggagatgggacactgcaggaggtatgactgtttttctctttgaagctattttgaaggtgagaaaaatggaaattaaatcctagagcaatggtatgttgtaatttaaagaaattttttattttaattcattattttaggattgttgctctctaaagctagtatagctttaaatttttctcctgcacttccatttcattgctttttgtaaaccctctacccagcacatagaaggatttttgtattatcatatttaagtttgataatattgaatataacagaagaaaaaatgatggtggatgggataatcttgttatattttgaagactcttatgaagtagccctgtttgtaatggaatcatagtttccatcaacaggtatgtttcttataaaataaacagatattcagctatccattctcatgtcatttccattacatataatattatactacattaataggaagaggtatacatgttaagatacatgcatctgcttttgttttaatattgcatcttctcaatgagatgccactatgcacctattagaatggccaaaatttcagaacactgatgatatcaaatgctggcaaggatgtggagcaacaggaactctcattgttggtaggaatgcaaaatggtacagccactttggaacagctgggtgttttcttacaaaactgaacacactgttaacatacaatccagcaatcatgctccttggtatttaccaaaggagttgaaaccctgtgtccacacaattgcacatgtagcagcattattcataattaccaaatcttggaagcaaccaagatgtcctttagtaggtgaatgaataagtaaagtgagatatattcagacaataggtattattcagcactaaaaagaagtgagctatcaagccatgaaaagacatggaggaaacctaaatgtatgttactaagtgaaagaggatagtctgaaaagactacatactgtgtgattccgacaatttgatatctggaggaggcaaaactatggaggcagtgaaacgtcagaggttaccagatgttgaagagagggatgaataggcagagcacagaggattgttagggcagtgaaactattcattatgatactgtaagggtgaatacatttgtgttacacacaaatttgtttaacacaaattttttgtgtgtatttgttatacacaaatgtataagtgttatacatttgtgggaacccatagatctgcaacaccaagagggaaccctagtgtaaacgatggactttgggtgatgataataaggtgtcaatgtaggtccatcagttgtaacaaatgtgccactctggtgaaggatgttgataatgggcggaaggttcacgtatagggggccagaggggacatgggaaatctctgtattcctctcaattttgctgtgagcctaaaactacttttaaaacataaaatttattaataaagatacccttaatgcttactttggtccattaagggcggtaagtatgttaccctgcaagtactcttcttttctagcagcagagtagtgcattcattatattttggaaacccctaaagagcccagtgcaggtgatcccacgcactgcttaatttttcattcctgtatactatatttcatattcatacctcatttctgattgcctgttgtccccattcattggttttaccagtgttcagggatcagaagctaacagcagagtactgtcctatgtttgacttagtcattatgtgagccttagtaagcttcttttaaaaaggctgtgctaatgatgttgtaattgtttttatggctttttaatgaagtgtgaagaatattgatagcatgcctacaaagaaggaagtagacctctcaacagccccatttattcctgaaattcagtgaggcaggagaagatgaagggaggagatctgggtcaggttttactttacaaaatgtttttaaagaaattgtgtatttggtataattacagtcatataaaaatatgcactgattagaaaaaggattggagggaaatatatcaaatataaacaagtgatttataattggttatctggggctgggtgtggtggctcatgcctgtaatcccagcactttgggaggccaaggtgggcggatcacctgaggtccagagtttgaaaccagcgtgaccaacatggcgaaaccccgtctctactaaaagtacaaaaattagcagggcatggtggtgggtgcttgtaatcccaactacttgggaggctgaggcaggagaatcgcttgaacctgggaagcagaggttgcagtgagccgagatcatgccatcgctctccagcctgggtgacagagtgagactccactgcaaaagaaaaacaaaataataatagttgtttatctggcatggtggaattatgagaatttttttttgtatttaggtatttttcagtttttacagaatactatccttcttcatatttgtcaataagaacgatttgttaagtgcacactctctgagtgtagcaaagtgcttttttcctgtatatgtacttcatagtggtaaactagggttttctgtataattgatgtgtacatcatatttatacccattttatagaacttaaaacatatttttagtaatacaacttggagtttttataattattttatcttagcctttattgtattattgatcataggtcaaaaataaaatctaatttagctctgattctattggagaatactatatgttttaagatccagtgcatcttttaacagagcttctaagaagaaaacaggagtaagtttatggtctatgaaaattgaatccaattcttttattgtaaaggaaatacatattatttataacaatgttttattattacatttgtaggttgttactggtgttcttcgacgaacagatgaggtgagcattaaagagtaattgcattttaacttttatttttctgttcttttttattgcttttctttcttttactttttttttccattgtatattttaaaacgggtacaaattgtgctttcttgaattttagaaaagaaaatactgctacccatgtcatagaacacgtatattaacacatggggacttttctggtttggtaattgatggtatccaataactttgacaatggttatttaaaattttgttatggaatctttttttcaaagaactttttcataaaagaaattgtggcatattcatatagtgggaatcatctaacagttaaaatgaatgaactaaatgtataaatatctacatggctaaatctcaaaagttttgaataaaaaaaaaagcaggttgcccaggtatgttatgcatttctacagtgttttaaaattcagaaaacaatactatgtatggttaatggatgcttaaatatgtagcaaaagaataataatgtggatgaaaaggaatcacaccaacctcaggataatggtctcctctgggaagggagagaggagaatagttttagaagggactttcattgtatctctatcgttttatttcttgaaacatatgaagcaaaaaggtaaatgttaacatttgttaaatataggttgtgggcacatgggtgtttttgtaacattattttatgcacttttctacaatagctagaagatccttctcagtccctttggtaatagtacattgtgctcagaattgttttgaaccttacagtatctattgtatgtgtggcatttaattaactgctatgccagtaccatctattatttgaacttgtttattctctttgccttatttgtacttaagatagtttataaagcaccttcacctgtcattggtcactgtataaatggtagacatttttagttgaattttatctgcaactttatcaaatagtgtgacaatgttatacagtctctgttgcactagtgcattgatatattatcttcaaaaccctcattatcttaaccaaatttctttcaaacagttgtcattaatgagtactaaaatatttcttccaaattctgagtcattttgttttcattgactgccttgttttagaaattacccacctagctttatttgattactggtctaaggatgtggaaaggagatggggaggcagatacagggtcagttatttgtcatagtggacacacctgtgcttctccattaagcctgattttctgatcataacaataaaactttcctcttctttccccccccaggctaccttcagtaagattcccattggatttatcccactgggagagaccagtagtttgagtcataccctctttgccgaaagtggaaacaaagtccagtaggttgtcaatgtggggaattagcatttgtgggtgagcgagactgggaatgaaaaatttatgtgtatgctataactttcttgagttttgatagcctgaaacttcaaataattaagaggaggacctagatcagagttcagcctttcagttcattgggaagtctcccaacttggttgtgggactcttataataagtctccaggtcaggtagggaggtgaatacttgatgtccttttgtcagttatgaagataatatccctgacctaaaccgtttttgtgcttgtacattgtaagattctttagtgaagacatatttgtgctgctcatttgtttgctttaagtatatgcaatgacaaataacaagtcccttgtgaagactgaactagtagcctggcttcattatcttgatattaaaaatagctaaaacaagtaaatatagccacatccttttgggaatacttaaagtggtagacagtgtagacaaagtagactgggaaagcagtgtagctctgacatctaaattaaattgctgtgagtctcacagtgtttttgggagtcaagcaaattgttgttattattgttcttttttgcttgaaggcattatgtaaacaaagctctgctctttcaagaagataggaatcttgaatttgagctttgacagtgattaataacatcattttgagcaaatagttgtcaagaagacccaaataaatggagagatagctgagagatcagttgcctgatggttaacgtaagctttgtgacacattggaggaagtcaataaataaatatttgttgcatgatttaatgaaaattttctcatgatttttctggttataatcttctagaataaataataataatacccaagtgattttctgttttggttaaggatttttttttctgctttggaattctttgattaggctggcttttgtgaatttatttttgctattgtaatgttaggagtcaactgtatctcttttaacaattctatattttaataagcatcttagtccagttttcaaaacactaggcatacacacatatatatatgtcagatcttcattcaaacttcttttatatttcaaaccttaatataatggggattattcagctattcattagccatcctgagggcctaactacaggagaggccatttcagttggccatcctttttttttctttttctttcttttttttttttttgagacagagtctcgctctgtagcccaggctggagtgcagtggcgcgaactcggctcactgcaagctccgtctcccaggttcacgccattctcttgcctcagcctccgagtagctgggactacaggcgcccgccaccacgcccggctaattttttgtatttttagtacagatggggtttcactgtgttagccaggatggtctcgatctcctgacctcgtgatccgcccgcctcggcctcccaaagtcagttggccatactttttattcccggtttagaatttctgaggggcagtagataatgacagttaattgctcacatttttgcttttccaagatgaatcctgtctgattcaggtgttggttacattagagagcttgtcttctccttgtgtcagtgtagattttttgaattgctttagccagtattccaaatagcatatgtcattgatccaagggtagaccattttccttggagaccccttgcctgtccaaaagctaatttacacagagtgtggcaacccccagggtctgagagagtcttcagtttgggggaactgattttctcttgtagttaaactactactgttgctgctgctatttatagtttaaaaatttataaaacttaatttataagcatgccccagggctgttaggtaatccaggaagtctgtcctgagttcagagttctgtaggcctcataaaatggcagaagcctaaggctatttaaaaagaacaaggctttgctttttgcactgctgtcaagatttgttgtaccatagttaccacagaggaaaaaagaattttgaatttggaatgttgcaagtaaataatctgaaaagtgctattccatgctacagtgctgctttatttagaacttttagttattggcaggagaatgataaattataggttgcaattttagctgtcttctgccagcaatttaggaaaaaaatttaatataaaaagacttgatgagttacaacaatttttttttaaggtcagcctctcaaaggcatttactaaatctctcagtgtgttaaatactgttcagaataagtacagtgctttaggattctttctgatagcttttttcagaattaatatattcatatcaaattaaacttgtgagcatgctgcttactttctcctacactgaaactcatattccaaactgctgcctacttcccaagtagcatctatattggagagaaaaaaatggtgtaaaaatgagttgatagagaaacatgagaaagtataatagtttcagctagagtttaatccaagcatttgagttaatgtgtctatcttgggattttaaagtatcttaagttgtacctaactttgttagaaacactggtttaggtggatttgattccttaggtgtttacatttagtcctgagcacattgatggggaggcctgtagagcacccagattttagatgtggattttttctttgggaatccattgatatccatttgatacgtccaaagcagccttacaggttaagttagcacatctttggagacaaatttcattttgtgacatgctggctctgtcctcttggtaatttcattcaatctctctgaacctcaatttctcttacatgtgtttatcaaatgcacactagtagtacctacttcagaagattgttaaaaagctaaagtaggtctatttacgtaagtgtaattatgcctagtaaagtggactttattcatatttattaaaaattcatttggggggacaaacagtaaataaataggttgactacaattactgagtctagattctataattaaaacaaatataaatcaaaacagataagcctctattctattgctaactgcttcacctagaaaagttttttttgtttgtttaaaaaaggaaagaatgttttgtagtcattcaaatcagttaccataggatggcaacaatttctatgaaattcacagtatcaaccagttctgcacatagcagaatagattaggaggtgccctgtttggttaggaactgcccttttttgaatggaaattaaagtactttctaaatgacttctacttgtagttgtacttaaactccagacaaaatattttactttattaataataattaccgtatttatttttccaaaatatagctatgtaacaatagaggcaataggacactaacactgatatacctttacaaaaacatgaaatacatatggataaatctaacaaaatatgtgtaagatttatatgatggaaactacaaatcagtgaagagagaaatcaagaagacctaagtaaatagagatacttctgtgttcatggattgtgaggcttcgtactgagatgtcattctctccacaactgatctataaattcaatacaatcccaatcaatgtttcacaaggctttttgtagaaattgaaaaattgattctaaaatttatatagaaaaataaaggaagcagaataatcaaaataattttgaaaaagaacaaagtttaaggatttaccctatctaattccaatacttactctaaagctacagtgatcaaaacagtgtggtgctggcaaaacaagagacataaatcagtagaagaaagagtccagaattagacccacacacatatggacaattgatttttcaataagggcaccaaagccattcaatgtataatagaaaagacagtttttttcaacaaacagtattggaacagttgaacatatacaaaaagtaaacttcaacccatacctcacactatatctaaaaattagcatcaaatggattgtaaacctatatataaaacctaaaactgtaaagcttctagaagaaaatctttagtcattagagaaatgcaaattaaatctaccatgagatgccactatgcatctattaggacagcataaacaagaaaaaaaaaaagcaaacaaaaacccgtcaaataaatgcagcaactgaaactcttggatatcattggtgcaaatacgaaatggtagccactttagaaaatggtttggcagtttcttgtaaaattaaacatatacctaccatatgagcagcaatcacacttataggtacttattcaaaagaaatgaagatatatgtccgtacaaaaacctgtacatgaatatttatagtagcttgattcctaactgccaaaaactgggaacaatgccaatgtccatcaactgatgaatgggtaaacaaattccagtacatccatacaatggaatatggatagtctactgatacatccattcataaacaatagtgtagatgaatttcaagctcatgctaagagaaaaaaactgaactggaaaggctccatacttttcgattctattttatgacattctgggaaaggcaaaactctagacgcagaaaacatagtaattgtcaggagctgaaggtgcaggcagtgggttggctgcagagggttatgaaggaacttcttgggatgttgaaaatgttatatatatttgtcatggtgatagttatatgactgcagcttttgtcaaaatttataaaacagtgtacctaaaagtatgaattttactgtgtatatatcataccccaataaatctaactttaaaaaagaagttacacttccagtttccagttccacatgtaaggagcttggaagttgtcactctgtcctaacaataaacaaaaagctgaacaacctgaaaactcagcaactcttcttgtatctgaaggagaaggtaggacatagggcaaactgctgcccccaagattggagagacaggggaatacaggggattttgacttaacgaagacacacactggaaaccactttggaaaccactttggaaaccagtgccagggtaggaaaacctgacctgtaattgataaattgctgaagctcagtgtgattagctctgagaggagtcccagtctactgggatccagtcataaggagtcccccacaatattgtaagatatgcctccaggagctcaaccaggagctcacaataaatatcagagaaaaatcgccttatacttctggcactggtggggaaaaggaaccattttgaaatatgccacagtattctgttcttcttaacaaggcctgtcctcaggagaaacaagttaaccagagcccaacctgctggagtattatcaaggtttaactggagaagggaaatacttaattctagtcagctccagccttgcatgtgggagaagggaaaaagccaattccagcctactctagccattctgtccacctaagggaagagaaaaaactgagaaacatttgttcaaagtccagagacaggctcattaaagcctgagacctaatcatcgaacctaatcattgcttcccctcccttcacatgctacatggatgtcaatagtacatgccttttgatgatactttttttaacctatagactttccaaatggctctcagaatgtagataagaacggtctgtgttcaaaagaatcagcaattaaaatgaagcgcatcctagtagtcctggaaaataagagaaatatgtctcaggttctggattatattttgctaagataactataacaaattctgccctttagttactcttctggctgttagagcaagaataagtattgtttttggaaatgcctgaatttcttacaatgaataaaaaaagttattaagtgtcatattttccaatggtaaataggagtcaggcacaatgtagagactcagtaaatgttaaatgaatgaatgatcagtgccttgtatgaacttctccttgccaaagctttctctttgagtccctataaactactagtactttggcaggagggagggagagagggaaggagggggagagagagagagggagagagagagaatgagagagaatatgtgtgtgtgtgtgtttgtgcatgagtgcatgtggcagtgtggtgggggagatgttgcctatttttcataatatgatcatttccttttctcttttagacatattactgatgccacacttgccattgtgaaaggagagacagttccacttgatgtcttgcagatcaaggtaaatcttttcatcacatattggaaaaattgtgaaagtaatactcgcttacatgttaaagaaaataaaatgtagcagttcaaatgaggttataatgaaaacaatagttgctcttccattcctaccccaagtattagtccccagaggaaataattttacctgttaattctagttgttatcactaattaatatgcttttgctcctatttttaaaatgtggctaaaagcataatatttatcattatagtcatttttaagtatacagttcagtagtgttaagtacacttagctactttttttttttttttgagaaggagtcttggtctgtcacccaggctggagtgcagtggcacaatctcagctcactgcagcctctgcctcctgggtttaagcaattctcctgcctcagcctcccaagtagctgaaattacaggcacccacctccacaactggctaattttaactactttttgatttatcacttttagaccttatctttgacctctttgttatacaggcatacctcattttattacactttgcctgactgcatttcacagatattgtgctttttacaaattgaacgtctgtggcaaccctgccccaagcaagtctaccagtgtcatttttccaacagcatgtgctcacttcatgactctgtgtcacattttggtaatcctcacaatacctcaacctttttcatcattactacattgttatggtgatctgctatcggtgatctttgatgttactattgtaattggggcaccacgaattgtgcccacatataatggcaaacttaattaaatgtgtgcgttgactgctccaccaaccagccatttccctacctttctctgttccctgtgacacaacagtattgaaattagaccaattaataaccctacttggcctctaagtgttcacataaagaagacgcatctgtctctcactttaaatcaaaagctagagatgagaccaggtgcggtggctcttgcctgtaattccagcactttgggaggtccaggcaggtggatcacttgagcaggagttcaagaccagcctggccaacatggcgaaacaccatctctactaaaaatacaaaaattagctgggcatttaaaaaaaaaaagaaaaaaagctagaaataggtatgcttagtgagaaaggcatgttaaaagttgagataggctgaaaactaggccttatgccaaacagccaagttgtgaatgcaaaggaacagttcttgaaggaacttaaatgtgctactacagtgagcatatgaatgataagaaagtgtggcctggtgcagtggctcatgcctgtaatcccagcagtttgggaggccgaggtgggtggatcacttgacgttgggagtttgagaccggcctgaccaacatggagaaaccccatctctactaaaaatacaaaattagctgggtgtggtggcacatgcctgtaatctcaggtacttgggaggctgaggcaggagaatcacttgaacccgggaggcagaggttgcggtgagccgagatcgcgccattgcactccagcctgggtaactagagcaaaactttttctcaaaaaaaaaaaaagaaaaaaaaaagaaagaaaaaaaaaaagaaagtgaagcagccatgttgctgatagggagaaagtttttgtggtctagatagaagaccaaatcagccacaacattcccttaagccacatcctaatccagggcaaggccctaactctctccaattttatgaaggctgagagaagtgaagaggctgcagaagaaatgtttgaacctaacagaggttggtttatgaggtttaaggaaagaagccctcctcctaacataaagtgcaaggtggagcagcaattagctgatggagaaggtgctgcaagttatccagaagatctagctaagatcattgacagaggtacccatactaaacaacaggttttctatatagacaaaacagccttttattggaagaatgtgccatctcagactttcatagctagagacgggaagtcaatgcctggcttcaaagtttgggacaggctgactctcatgttaaaaactactgcagctggtgactttaagttcaagccaatgctcatctaccattccaaaagtcctagggcctttaaaaattatgctacatctactctgcttgtgctgtataactggaaaaacaaatcctgggtgatagtacatctgtttacagcatagtttactgaatattttaagcccactgttgagacccactgctcagaaaaagcaattcctatcaaaatattactgcttattaacaatgcacctggccacccgagagccctgatggacatgtacaaagagattaatgttgttttcttgtttgctaacagacattcatcctgcatcccatggatcaaggaataatttcaactttcaagttttattatttaataaataaattgtggaccaaaggtcatcaatagatgaactactgtcttggcaacaaagtgagaccccatctatacaaaaaaactttgtaaaaaaattagacaggcatggtggtgtgggcctatagtcccagttgccatagatagtgattcctctgaaggatctgggcaaagtaaattgaaaaccttctggaaacgattcaccattctagatgccattaagaacattcatgattcatgggaggaggtcaaaataacaatgttaacagaagtttggaagaagttgattccaaccctcatggatgactttaaggggttcaagatttcagtggaggaaggaactgcagatgtagtagaaataacaagagaactggaattagaagtggaacctgaagatgtgattgaaatgcttcaatcttataaaatttgaatggatgaagagttgtttcttatggatgagcaaagaaagtgatttcttgacatggaatgtaatcctggtgaggatgccgtgaaccatgttgaaatgacaaaaaaaggatttaaaatattacataaacttagttgacaaagcattggcagggattgagaagactgactccaactttgagagaatttctgctataggtcacatgctatcgaactgcatacatgctgcagataaattcatgaaaggatgagtcaacagacattgcaaacttcattgctgtcttattttaagaaatggtcacatccaccccaaccttcagcaaccaccaccctgatcagtcagcagctatcagcatggaggcaagacactctacagcaaagattatgactcactaaaggcctagataattgttagcattttttaatttagcatttaatgttagcattttttttaagttaaggtgcatactttttttgacataatgctgttgcacactcaatagactatagtataatataacttttatatgcactggaaaaccaaaaagtttttttgactcattttattgtgatactcactttactgcagtggtcaggaaccgaacctgcaacatttgtgaggtatataagaattgctctctatctcctctcaatataattgaaatgctatttttagttcctttattttatttatttatttatttttggacaggatctcactctgtcaccgaggctggagtgcagtggcacaatcacagctcattgcaacctcaaactcctgggctcaagggatcttcctgcttccacctcctaagtagctgggactataggcccataccaccatgcctaattttttacaaagtttttttgtatagatggagtctcactttgttgcccaggctgtagttcatctattgatgacctttggtccacaagtaattcgtctacctcatatggttgttttgaatattaaaagagttaataaatataaataaatataaaatacttaggacaatgatttttacctgtgtgtatggtggccacctcttcctctcatgccctgccaaaggtgaaactgttctcatatctcatcactctattagagtagcttttctttttttgaattcaggctacttggtcatcttgcaatcttagctctttggtgagctttattaaagttatgattttgtagattatctggctttttctcatttttagggtgggactatgttcttcgtactttcctgcatgctaggtgggaatagaatttcccatttttcttattgtgtaatgttttcttactgatttatacatgaactgatgaattattttagaaatatattttttaaaaagccttagaagcaatgatacctaatagcagtgatcatacctggcacccagaaggtggtttgaaataccattcccaataaaaatagccaaggcgctgtgaaggattggctttcgcagggcaataacaagacaagaaagtactcaaaagctgatggagatatcacaaaagatgtagcctgcaggtgtcctactcgccaatttgggactctttgaatattacaaagaacaacaatgatggatcataagccttaaaaatgaagaatccatgagtttccagtgatatttcaggattgccagcttgtaaatgcagaaggaatgatagaaaatcgccattttttaaatcacctgcgtaataattgattcaggtagagatcatcagtgaatactaaaaccactggataaaagattgttgggaaacaaagcccacagtctcaaagtatctcagattacttaataatttaaaagggaaaaatatactttgataatggagaaatctagtgatcaaacttagcatcatgaataatggataaactgacattgtctgcctcccgaagtgatatactgagaaggctataacatcacctatgtattttgctgcacaaagtgttaactaactgaatataatcatgaagaattagacaaatccaaattctaaaagcaaaaattggactcatcaaaaaatgtcaatgtcatgaaatccaaaagaaggtagacagtctgttcaggattaaggaatactaaagaaataactaactgcagtacaagagcctgaattggaaaaatgagaaacaatggcaatcatgagaggcagtattggaacaattagagaaattttagtattaactatatcttaaatattatgtattgatgttagatgtcttgagagggacagtggtgttatggttaagtctgtgtatgttcttgttcttaggagatgcaagatgaaatatttagtggtacagggtcatgaagtctgcaatttattggcaaatttaacatctctggagaacatatacacatagataaagctaatgtggaggaaatgttggcagctggtgaatctgggtgaaagctataaatggtgttcattgtactgtttaaaaattgttttggtttgacacttttccaaaataactttgagggtaagaaggtccagtagctgttgtcaattcttgatcagggttctctattaaaaaataatttaattcttagaaaacagatattctcacttggatagtagttacatagcgattcctttttcatctaaactcttatttttttttctggaaagggcaaattcctaggaaggcaaagctgcgaagtaaaataaccctataaatagtgagccccatgttcttagatttggccttaaaatgtaccagctactttcaggatgaacatcttatattcattcacgttccctgatatttgtgaaagaaggatcctcactgtgtcatgattccaaagttcaatcccaaaaagttgctgttagttacatagagcttgctctatgtatatttacaactggtgaacccatgggcttgccttttattttcttctcgtgcactgatgtctggactcttcaccatgacctcactgatcatgataaaagtgatttaaattgcagttgatcttttagcatataataaagctaacttgttttcataaaatgggatggctatgctgaaatttcagcctaagaaaggtactacagattattatctatggagatactatttaaaatactgttattaccaaaggaggtgcatcaggatacatctcaataactgatttattctttcttatatatgtgttagaagtaatccatcccagagtatctgagatttaactggaaattcttgctgtgctttcatttatttatttattgagacggagtctcactctgtcacccaggctgaagtgcagtggcacaatcttggctcactgcaacctccacctcccaggttcaagccattctcctgcctcagcctcctgagtaactgggactacaggcgcatgccaccacacccagctaatttttgtatttttagtagagacggagtttcaccatattggtcaggcttgtgttgaactcttggcctcctgatacacccacctcggcctctcaaagtgctgggattacaggcgtgagccaccgcacctggcctgtgcttatatttaaatgtctcttgtctcttttatgtttttctttgaaatatgctgattttgtgaattgatgaaaccagtatcaaatttaccacaggctctgtgtattgatgacacaacccaggaagaaaattctgaaaatcagttcctagaaaacgtggtacaacagtctctgctctggtttctgaggaacccaactaagttggatacattttctcttttttccttatttctgaaaattaatttcagaatatggggaaaaagattatagacaaagccttgtactataagcattatagataaagcctgataccacatttttcttcttttaaagaacaatccaaccctattaaacatatatctgacgattctccatagataaaagaaatagttcttggaaacaataatgccttatatttagctttttagattgttcaatctgtgttcacatttcacttgaatctcccactcagtgaggaagtcgaggtgagattcgtatcctcatttgacaggttagggaaaaaaagaatcctttgattatgacgagttgtgctggagatgtaactagaatttagattttctttctcatagtctgttggtttttccacttaagtgctttgtccaggtggcatcatagttggcaccattccatgatttttgaagggcagtttttcccatatagacatctatgatgcctgataacttgactttaaagtaattactgggaaggtttatagaattctttgtagctttttctttttgttttttcaactagattcttaagaccctgccaacccagaaccaaataaggcatagaggggagttcatggggagttagaacctttcccttttccctatttgccattcctggctaattacatggactccttctttttagaccctggctttgatgattctcttaagatgatgcttgaagctgcttcagaactcctttagaacaccttctactttgtttctttctctttatctaggatccctgaaatttccagattaggcatctatctagtttataggacttgttttcttttcagtgttccttaagcgtttattccaacctgctcgctccattattttcttccacaaaccctaggccattttctcccagggatttactgtttctaggggaggctgtgaattggggcagcacatctcctttgctgtgaagatctgactgtgtgcttgtctttctttttctttttgtttttgtttactgacccaaccatctcaaaatttgactgcctacccagatgagtgggttaagatacagtgggactttgtctattattggcttctactttgtccatctgaccttgcatgctttttctgtgttcatgtgtaccccaacagggactagtctctccatgactggtcctcagggctattctgaatcctgacagtcctatgcccatctggaatactaattattctctagatctgctcacacatattctgccttgctggctcatttcctgttgtccagagccattctcaccttttgctaggatacagcactccacatcagtggaactttggggtcacaaggctttttatttaattctaatggaatgttcctaaaaactcttccccccgagatgaagaaagagaaaacagggttagaggatcagtcggcaaccctcagtacttatctcagtgcttcttgcctacactacatgctttagaacagcatttaccaagaaatatgaattatacaaaaatgtcctcccaaagaagggttgcacagttaacaactcaggaaagctgtatattgtgcttcctcttttggaaatgtgtaatgtacattaacatattaaagactctaagaactgtagtaaacataactggcttcaaaccaagtaagtttggtattttccaatttatttcaccatggaatcttctatcatcatcatcagcagcagcatcatcatcctcagacatagcacttgttaacatgttatgaaacatttggggaaatgatgctaaagacatatactgttatttctctcccttggactagaatcactttcttctctcctttctcttctttccagttctttccaatctcccctaatctaggtaccttgttttttaaatgatggccaaatagtgcaaagttgcagttagataggaggaataagttttgagatctattgcacagcagggtgactatagttgataataacgtatatttaaacataactaagagaataaacttcaaatgtctcaccacaaaaaaggataagtaaatgaggtgatgaatatttaattagcttgatttaatcatcccacatgtcaattacattgtaccccataaacatatacaagtgtgatttatcaattaaaaataataatttatgttttgttttaaaatttatattttccttgaccatctccttagctccccccacccattgtacaattgtacctacttccctgatactcaataggtatctcaatataaatcagaagcctttggtgtatgaaaacttaccacactattatacttacttagcaattttgttaagttgaaggcattaagtgggatttaatttagacaatttttagattcagttctagatgagagaattaagagggacactgacaagcaacagagggggttgggtaaacaagataatgaggctgtaaaatcatggcggaacaacggaaagactagacgtttagcttggagagcattaaggctagggagggaatgtaagtgcttcgaggcagagagtatgttagtgtgttcaccattgtgtcctcaactcccagcaccatgcttggctgagtaggggttccatcaatactgagtggatgagtgaaaacatacctgtcttcagatacatgagaggtgaggtttgtgaaattccagtgagggtaggaatatttttggctcatgtaaaagctttatgaggttattctgtcacctcattttatgattaaatatagtaatttttaaattttatgtatttatttattataaatttttactattggccactcactgctagcaattgaggatacagtgctgataacccctttatacactcataggagataatgtagagaaggttgtttaagcaaaagatgaccctgttttcagaggtagaagccaacgttcaaaagttaagtgacttgcctaggatcacttaggtattctgtgaggattctcacttcaaaacaattgttctacgttattatgccattttatagatctgtagtggtcagcatgtaacattcctaagaaataatacagtctttaaatgatcacttatactttgataaaatcatcacttattacaccccaaaattctggagtcatctttgactcccccattcaggcaagaagtcatgttggctctaccttcaaaatatatccaaaatcaagcatttcttcttgcctctgttcttaccactctggtcccagctgccttcatcttttatctggatcattccaggagtcctcaaattcttatcattccctctccccttgcctccctacaatctgttgtcagcacaacagccagtgtgtggtcaggaattagagcatgtcacttctctgcccagagcccatcaacagcttcccatctccgaataacaccaaagtcattcaaaggccttcaaggccaaacacagtccagtccctctgacctctccggcctcatttggatttctcatgtacttcaggtctctgttcaaatgttagtgcatcattgatatcctccatcacctccttatattaataagcaatcctgggtgtggtggctcacacctgtaagcccagcactttgggaggatgaggcaggtggatcatctgaggtcagcagttggaaaccagcctggtcaacatggtgaaaccccgtctctactaaaagaatacaaaaattagctgggcgtggtggcgtgcacctgtaatcccagctactcaggaggttgaggcaggagaatcacttgaacctgggaggcagaggttgcaattagccgagatcgtgccactgcactccagcctgggcaacaagagtgaaactccgtctaaaaaaaaaaaaaacaaaaaaaacccacaaaatttaaaaatcctccttaccctcaatgtctttgggctgttttttcatcccactctctctgctttctactatttctagctcctttattgttggtacataaagcaatgattagagaaaaatctttttccttaccattccctcttggttgctgatgcccctgtgctggctgtcttatgggttcatgtgtgaattctttgggattcctccccatggcgtacatagttttctgatgttagagatctgttctagctccacttttcaacttcctgtggagagcatccaggcttggctctctccacagcttctaactactgggatactatcatccctgggctaggctcttagatggggcattgtcaagatgactcaaagccctgttatcttacacactatccactaggcacccagaaaactaatatgtccttgctgtaccagccactgagttgctgcacgttctccttttttctctgccatttctctctggttcccttgtcccttactaaagcaggtacagagagtgaagattcaagtctactgcatgagcagatactcgacaaagggatgagaggccagcatcctttccttgcaggcttcttttattgtgtttgattctcctagaaatttctctgattctcctagtcattccaaagcaagtgacctgcttttggcgtagtggaaacaggagtgaatgtggtgttgggggaagcactcttacccttgcggagaagacagcatgctttctctaggcagcgacttgcactgccaaggatttgcctccagttcctactcttctccttgcactggctgtggtgggaatcaagctggttctgcccacttttagcaacttctgtggagtcttatgtagcattcggtagctctctttagagtgtgggggcactgggtgcctgtcagttttcagctcttagactttagatgaaattctgagctacaggaaaaattccatttagaatcctggtacctagattatttataatttttaaggaaggttcagggtagagtataaactcttagggacattggctgtattgtgcattttttctatatattgcttaattcactgatttattagaaactcactgattataatatgcagtatttggccataaagcattggaccaaatccaaatcactttttatttcgactttttgtaacacgtatttgactgtagtttcagatattcaggtgaaacattctagagtaccaggattctgatctgacttgagagctcttgatcctataaggaaaatgcaggcttaagttatctttgccttggacaagtacatgaaagaaaagaaattctagctgacctgactactgactggctcgagaggtaacatagttaggtactctcaaatttacagtccaaagtatgacagtatgttcccctgccagcagattcatgaaacctgatgtgtaaaaattaccttcatattacagtgtggcttattcaagtatttttactaagcactcacagggttaatgtctttaatgtttgagcagactttttagaattttggtttgatgaaaagtaggccatgaacatttgctgagtacttagatgtaaagagttctgagtgattatagtcatgaatttaaatgaaatgtatttaacttccagggtgaaaaggaacagcctgtatttgcaatgaccggccttcgatggggatctttcagagatgctggcgtcaaagttagcaagtaaaggattactatattgatgtgtgatgttttttaaaaaaatcttattctgtccctgcctttcaggttttaattcacagtgatcttctgggaataaatttggtgggcctggaggttgaattatgtgtgaataatggaggtaggaacaatcaggtagaggtttatgtcctatatgcagaaaggctggggaaagttgcagcttcctcaacactagctgggcagtagctgaagaggagaagggtatgtctctatttttagacacactatttgagcataggttaggctcaagctaggctgtagggagaactggattgcctatcattctgcagctgcttagctgggtaccaagtggaagggactgcctgggctacagccttacggagctgttgcagtcagacaacttttcctgagaggtatttttgtgaaggcctcgcagattgggagaccacaggccgctgctcttagaggaggaagaaaggcggcgcctggctgtgctgtgagatgggagaaacaggcctatcgaggagctgattagagggccagtgttggcttttcatgagaattgacttatttttggagaatccattgtatgcaatgaaactcttggcttggagagagggtgtgtcatgttccatttgctgtggagaggtaaagtaggcaagggcttgctgagcaggactgcaggggacaccatgtgagattcgcttcatacctggtggtggtattttctctttaccttttcttaaaatcgagggcttacagtttgagtatagtttaaatgaattgtggctgatctcacacatagctctcaagaaattgctctttcacttaataggccagcctgccatgctttttttttttttttaacagaaatttctctcacttgtttcactttattattcttgctaatgagattcctgacagtgaaatgtcaaaagagagacattaccatattatattacacattgcattctgaagtatttcacatctttttatttgcaagtgtgccatgattatgggattctacaaattaccttgtgtttgatctgaaatctcaaatccagcagctcaccaagagaaactgcttagctttccccaaaaaagtctggttaggacaaattgctttccaaaatgtgttaagcaacaagaaagcacagtacagatcaacgcttttaggactattttatatactagccccatatctcgattggtttctgcacaaagaattttaaaattctgattgttattatgtgctaccttggctaggcccttccacagagttgctgtttgtattaagaaagaaatggtagagatatgagaaatcatttcctagctggctgtaggaagactacaaagtcagtggcaaaatgtactattggtagagatgaaggaaactgaggaaattttagaaggtaactgcctgagttgagatgaccttctacttggctaactagggaaagaagcaaactataaagtaaattttaaaaaataataacacaaaaaatcagatgatcaagggcctcattagtagtagcacagtatcaacctgaataataatttagaatgtttctgcattccctcttggattatatctaagctctttgtctgttattccaggcccaacttactctgtcatcacccctaattatataattatgtatctttacttctaagcttttctctctttctctgactgttatcctatttcccatactctaagttttgtaccctgactttattctgtgccattcattttataggcatggctgctccagtgattttaggcccttaatgactttgtctctttttgattccccttaccaataagcagtgatcagtttatgcttttccttatagtcattcattgtttgcttttacatatttgggtcttattttctcaaatcataagctctcaaaggtgggaaatttatactttatatttcttctgtttcctccgcattcatagtgggtgctaaataaatgtatatgatcagaatcaacagagagcagttaatgttgagtgatttgttaacagagataagttttaagagaagaatctattttatgccgttttctaattccgattaggtgtcttcctctctccagtagcttttatgtatttagcaatatgcaatagattctcgttattcccagatttaacatttgccattttagagctatataacatgagtaatgtgaaattatgctggtttacacatttttaattgagtgtgcatatgtgcatttgtgtgtgtgagaggacatggtgtacaggatctagtcatttagcttgggatcagcacatcagagcatgcagtgtttgcatcttagtgtggctgtatcatcctttactcatagctcttttgaacgtacacttgacccattgtatccatagatgtaaacaaatgcagatagagaatatttggggaaaaaaatattccacaaaattccaaaaagcaaaactggaattggctgcacaccgagtactgtgttgaatccgtgcaaataaagtgatgtgtaggcactgtattaagtgttataagcaatgtagagatgatttaaaatatacaagagaatgtacataggttacgtgcaaatatgccattttatatccgggacttgaacatctgcagactttggactgagggacaactctataccaaactgtattctatggcttaaaggatgtgtttaaaggatgttgtgaatttagtgactcaaggagcctggttatatatctctcataaattgcaagaatctttactgcgtaactaattacatataacttgacaaggcatcaaaacgtggatttaaaattgaatgtaatactcttttatactaagccataacctcctagctaccagaatagccactcatagcagagatgtaattctaatgtattgtctgccatgaatggtatctatcacatgatagttcttttgatattcttatcagatttttatcttggtcttttcacaggtactggtatcttgggcctctaaaaatcaaagcagcccactttttcagcactcttaaggtaaatgtgatttacagtgtagaaatttgctgtgttattttgttgtttctctgtaatgcatatatttggtatttttttttaattccttgctacagatgaatgtggcatgcttcaacactaaaacagggcatgtttgattaaatacaaatatagaacgcattcctgttttgataagcaatcaccctttatctaccaattcattccctctactaccaaacccatatttaatctctcttaagcattctacttgcctttgctattaattcactctcttgcccgacagaccttgaacataatgacatattcttcagcgattattttatgcttgtctatgttagtacctggaaatgaattgaagatttgtatctgaatatataatatctaattgtacaggtttgtgtttgtatcagtaggtttcaaactgtaccagctaaatatgggcggtggttactgtattggagagtatagatatggaacatttccatgatcagaaaaagttttgttgggcactgctactctatatgatacaataaaaaatactggcatagagaaaagcctaacaatttttattagtgaaaatgctaatagaaaagtcatctttaactgtggactacagactatattcagcttttatgcaaatcaaagtggtatattgatagtttggccaatctgaaaattggcagatggggtttgaatgtagtgagaaggttggttccaatgttaatattcagagttattgaatgtttttctaattataaaagtaatacatgttccttgcaaaacatttggaaaacatagcttcctttaccttttaaaaaaattctggctggattaaaaaattaaatgtaaaaccctaaaatcactgaactactagaagtaaatgtatgtgattttaaaaatgaactttgcagggcaaggtctttatataccaagggcaaactggattagtaaaatcggttattcctcgagtttcattggtggagttgtgagtgcatttaggaagaaatagagtagctacatatttaaatggaatataaactgttgccactatttattcagcaaacaatagttgacatatgcttgggatacaaagtcaaatgagacaggtttcctgccctcaagaagtattcagatgctgggagggaagtgtaagtaaatcagcagtttggcaagtgctgtgagagaaagatagaaagattaagaagggagcagagaggaggggcatctaaatctaatgagggtcagaaaatcttcccagcagaggagacacactaaattttgaaacatttaaaggctgtgtgaagtcacagtggtgtgacatggcccttaattatgattaatgcagtaaaatggcaggaagtgaagccagtgggttaggtaagggcaggttatggcgggttttgatgtgcaatttgacttttatccttaaagcaatggggagttattgagtcttgagcagaggcatgaaatgagcagatttgcattttagaaaaattgtttttttctaaacagaaaaacagataggatgtaggtagctcaaggcaaggacattagatagaaggttgttaaagtagtcaggtgggaagtgacgtatagactaaggaggtaacagtattgacaatagaagatggattaaagaactcttaagttagaacctcaaaagtcagaagaatgtaggattatcagatttctggtatgagggactagagtttggtaactggagttttccactgatgttggtaatactagagtaaatcaagtttgtgaagagagatgaaattttcagtttaatctatgtagagtttaacatacctgtggtacagacaagcaaagatacaattgtgatttaggtcggaattcagcagagaggtctggactaaagaaacagattcaaatgtcataagtgtgtgagcggtgttgaaaccatgggttgggtgaaattaccattgagtacagatggccaggaatatccctaagggacataaacatttaaagaaccaccaaaaatgactgagaagtgctaagagaaaatgcaggagagaatactaacatagaagccaatagaagagagaatttcaagaaaaaagtaagagtttcgagaagcaaaagcaaagactttaaatatacagacaagagagtatccatcgaatttggcagcctccaaaagctgggcagcctccaaagtgtggtggctgaagccagactgaagaaagtcaagaaataaaagtgatgtaaagaagtggagacagcaaggacacgctactccttcaagaaacctgactttgaagagaaggagatagggaaggcaaaagctgagagaaacatggggtcaatatggaatttttaaaagtggagaatatccatgtgtttctagactgaagaaaaagaaaagaatgtgaggaggtgagaagggagacagaaagcatgactgaattggcaaaatccaagagcgggtagaagggcgtgggatccagagtactggattgtccctggacaggacaaggggcaccttttttcattgatacagaagaggagtaaagggtaggtccagatgaaaatgagattagagaaagttaaggtattctcactgatgtccctgatattctcactgaagtgtaggaagcaaagtgatcctgtcagaaaggtggtgagtagtggtatggggtatcctgaagaaagatgaatgtaggaggaggcttaggattatcaagtagcactgaagacctgaggctaacaatttgtagacatgaatgctcctttgggtgactgcttttccctgtattaatactcagcaggagtatcattttcttctctagtaatactgagccatgatgtaagagtacaggaacttaatgacaaggctgatccagaactggggctttttaggacatattgtagaagaataaagacacaggaaagccaagagtaagtggaaaaagaaagcacttgaaagtaattgactatcagtttggcactgaggggaaaatgagtggtcagggagtagaatcctcaatgtgattgaaaacttggtgcagttaggtcttcaggggcccacaataaaacccctctcttcctctttttagtttgaaccaaggtatgaaaacaaatgcaggaactaggcagatgaagatcaaaacgtcatctttataaatgtcagcaggagtggaggacagagcacagatacgtggtctctatctgatctcctaatactgtgaacaaaggtgtccattgaaacagctccttcagggcagagaccaccacaagaagctaattttcaccacatgaaaattagaagcagtgaccgtttgagacaaggacagctgctgtcagagagaaaggaaagggctggatccatgcattggtccttctagacttggggaggagtgagtaagcagtggagtgagagaagccagtgttgctactgctttgtaattcaccacctggaaacttgagaacagggaagcatttcaccctaagagacacaatgggcacaaaagaatcaaccagaagaatatgggatgtgattagagagcaggatctcagggttttagatttccaaagtggaatagttctgggtgacattaggggccaggatgtggccatggaaatgggtggatgtggtgaatcagaggtgatgtcaagggctgagaggctggggtatggttttattcattcatgcggtcaggatgtgatccagggtgacactggacttgggatgccaggacatagaagacaaaaaaaattagagtgtgagggtgatgggctttgaagcagaagtgagaagccttgggctggattgtgagcctgggctaaaccattctggcctgtgtgtggaataagattccagaagtgaggtaggtacttgatgcaactggatttcctcagtttcattttgcatcaccatctgtaagccaaagataaatttattacggatgaccctatgttcattcaccctctttttggacaaatgtaaatggtggtggttagccaattttagggggagcaatggaggcagtacttgctgaattcatggtttttaagatgtagctttaagaggaaaagaaagcttgaggattccatgctccaaactagcattccatccagtgagaggagattattagttcactttctagcaggtataggtagacaaataaataacttttgcagagagaaactcccagagtggaattgtacatgcataacaaaatttttctctctccacattaaaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatggtgagcaatgtggcgactaaagattggagggccctggtcagtttagaagtgccctaaagtagacctccaaaatcagttttagagacttaactagagcaggagaagcctctcagggatcactgaattcatccttctgtgtgccaccagagcaggcccaagcaatgtgccatcaatgggcatagcagtctctgtgcacagtctttctgttaacgtgactgcttttggtagtgatgttttaggcacagagatgccatttttacctctatgtataagaagcatgaaataaataaaatgaaggcagagtcagcagaaaggttgagaagctgagctgagcagctagcagctagccgtccgtggtgggtggtgaaatgttaatggaagaaactgacctgtatctaatggattcccacagccctttcccaagaggtgagcccggaggtctggaaagatgtgcagctgtccaccattgaactgtccatcacaacacggaataatcagcttgacccgacagtaagtgtgcttttttattagaaaagcatttggtacctaagaaaagtgacaatagctatagtcctctcccactaattcagttatttttatttttaccctgtggagatagagagggcagtgtcaggagaaagaggatgtggtgtgcctttaaggaataacagcaatgaggagaagctgccacctgcaggagtggcataaatgcttctggggctctgattacatgttctgctcattgcttaattggcattcagagaacttagggcaagagggctttagaaatgaaaattagctattcccatttgtcactggaaaaaaattgtggaacttttagttgagtaaatatccacgatttttgtgactgtactaaatatgtcaaattagatcctcaggagaaaaatacccacacacatacatctgtatctatatctacatattatttatttaggcccaatctataggtatgcactatcccatacggtagctattagccacatgtggctagttaaatttaaattaattagaattaaataaaattcaaaacttagttcctaagtcacactcaccacatttcaagtgctcaacagccatatgtagctagtagccatcatactggaaagcacaggtatacagcctgtccgtcagtgcagaaggttctgttgggtggtgctactatagacaacacacccaaaagtattgaaataaagcaggcattggcaaactggtctgccacctgtttttatatagcccagaagccaagaatcttctaattttaaatgatgcaaagaaaatcaaaagaataatttttgtgaacagaaaaatacgtaaagttcaagtttcagtatccataaataaagttttattggagcacagccatattcattcacaaatatattgtctgtggctgcctttgtgctacaggggagagctgagtagttgtgacagattgtatggcccaaagcctaaaatgtttattatctggtcacttacagaaaaagtttactgaccctagtatagagaaaaccttggtaatttatatcaatgagaatgccaataggaaagtaattgttaactgtggactaattacattcagcttgtatgcaaattagtctgttcacagttgtctaggccagtctgaaaattagcagatggagttggaatgtcgtgaaaagtttgattccaatattaatagagtgataagtttgattctaatattaatgttcagagtattgagatgttttctaactatgaaaataatacatgtccattgcaaaacatttggaaaacatagctcccttcaccctataaaaaaaattctagtttgattaaagaactaaatgtaaaataataaaatcattaaagtagtagggtaaatggcacacgtttatacctatgtaacaaggctgcgcctcctgtgtatgtatcccggaacttaaaatagaagtttgaagttaaaaaaaagtattagggtaaaatctaagtgattatcagtataaaattaaggaggacaaggcctctctaagcatgacatttaaggcaaaaatcatattgatgcatttgtctttttatttaaaaagacattctaaacaaacttttaaatgacatattgggaaaaatattagcatgtgatagaccaggaattcactttccttttaacaagctcttaggataaagcaatgagaaatgggcaaaggactaatataaaaagtgagcaaggggtaagaatagaaaattcataaaagaaataagcatatgaaaaaatagcttatatttgctgattatttactacatgtgaggcacctgtcctaagaattttacataatattatgtaatccttataggtagatatctttatctgcattttgtaggtaaggagacagagtgatttcagcaaagaaatgcaaattaaaatagtaagattgaattgtcatgactaaaaagcatgttatagattaaaagcttagtggtggtgtgtgtttctgatgggaatatagattggaacatcctgtctcagcaatttggcatagtatacataaagtgtctaaaatatatgcataccttctgccctattaactgtatttctaggaatttatcctactggaataacctgatgaatatataatgtaggcagtccttttttacataatggaaatctgaaaaacactggtgaaagtggatatgtgaatgctaaaaaaaaaaaaatagattctgttccagaggaatttaaaagagaaagataaaatgtctaattatacatctcctttataccaagtctttaataatatgtattccgagtattttattcatgttctttaccattgttcttttctctgatgactgagtaccactgaatggattgagttcagtgagtatgtgagtgcgctcaagattagccacactcacaatgccaagtgctttttatctttgtgcctatttaaaagtatacgatactgtgccgcttatcactagtagcagcaaattcatttgtttcgtttttgcacagttctttataaaaataaaagcaaatgcaatacaataaaggcagtgtagctgccgtgtaatagctcaaaatgttcacttattaaaagcagcacattcagtgtatgaaagaagctgtaggagtatagaatgtgtgaaaattaggatctcttatacaactatgctcactgtataatagtaaaatatttgcaatgaactaatcagactgaataaattttggtacatttattaaaagtcatatctattttatatatgtattattttctatctattgacatgggaaaaataggtgaaaagatttgcaacatagttccatttttctttaaaaaggaaatacccccacttataagtgagttttgtgaatgatggaggtaaagctccaattttatgttctttccaaatagaaagccagttgtccaagcgccatttattgaaatctccattttcccccattgatcttcaataaacctctgccatacatcatgtctatatacatgtaaatgtttctagtctctttcttctattgttgttccattttctcatatttatactaatactctgcttctcttattatagttttataataagttctatgtttttctctttttacacagtctcttggctattcttagctcatttgagttctataaatattttagaatgtttattttattaaattccacataaaaatgttataatattgatctcactgcattgtacccatagatcaatttggagagaaatgacatttctacaatattgactcctctagcatatgaacggggtatatctcttcatttatttaggtcttcaatgtctttcaatgaagttttatagttttctctggaatatcctgtcttttgctggatatattcccagttatcttaatttttatgctattctaaataatatctattaaaatttcattttctacctgatttagtagatggacatataattgatttttatatcaatgctgaatcagcaacctaattaaattattattaattattctaactttctttcaatgaattctttcaaattttctacagatttagtcatggccaatgcaaatagtgcaaggtttgttttctctcttcaaatacttatccttacaatccttcattttacttagagcactggataggacctcagtacatggttaaatagaagtagcagtaacaggagtccccatcgtctttcttatttctgatttagagagaaagtcttcattgcttcatgcttgtatttaatgtgctttctttttttatagacaccctttatcagattaaggcagttcctttctattcccagtttgctaagcatttttatctttcatgttaaatatcttagatatttaattttatcaagtactcttccagcatctattgagataataaagtttcctcatttaatctgtcaaagcaataaaatgaattgatttttgaatgttaatgtgagacttttggccaagatgtagcaaaaagcaccagctttataccttaaacaccttaaaaattggacaaaatctttgaaacaactatatgagacattggtatgagacaagcagcataggacagtgagtccagagagcaagaagttgaacacagtgagcctgatgcttgcccgaggtgactgctggagagaggccacagcctgcggagagggagcccacacagagcccatgccctacctcagttgaggggtctttgagaatttgagaaatcaaggcagctagaattgcaaggcaggatacaagagagccccatggagaggagagccgcacccagaaccaagctagaggtttacggaggtgtcctctggaatcttcagctgagtactgacaggtgcatgcatgtgagaaaccaccacccgagatagaggttgagttacctaccagtgagcaggcgggacagtctcaggagagtcagtcctctcacaaagccaggaatagttcgtgttcaaaccaattagagtagaaaatcctcttcagacatggggcattgggtagtgtcctcagaaaggtattgcctcagtagtgagtcaaaattaattctagactaaaggctgccctcttccctgttaacaaagctaaaggctcacctccaaagaaccacagtttctttctaggtaacttaattgtgcctccagaacaaagctttagaacaggggtcagcaaaggacagcccacaggcccgactatcctgctgcctgtatttgtacagccttgaagctaacaatattttttacatttttaaatcattgaaaaaaatcaaaagaagagtatttttccccgttacgtgtggaaattgtcttcaaatttcagtgtctttaagtcaaattttactggaacacaggcaggctaattcatttgagtatattctctggttgctttcagctactatggctgagttgaatagctgtgagagagacctcatggtctgcaagcctacagtgttcactctctggctctttacagaaaatgtttcccgaccctgttctagctgaagtgtggctctcccctgagttttgcctttcccacagtctttaagcagtggctgtgctttctttcttttcctccccttgtatgctgggcctggtgacttggtggttgtcctcctgactcatcactgctttaacccattcttcctcctcctctctaactacccccccacccagccccacctctcaatgtcctattgtcagagcagatcattgctcctgggagctcctgaaccctgggccgttcttacacatttatctataatgttaattcctagcccactgtctccctctccaatctactcctgtcttaattctcaacacggcagccagagtgatcctattgaaatgaagccagaacatatttccctccttagaaccctccagtggctctctgattcattcagcctaaaagccagcttcctcgccatggtctatgaggctctgctgatgtagctcctctcttccctgtcttcctcacttgttgcccctgtcattcgctctgctccagctacacgggcttccttgctgttccctgctgtcagacatgttcccccagcaccacctgaaggcctccgccccagtagttccccttgtgtggattgctcatccccggattaggggttctcaaagtccagttctcagatcagcacatcagtatcacatggaagttgctcgagatgaaaattcatgggcctcaccccagatctactgaaccagaaacttgggatggggccagagtctgagttaaaaaaaaattatttttattgattgattgattgagacggagtttgactcttgtcacccaggctggagtgcaatcgtgcgatattggctcactgcaatctctgcctcctgggttctagcgattctcccgcctcagcctcccgagtagctgggattacaggcgcccgccaccacacccggctagtatttgtacttttagtagagacggggtttcaccacgttggccgggctggtctcgaactcctgacctcggctgatccgcccgcctcggcctcccaaagtgctgagatcacaggcgtgagccaccgcgcctggccaaaaattatttattttttagttgacaaacaaaaaccagagtctgaatgttacctgctctacagtggcacctgctaaagtttgagaaccactgccctgggtggccacatcgccggctccctcacctccttcaggcctcctctccaaggcttctccacgggaccccctttttcataacacagccactgccatcagcgccacctcatgttccttgctctgcttctttgatcttattttctaataaactctaatatagttgtggcatccttatcttctaacagagtttataatttactatgatccatctattccctccagtctctacagtagaaagtaagttctttgtaggcagaaagtcatgtgggttttgttcattggtgtaacccaagctccgtgggttcatggtgcatgactggcactcagtaagtagttaaataaaaggtgaactttcaaagtcatccactttatgttttgtaattcttagttgagagttctttgttagttaccctttaatcttaggcaaaggctttaaggctctcagaggcctcaaatcctgggcctgaacattttgaacctaccccaaaagaaacaagacctctatttgaagctgacatagaagttgtgggattgatttacagagggctaggtttgtatggctagtcactgactggtagcaaattatgggaactggtccaagaaccaagtctgttttgatagccattttgtcgtagctcaaatcatccagagctttctgtggctggaaatggaaagtttttaaacattaccatagaataaacggattgctgttttccaactctggttgcacaccaaatttgtatgtagagcattaaagaagcacaggcacttgggctctccacaccaagcagccgattccatgctgtcatgtgaagctcatgtacagtgaacactgagattgctgggatgggctgaaagcttggcctgcaagggaagtaatcctagagactagaacggctaataattactagtgagtgacagaacgtccagaacctcccactctgagttttgtttgcttatgtagtaaaaaaaaaagccaagcaatggagatgaattttctataaattatacctcagtaaagctctttgtgaaaaaaaaaaaaaaaaagattgaaaataggtttggaattaaatcactacaagtagagtcccctatctatatatagcttcaaactatgaaccatcaaagctgaggatgacaacaggctgcattagccaaattttaagagtaatgacgttagtgttcttaacctttttagagcaaagaagattttctgaatatctgcattgaacctgacaccatcagcaaaggagactttataactatagggtaagtggactggggttcacaggaaatgaggcttgtgattttctcagattttactattcagagtgccccatgaagtctaagacagaaatccagccaaagccttgtcttgtttgggaatttcgatgttatttctttcctatgggctgacatgtagagtgcccctctcctatgctggccatcactgttcattttgtggggatcagaatgtaagagcagtctttgtttttcaattgaaaccaaagaattcaatggagcatgacacagcgtcaagaactttggtttcagggtcaaagagctgaatgcaaattttgattctgccacttacccgacgtcatgactcggatcatttagcatctctgaattctttccgtctacagaatgaaataatcatctctgccgatctcaggactggctttcagccttgagtaagagaatgtgtgtcaagcctttttatattttgaagcacttcacagtatccattactatttatgtcagttcaccatgtcctcctattcccagggccttcatgaaaaactggaaaaggtattgagtaccttggacatttcccaggcctttttcccttttccaatacagaatacccttccaagttctgtgatttgttaagtcctacctctgccagaattttattggtaaagaacactataaatcctccttcagggcatctgaggagctggtgtgttcccatgccaactggtaatctgctcagctccgcttttctgtgctttgtctcagagctccctctcgtgcccatttagggatcacacatttctgctgcagcggcctggtctccatggctacttcattatctacacaggcacataagtttgttgttcttgcctttggcataaattcttcagagactgaatagctgattctgcagcctttgattttcttgctgtatctataagaagggaaaatcctgttccttctacagaatgtccagaaatcacacaatcttcattgacagtctggccagtgagaccagcaatattcaaatctcctttatgatactggtatccagaaatagagaccccaattctattgctaaggttaggcgaagccactatgttctgcattgttagcaccagtggcagccagtgtccttctgttctctacaggaagtgaaatcaagtaatgtctgtttcctctggatatctgaagagaacatagtgaagctgcgttagaaaactctgataccgttttgtagagttactgttgttaataaatgataaatggactgatttacttagattagcttttactgtatttccactgcctaaaagatacatctgcatgaggtggagtgtgtgtctgtatatgcgctggaaattttactccatagtcactcagtcaaggtagatattgtatgccaagtagaccgcgttataaatacagtcatcccacggtatccttggggtattggttccaggacctccctcagataccaaaatccacaggttgtcaagccccttctatatagtggcacggtatttgcatagacttaggcacgtcctccctatgcacactaaatcatctctagattacttataatactcaatataatgtaaatgctatgtggatggttgctgtcctgtattctctaggggataagatagtctgtacggattcagtacaggtgcaaaaatatgtattctctatcctcagttggttgaatccacgggagtgggacccacagataggaagggttatcagagaacttctaagactagttgttcatatacataaaagaaatatctacattaaagtaaaaatattttatccttcaagtaatcacaagaagtaccaaataccagacgtttagtacttttcctaaagaatttcattctaatttttaaatttgagactaacaatctaagaattaggtacatgtggaatgattatttttaaatcaatcaatttttaaatcaaattaagagcatttcagagaaagtcataacttcatgcccagttctctactttcagtctagaatgtatcacaaggctaagcaagaatcactgttggaaaaattatttacagaattctatggcttaatagaccatctgtccacttatgtaagctcataaaaagggggaaagaagttgctacattgttgcaacctagtgcagttgccatcactggtcttaagcttgctttttcctgtgctcacagaagtcgaaaggtgagaaaccccaagctgcacgtggagggcacggagtgtctccaagccagccagtgcactttgcttatcccggaggtgagtggggaaggggtcggtagtcacagcatttgattcgttcgtcatcggcctgcccctctgtggtgtcccatccttcctctctgttagctgacctagacttaggcacatattgtgtgccaagcattttgccaggctctgggtcatattagcggggagctgaaaaggatggcagaatctccttgggagtcatggatttagagttggacttctgaagactcccatcgttttcgaaccaaggttcttccctaaagtgagttttaggtctccttttatttttccatatgtaaataatgcagaaggttactacattaagacacatagagaattgtctagctggcaaatgttaatagtggcttttactttaacattttttataaaggatctggaagcagttttcagttcaacactgaatttttctgtattatgaaatgccatgcttagaataacctatgtaagtgaaaaaaattggaaatagaatctggaattgggaggttattcaattgtcaatacggaaaaaaaggaggctcttcatatagcctttgaagacatgtggccatatattactgtattcagacaagactataggtaaacagaaggtatccccatagtgactggcgtcacagtttcgatataaatattgaattaaatgcatgagttatggaagggtttcatagactgtaatgatattaatgttgatacaccttgggtatatcaagctaaacaagtcttagagaataatgaaaatgatccagcagatacaatagcatgtcataagagaattagctgtctttatttttatttgagaaggattagcataatatagaaagactatgtatatgagttccttaagacatggcaggacccttgccttttaatacatatttgaaaattataaccatgttgttcaaatcccaaaatactctgggaggagataggggccaaaaaaagaaaataaatcctttttcatggatggtagaattaggatgtttccagaaccagcactgtgcccatcgtagtaggcactgaatttttttttgtaaaagaacattaggatagctcctcaagagaggatgttgttttccataatgaacttcttctggtgctgctgtgagacctccaactccagtaggccactgatgtgtttgagctgttctgaatattctcttctccccagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcaaattggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatg

SEQ ID NO: 38752 - DNA, 16059 bp, Homo sapiens
cttcctggcggggtgcagtggctcatgcctgtaatcctagcactttgggaggccgaggtgggcaaatcacttgaggtcaggagtttgagaccagcctggccagcatggtgaaacccctctctactaaaaatacaaaaaattagccaggcgtggtggcaggcgcctgtaatcccagctgcttgggaggctgaggcaggagaatcgcttgaacctggcaggcagaggttgcagtgagcagagagagtgccactgcattccagacagagtgagactccgtctcaaaaaaaaaaaaaaaaaaaacagctcttcctgtcttggcctcccaaagtgctggaattaacaggcatgagccaccgtgcccagccagaagtgtattgtttaatttccacatattggtgagtgttctgattttcctccttttattgatttctacttttataccattgtggtcagaaaggctcttgatatgatttcattcttcttaaatttgttaaaacttgattttgtgaagtttcattatatcatgcattggtggggtccacctacaataagctaaaacattgccgtgtaatgtaatgttagggagtgggaagcattaagggaaataaagcagggtgggggtggagagtgagatgtgatggtttacacatggcagtcagggaaggtgactctgaaaaggtgcctttcaacagagacccgatgttcgagggagagcagtcaaggaggatatccagtggtctagttcgtgggaatggttcctccatagcgctctggctccgttgcacgtctccacatgggccacgtaggtaagctgatgtaagtcttggcagaacgccctgtaatcctcggaacacagagcacggaaggtctgtggggaattctcacgaggccatttaccattcacctcctatctaccaaggagcctgttgtgagacagttttctccccacctcctgaggttctggtggggtttgaggctttctacccctcacctctgggctatagaactgcttagctgcagcatgaaattagctcctcagcaacaaggtgtcctgccacctggtgtgtggtcatctcgcccctttcatttcggtgttgcccggcacaagggacatgaaccagaatctgtggatgttcttgctttcgtggtccacgtaagtaacatctgaatgtaactagggcttgtttcatttccaaccaaacctgtcagccttaccttgcttcgacatctggaagagaattaaaggcagagggaaaagcaaacaggtgcaaaggccctgaggcaggagcttgcttggtgtgtggggaacagcaagaaagccagcggggcaggagcagagtgagccaggggccagtggtgggtggtgaggtcagggagggcccggagggcctcgtgggccacggagaggactttggctttttctctgagagagatgagagccacggcagggctctgagcagaggagggccctgggctgacttgggttgcaacaggatcattctggctgccgtgaggacagattgaggagagggggcgaggacggcagtggtgaggaggctgctgcagtcatccaaaccagtgatggtggtggcggcagtggacgccgagaggagagctcggattctggcatattctgaaggtggaactcacagggtttgctgacagatcaagcaaagcgagggcgggatgacaaagtacttgttaggaatccacactagatgagctcacaaaaagtaacttgacagttggtgttagtgttgtggttaagaacagggattcggagccaagtggcctacatataaatccagttccattgcttactggctgtgtgaccttgggcaggtcacttcctctctttgttttcatttcctcacctgtgagatgagatggcaatagtatctacttcacaagactgctgttgtaaggattacacaaggttttctattaatgtaaagtgcttcaggctgggcacagtggctcatacctgtaatcccagcactttgggaggccgaggcgggtggatcacttgaggtcaggagttcgagaccagcctggctaacaaggagaaaccccgtctctactaaaaatacaaaaattagctaggcatggtggcgcatgcctgtaatcccagctactcggaaggccgaggcaggataactgcttgaactcgggaggcagaggttgcagtgaaccgagattgcgccattgcactccagcctgaatgacagtgagactgtctcaaaaaaataacaaattaaaatgaataaataaataaataaagtgcttcaaagagtgcctggcataaataaagtgcttgttattagtgacatgaccatgggatgagaagtgtcagggaagtgagtcatagcaaagagcattccagataccaggaacactttgtacagttttcaaagcatgtgacaggaagccagcgtggctggaacataacctgatggagtaagagtgccaagaggtgaggttggagaggaagcctaggaggagatcagcccctcacggtagctggacgccattgcagaccttggtgcatagagcagtcctggaggtcagaagagaccaggaacagaactagatctgggacttagtgctgggggtgcacagagctaggagaaggacggggcattattgtcaacaatgctggctggttaccagtggttggtggtttctggtgtccaggataagaaacagtctagttcgagcagtaggacaaatacctaacgcatgcggggcttaaaacctagatgatgcgtggataggtggagcaaaccaccatggcacatgtatacctatgtaacaaacctgcatgttctgcacaggtatcccagaacttaaagtaaaaaacaaacaaacaaaaaaaaacaaaacagttcgacttcccactggagtccaaatactagttctaatattgtctacatctgtggccatgggcagtaaacccctctagagttcactttccctatcttcaaaatggggcttaaatgtcatacctacctccttaggtttgtgacagtacatataagatcagtatagtcagcactcagtaatgcaggctatcaccacaaccaggtgggacctatcccaggacagcaagggtggcttgacatttgaaaagcatgagatgtagttcaacatattagcaggaaagaaagagaatcaagggctgtaattgcctgggactgtgatatcagatgcaagggctaaacactcccagatctgcaatctagccctgaatgcctcactgggcaagctgaattgagatcttaagaccagagtgatcctagtcctacccctgtgaagtgatttccgctggctctgaatccgtggccgacaggctttaacgtccgccttatcctcacgctcagcagtccaaggctttgtgcattctggtttcagttcaaatttatttttcacacctgccccccagcaacaataaccaaactactatttttttttttaagaagagtctcactctgttgcccaggctggagtgcagtggcgtgatctcggctcacttcaaccttcacctcccaggttcaagcgattctcctgcctcagcctcctcagtagctgggataacaggcacccaccaccatgcccagctaatttttctacttttagtagagatggggtttcaccatgttgagcaggctggtctcaaactcctggcctcaagtgatccacccgcatggcctcccaaagtgttgggattacaggcatgagtcgccatgcccggccaaactactatttcatttacaagtttaccaatttcttacattattattttcttactattgatcttggcagttagaatcgtagctccagggactgaagaagtatctgtcagaaggctggcttgctagttcagcacgctggggaccgcacagtgctccgtttgaggctttttccaaaggcagaaattttatttctgacttagggcatagagagttgtcaccaacccccatttgggggttgtgagaactttggcttcagaggcaaatgttttcccatcaggaaatgatgaaagttatgaactcatatcccaacccccactcaccccatttaggaagaaacttcagggatgagataagtgaatgaggattccgtgtctccactccaattacacctcagctccatggctcctcccgtttctctctctggccttgattctcagcacacctgtaccctgaaccacctacactttcccacctacacttttactttgtcctctgaagttggggcccaacttgagattttatttcagcctgtggtagcaatgaaaagcagacacagccaatgtggtccactgcgttcctttgcatttcttgtttttttttttttgtttgtttgtttgttttttttttgagacagggtctcactgcgttgcccaggctggagtgcagtggtgtgatcacggttcactgcagcctcaacttcgcaggctccagtgatctcccacctcagcctcttgaatagctgggactacaggtgtacaccatcatgcctggttatttttttttattttgtaaagatagagtctcaccatgctgtcaggcaggtctcaaactttgaaaactaaccgaaagcttgtaacaagcagaggaatgtttaatcaagaaaaaccagctgagtggctcatgcctgtaatccagcacttcgggaggccaaggcaggcaaatcacgtgaggtcaggagttcgagaccagcctggccaatatggtgaaacccatctctactaaaaacacaaaaattagcctggcatggtagtgcacgattgtagtcccagctacttgggaggctaaggcacgagaatcgcttgagctgggaggcagaggtgcccatgttggcgaggctggtctctaactcctggcctcaagtgacccaccctcctcagcctcccaaagtggtgggattacaggcgtgagccacagtgcccagccaacaaacctttcatcagcttgttttgtctagtatcttatagccttataggaagaggttttaaaaataatttttataaatttaatatgttaatattgaaaaacaataaaagaattcattccaatggtgaaacagaatttcccaggtatccctgactcgaattcctgactcttctgttatttcattccatcatatttctttggaagcagagtggtgggatgaaggggcagggctctgttgagagaaggtggaagtgaatgggaaaggtatttatcacaacactctttatggtgaaaaaagaacatggaaataaacccaatgccagtcacaaataggggaccagttcagggctgggtgcagtggctcatgcctgtaaatctcagctccttgggaggctgaggtggaaggatgcctcaaggccacgagttcgagaccagcctgggcaacatatcaagatacccccatatctctctctttttaaaaaaaacaaaaaaaaaaaacaaaaaaaaaaaacagggtcttactctaacatccaagccagagtgcagtggcatggctcactgcagccttgacctcccaggctcaagcaatcctcccacctcaccctcctgagtagctgggactatgagcacacaccaccacacccagctaattttatttttgtagagatgtagtctcactgtgttgcccaggctggtctcaaactcctagactcaagtgatcttcttgccttggcctcccaaagtattgggattacaggtacgagccaccatgcccagccgaccccatgtcgctctctcttttttaattaatttatgtttgagatggagtttcgctcttgttgcccaggctggagtgcaatggcacgatctcagctcactgcaacctccgcctccagggttcaagtgattgtccttgcctcagtctcccaagtagctgggattacaggctcctgccaccatgcccggctaattttttgtatttttagtagagacagagtttcaccatgttgcccaggctggtctcgaattcctaacctcaggtgatctgcccgcctcagcctcccaaagtgctgggattacaggtgtgagccaccacatccgacctctttttttttttttaagagacagggtctcgctctgttgcccaggttggagtgtagtggcatgatcacagctcactgcagccttaacctcccaggctcaagcaattcttctgcctcagcctcccgagtagctgggactacagggatgtaccaccatgcctaatttttggtagagatggggtctcactttgttccccaggctggtctcaacttcctggactcaagtgatcctcccgcctcagccttccaaagtgctgggattacagacataagccactacgcccagttgacaccatgtcttaaaaaaaaaaaaaaaaaaaaaaacgtaagggaaccagttcaataaaatgtcacccttgaattccctgggcttcagatatcctcatctgtaaaatggggatagtaacaggacccacaaccttcagttattatgattaaattgactgggtacagtggctcacgcctgtaatcctagcacttagggaggccgaggcgggcgaatcacttgagctcaggagtttgagaccagcctggccaacatggtgaaaccccgtctctaccaaaaatagaaaaattatccgggcgtggtggcaaatgtctgtggtcccagctcccgggaggctgaggtaggaggactgcttgagcccaggtggcagagattgcagtgagccaagatcgtgtcactgcactccagcctgggtgacagagtgaaaccccatctcaaaaaaaaaaaaaagattaaatagattaatatatgtataaaataccttgaacagtacccagcacattgtctcataaatattagttgttcttgttaaggttacatgtttgtgcagtgaaatagagtttactctttatcaatcatgttacaaaagagtatttaatatgaaaagacactgataagcttgttacagggacaagggagatgctgagtcaacacaatacagtgtgatctttcggtgactttaaaacattgttgaattgattgtatttgttataaaaataatgtggaaaataacagctttgaattttatgtcagttgatgttaagatccaacaggaagtttaccctgataacgttaagatgaacagtttgaaagcagcttcctgctggaagttgaaatagagatgattcagatagcctctttggatccaaaccccaaagcttcttttgcctaattctatcttctgtctttagaaactcaagcctcgactgggctcggtggctcacgcctgtaatcccagcactttgggaggccgaggcgggcggatcatgaggtcaggagattgagaccatcttggttaacacggtgaaaccccctctctactaaaaacacaaaaatttagccaggcgtggtgtcggacgcctgtagtcccagctacttgggaggctgaggcaggagaatggcgtgaacccaggaggcggagcttgcaatgagccgagatcgcgccactggactccagcctgggcgacagagcgagactcccgtctcaaaaagaaaaaaaaaaaaaaaaaagaaagaaactcaagcctcaagctgtctgggggcatccaagtccaaccatcccagtcacacacacacaaccgaccttactcatcccaggggtgtgcagaggcccactgcaagaactggtgaactttcaaggcgtctttgcatatatgatgattttttattctattattcaagttttgcttggacaagattgtgctgctaaaaagtggcctacaccactttttttgtttttgtttttgagacagggtttcactcccgtcgcccaggctagagtgcagtggcgcgatctcagctcactacaacctccgcgtcctgggctcaagcaatcctcctgccacaacctcccgagtagctgggactacaagcgcccgccaccatacccggctaatttttgtatttttagtagagacggggtttcaccatgttggccaggctggtcttgaactcctggcctcaagtgatccacctgcctcggcctccctaagtgctgggattacaggcgtgagccaccgcgcccggccctacaccactttttaaaagtcgtgtttcttctcttttttataatgttgtacttctgatttctagggaatgattagcaaactcacccctgacgctatgtcccttggacattatccttgtatacacaaaaagtgcaattaacgagtgggtagaagtcaaggggtggagcctccgtccttgggcttgaagccaatgtccctcaatgcgcctgcgagactcccacgccctgggaaggatgcctatcgattcgctctgggctcggcagttctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagacttttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcacacattcactccactgactttcatcaagcacctgctctttgctgggcactgttctgcatcagcagaggacaaaaagataatatgccaagtaaaccagtaaacacacaaactttgtaaacaggtcagtaaacatatagcaagccctgtctttagtatctgctgagcagggggagggcaggaacagcagaactcgtgaggaagccactgcagtagtacaagtgggcagcggtggtggtggcaggggacacagtgagaagtgatctgactctaggtagattttcagggctccacacctcaaaggttctcgggctttttgcaagatgcacccaccctgaccctctccatttgcaggactttgaggatgatcctcgggccctgggggcccgtgggcaccgtcgttctgtcagcagaggctcctaccagctgcaggcgcagatgaaccgtgccgtctatgaggacaggtatgcaccagaggcagccaaggcggggggcgggttgcgaggaggagaggggccctggggcaatggcagactgaacactctcgcatctacctcctgtcacccctcacttcctattggggcccaggccccctggcagcgtggtgcccacgtcagcagcagaggcaagtcgggccatggccggggacacgtcactgagcgagaactatgcctttgcgggcatgtatcatgtttttgaccagcacgtggatgaggcaggtgagccagtgggtagcgggttccatcaccaagcgtttgcccaaactgtgacaaccaaccaaggcatccttttctgaatccaaggcccctggcacactccaaaggaggaatgaccatccataaagccttttgtagactgaaaatccctctgcaaagtggtcagtgcttcgtctactggaaagggcctcagaagcctaagagagagccctttgcagcaggctgcctgggttcctgagtcacttggaagagttcaaagcctttgctgatgataaatccccttgcagagggcagagtgggctacagtgtcaagggttttgcaaattgccaagaccttgattataaagtgttcgctaagacaggaactttttcatgttgcagaagacttttgcaatctgcaaaggagctgctaagacttagggagctttggcagagggtcttcaggggttacagttccctttgtcagccaaggaaagccctttgctgaggccactgttcctcatgcagtggggccccagccccaggcacacacgtcagagccttttagagagaaaagtgcccagtgagtgtgcagattcccactaatggcttcttggcattgcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtcaggctccaggacacccactcaccaagggctggtgggctgggtcaggaaggctatctgagggaatcagagtataaggagggacagccagggggggcctaggacccccccaccccccacccaatctcgtcagagcagtcctagtgtggtcagacttaaaagggaagcagatcagaagacgggagtgggccaggcgcagtggctcacgcctgtaatcccagcactttgggaggcggaggcgggcggatcacgaggtcaggagatggagaccatcctggctaacacggtgaaaccccatctctactaaaaatacaaaaaattagctgggcatggtggcgggcgcctatagtctcagctacttgggaggctgaggcaggagaatggtgtgaacctgggaggtggagcttgcagtgagccgagatggcaccactgggcgacagagcgagactccgcccccaccccccataaaaaggggaatgccgttcttggtctgggatggccttgctgtggtacactccagggagcacgggccagggtcagggttctggctctggagcccctttggtcccatcagctacagtcctacagttttccaactgcaggggctacctctgaggagcaggatgatgaggctgagcctcgtctggtctgtcagtggccccaccgtgtcagactccagggtagattggtcagagagcaggggaaggacattagaaagtctggtgtggcccggggtgtagtggggtgaactgcagaggaacagaccaagagtgagcttgtgggccgggatcctccccgcattagcagcagccccacaagttccagaaaggagcagccagggagcaggggaaagctgggatcacaggcctaggcaggccctatggttctcacactgtaggaggactggccaaggggcagcatgatggctctgaaggccctttagtcccgtaggcaggtggcctactctgggcagattgcaaaaggggctggctagggaggtggattcatgcctggtcaccttgtctacctgccacagccctattgtgaatagactctaatagggaccagccagtcgcatcaacagcagccccactgtggtcagactcaaggagggcctggctggaagcaggatgatggtctgtgcattctccccacaggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccatggcagtgtcttctctttcctctttgatatggccacaggtaggcagacagcaggcctgcatctgggtgctcgccctccagccctcccagggcacagccctcaccctcacctttgccttccctccctctgctgctgcagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacaggtgggtcccccatcagggcctcctggagacggaggacctgcctcctccagcacactgggacagtagctcatctcctccatcaggttaatttaattgagggagcagtagtagcagtaacagtaatagcagtagtgagcgcgtttacagccatcactgtggccaggccctgttcgaagcagtttccacgtatcaccacattcaatccttgcaccgacctgtgaggtaggtgctgttattatctccattttgcaggtgagcaaactgaagcataaaatagattagggctacttaaagcagagacctgttttcctttcttccttccttcctttttttttttttttttttgcggggagtagtgtgggggttactgtccccactcacatctgtcatgttacccaaatgcagttctcagcctgggccacacattggaatgacctgaagagcttcaaaaactcctgtctgggcccctctacaggccagtaatttcagaagctttgggatgggcctgggcattggtagattgagaaattccctaagcaatgtctggccagtcctgaaaaccactgcctaacaggatgctttttattctacccctttatttctctcctcctttttaaacaatttctgtatatatacttaacaattttttaatttaagcgtacccttaagtttgcccatttcccacagcctctcctttcttcctcctgccacctctggcctcctcctgccacagtaaagcccattaatgatccacatctttccacatatccttctctttccacaaatcctaggcgtgtacatatatccatgtatgtttttgtttgtttgtgagacagggttttgctgttacccagattggagtgcagtggcatgatcatggctcactgcaacctccaactcctgggctcatgcgattctcccacctcagcctaagtagctgagattacaggcacacgccaccatgctcggccaacctttttaatctattttttgtagagatgaggttttgctgtgttactcagtctggtcttaaactcttggcctcaagtgatccttgtaccttggcctcccaaagtgctgggattacagacgtgagccaccttgcctagctcccaccacagttttgaaagaaagacgttttaaagaaatggccttttccggccaggcacagtggcgcactcctgtaatctcagcactttgggaggccaaggcgggtggatcacctgaggtcaggagttcaagaccagcctggccaacatggtgaatccccgtctctactaaaaatacaaaaattagctgggcatggtggcaggcgcctataatcccagctacttgggaggctgaggctggagaattgcttgaacttgggaggcggaggttgcagcgaggcgagatcgtgccattgcactccagcctgggtgacagagccagactccatctcttaaaaaaagaaagaaaaaagaaatggcctttcctacatttcgagtttctcaccaggcaatgccttgtggaaacccccccaggttacctgtggggacagtgttttattctctctaagggctgtgcagttttccacagtgtgggcataccatggtgtgttcatttcctctctttgtgcttatcttaataccaggatcttttagagacccttacaaagaaaaactagtgaatgaaactgcagaggctcccatttatatcaacagagacagtttctgaaccatcagtaactcacacatcagcccctacttatagtttatgtagtcatctcagaattgggtttcataagctgggtgtggtgtgtgcctataggtagtcccggctactcgggagactgaggcgggaggatcacttgagcctaggaggttgaggctgcagtgagccgtgatcgcaccactacactccagcctgggtgacagagtgagatcctgtctcaaaaacaaaaaaaaaaatatgggtttcatgaaccctgtaaagaacttaggcacaggggtggggacacaggcccacaacttgtctccctgctagggctggggctgtgttttgacccactctctcatcctctcagggtggtagacaacgaggggaccctgcagctgaagagaagcttccccatcgagcagagctcacatcctgtgcgcagcatcttctgtcccctcatgtccttccgccagggggcctgcgtgggtgagtcctgtagggacaggggatctgggtggctggggaggggcaggaaccagggctggtgccaacctggctcagacatcacgacaccgatgccctgacttcctggacctcatgacccctcctgccccaacagcctcactgtggaactcacagctccaaacagctcagagaactcacagtttgcacttgatctcggccaaaaggccgagaagtgatgaaaactcacactttgaacgcactaactccccaaacagcccagagacctcgcattctgcacacagtaccaaaacagccaggtgacctcccatctagggatggggccccctcaaacctccccaagccatgctaggacctcacacctcggacatacacccttcaacacctcagacacctcagggacttcccaccaggggcaccccaggcgcctcccgatggcctctccctctcaccccgacagtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggg

SEQ ID NO: 38753 - DNA, 44654 bp, Homo sapiens
caacatgcaagatggcggcccatcaccggcagaacacagcagggcggaggaaagtgcaggtatggaagcccggttcctcggtcttccggacgcggccggcagctccgggcccactccagctagaaggtgcccggcgccacgaccagctggggtagcggcatggggcgaacggggcggggcgcggccggccacgaggggtggggccgcggcgctaacggcttgaggaaggggcgggggtcggcttgcttggcccttggggcccaggcccgggaccctcgtgggcggcattctgagcccgggattgcttgtcgccgctcttctgtaggagtggacttgcggggtcgggataggctcgttccccgcccacttgcctcccccttgccctgtctttcttcgaagcgctctgccctcgctgcgtcggagccgaggcctccaggggtttcccaggggggtgggcgttggaggagtgagcggcttgtgcgggggcgtggcgaggcggcggagcgccaacggccctgcggggtttctgctgaggattccgcacttgggagcccccagccctctcttatgtgggagctgtcccctgggtaggtttaagtgacataagaatgtgcgtggggaaattataattttaattgttttggtatttaagttcctcttcaccatttcttcatcttaagtgtgcatcgctgaatctgtctttattgtttgtgtaatttattgtccatgtggtaaagagttgtctaatcttaccgtgtgtgtcttgtgccttatgcctttgtgaattcacttttgtttgcggttacgcttaagagttactgccacttcggggaacatcacacaccggggcctgtcgggggctgggggcgctaggggagggatagcattaggagaaatacctaatgtaaatgacgagttgatgggtacagcaaaccagcatggcacacgtatacctatgtaacaaacctgcacgttgtgcacatatatcctagaacttaaagtataataataatattaaaaaatagttattgccacttaatattttcagtgatgcagggaataaaagccctcttacaggtgtttgcctgcaggtatattgtatgtggtagtggcagtttggtgcatttattcattaaacatttacctagcacttagggtggcccccaaaggggaaaagggattgaaagggtgtagaaataattaacacctaggctttctttataaaacacagcattatatggagttctgcgggttgaaatcaagtgtcagataaaggtagttagatgaaggggtccttcagtaaggtaatcccagcagaaggtggtaggccataaagtcttctgattagttcacatcttggttttattgatctcactgatcagtacagtgtcttaagcactcactggatgtttgttgaaatgagtgaaattaataagtctaaactcaccctattaggtgtttttcagtgcattagtgataggatttaagtatcaccagcatccaaggcaggtagtgagaatgtctccttgggactgaaatataactcaaaaagtaacccgattgtattatagactctatggtggtgtacatcttaggagagtaagggtagttaatcaggcctttcagtttattgcattaagacttaaaactcctattactgcagtgtgttccctgcttgcttccttcccaggcctgcccactcccaaaatgcatgcaataaagtatatatattttaaaaagacttacaaggcaattgtactagtatgggatggagaaaatgtaaattaactgcagcaggtttggaaaaacagtgttccaataggctgaatgtgagccagtgcacgtagaatgaggcaggtgatagataattccacttttcactggtcaaagtacaaaattagagtttggtgttcagcacttaggaccttgttcttcataggtagcaatcagattggtgaactgacttgaaattatttcctatgaagaacttttgaaagagctgtcttagattaacctgctgaagagaagattcagggaactttcggaatttgtccctaaggtatagaagcagcctgagaagccacagggattgatttcatctgaaccatcattgtctatgaggtgttttttaaactaatgcgtgttcattgtaaaaatcccaacaaacaaaaacataaattagagttgccctccatgcttccaagaaagctactgcgggcaatgtcatgttttaatcctagaccagagtttatcaacctgaacattcttgaaatttcatctggataattcttcgctgtgtctgagggagggagctgtcctatgcatcacaggttctttggcatcatccctggcttctaccaactagatgtagtagcatctccccagttgtgacaactaaaaatgtctccagacattttcaaatgtcccctcaagggcaaaattgccgctggttgagaaccgctgttctatacctcttgctgtttgtgtacctgacttaacatatttttttgctataaatggagccatagtattcactgttttgtgtcttgctttgtcaaatttttaaataaacattccctttagcccagaattccttatctaaaaatatattctacaaaattgcatatgcatgtatctgtccctacttatgcaagggtgttgtgtgaagccattcttgaattgctataaagaaatacctgagactggctcatttataaagaaaagaggcataattggctcatagttctgcaggctttacaggaaatatggtgctaggatctgctcgtcttccagggaggcctcaaagagagagagagtcaaaaaagcaagtcaacatggcatattcccatttccacaaaggaaatatgcattttaaaagtcaggaagggtaatagcagtgattatccctttgggaatagattgtgtgattatagataagacaggacatgggatatcttttagtttgaaatatgcacaactttgtatttttgaactttttaccacattatttgctcttatacatcaaaaagaaaacttctcatcttggaaaaagcatacatgggtacttggagtaaatatactttgtctcctgactgtctcagaccacgagacagtagccctgagctccttgtcaagttgtaggccaagacaaacccttgagacttaaaaatattgctaaataatcagtggaggccaggcgtggtggctcatgcctgtaatcccagcactttgggaggccaaggtgggcagatcacttgaggtcaggagttcgagaccagcctggccaacatggcgaaatcccgtctctactaaaaatataaaaattgccggcatggtggcgcatgcctgtaatcccaggtacttgggaggctgagacaggggaatcgcttgaacccaggaggcggaggttgcagtgggccgagattgtaccagtgcactccagcctgggtgacagagcgagactccatctcaaaaataaaataaaatgatacttaaaatcagtggagaggggtccaaacatactgcatattaattgtagacataattttaaatgagtccatgtcctaccatcttcaacttctaggaaaactagagatacgagggaagagggatggatttgtgactgtcagaaacataatcaaatatgtgaattcagatacatgatgtagcattttctctggtaaccaggatatcaaagcaagtcttttccatccttagcagtcccttggtggtatgattttccagcaacctgagtctgttgattggctctctgtgcctccatttttcctcctgttatggcctcttccttcagtgcttcacagtgcttggggaaaaaaaatacttcgcttaacttgctgccacttctagttaagctctttccccagctaaatgccaagaggacttttgtgctcactaccgtatcctcagcatttagaatagtgccaggcaacaagtgggtgcctagttaatattcgttgaaagaattaaatccattttcctctatttttctatagccagacattttaaattttttctctgtactttaatggatgcagataacaagtttttaaggtgacatgtcttgaaacatatcagcatatatagttttcgttctttaatgaccacatagaatggatgtaccataatttgtctagccatttccttattgaagatattgctttgattttttttccatcatactataatttgctttgaaaaaacctccagttataaaatagtaaaggaagtgttacaaaaataaatgaaaggacaaagatagataatacagaatgcataaaagatgagggatcagtttgaaagttccagtatctgactcatttgagttcaagaaagagcaaagaaaacagagatgatgattaataatggatacaagaaaatttcccggagcttaagtgccgcaaatttctagatcgaaggggctttctaaatgcacagaaaaactaatgatagaaaaaacaaacaagaaatgtcacaacaccaaggaaaaagagaaaatcctgaaagcttagggaaggagatgacgagggagtggaggaaagaatgaaaataggatccctttaaagctgtatgaaacagaatggcattgaaatcagtggcaacattggatgctagaggaacttacagcaatgctttcaagagctgagagaattgctaaatcaagtgtaaatgtggaggaaagaccttttcaggcatgcaaggactaagttgccaacccatgtgccttttcttatattactttcttaaggtattggggatgtatttcagcaaaactatggagtgaacaaagaaagaaggaggcattagaattcaggaaacaatggctgtaacccagaaaagcagtaaaggaaaacaccaaaggtgacagctgtgccagcagatctagagggcagtcagcctagattgtaatgagaagaaggagggtttggagggggaagccttctgagaaaataaaggggtgggggtgagttctgtggtacagcaattaaaattgaaattaaagtggagaaaaccattgaagaaggaaaaattaaaactctagggaaaacaaaaagctctttgaggaaggaaatgtattcataatatagtacttagtagatagccttacagtcacaacaatatagcacggattatttgttcaattaaaaatagggatgtatctatattagaagagtagagggaggagatattgagggtagtttcagaactacatcctaatctacagtagcatgagtaaatcgataatgtctaaaatggatgagccaaaaagttataggataagcacaatatttagagaaatgcagttaactatccagtagcaacaactgagttgcaattagttacctttagggatgaagactaggtgtgggagtcttatccagacagtagagagactgtttttcattacagtcattactatttgattttctaaatacaagcaggaattacttggataacaaatgatcaaattttaaaaactaagtaatacatgttgtttgtaaaacattcagaacacatgaaagagacatgaatgagtgaaaaatcaccataatcccatcattcagaaataactgctggttattttattttatttttatttttatttttttgagacattgtctcactctgtcttaaggctggagtgcagtggcaccgtcatggctcactgcaacctctgcttcctgggttcaagtgattctcctgcctcagcctcctgactagctgggactacaggtgcgcaccaccacacccgtctaatttttgtatttttagtagagacggggtttcaccatgttggccaggatggtcttgatctcctgacctcgtgatctgcccgccttggcctcccaaagctgggattacaggcatgagccactgcgcctggcccctggttatttttatatatgtatagtcttcaaaacttgtgtatttgttctgaaatatttaatattttgaaacatttttataataatgactattgtacattgttgtgttggaccacacatatttcactaaaaatatatcatggctttccgcccatgtttatcagtctagacctccatcaactctttcttattctttagaaacagggctctcatgctgttgcccaggttgtagtacagtggtgccatcatagctcactgcagcctcaagctcctgggctcaagcagtcttcccacctcagcctcctaaagcacagagattacaggcatgagccaccacacctggcctacatcaacattttaagtgattgaatagtgttgtgttttacagatgtgcgtgctagaatttatccaactaggatacttctaattcttttgcattttaaagcacacgtctttaggaaataccgttgaagaggttggcccagactggttttaacagtaattactttccacctagaatgagaattctgacattcaggttattctttcactcttgccttaaccagtcagataatctcccagaagtctggatatcaagatttagatatgctgcacagtctcagttaaaggaaatgtgagctaggtaagcagccctggaaccccagagaaagagagattgagagaggctgaagttgacattgaagctagcttggttcctggtggctttggaaagccaattcatgcaatgatacgtatgtcttttatatgccagacactataatgggggcacaggggtggaaggaacaaggcagacaagtcccttgccttcttggagctattattctaatggagaagatacaccaaaaaatataaatgtggctgggcgcggtggctcacacctgtaatcccagcattttgggaggccaaggtgggtggatcagaaggtcaggagtttaagaccagcctggccaagatggcgaaaccctgtctctactaaaaatacaaaaattagctgggcgccatagcaggcacctgtaatctaagctactcgggagcctgagttgggagaattgcttgaacctgggcagcagaggttgcagtgagccaagatcgcaccactgcactccagcctgggcgatacagtgagactccgtctcaaaaaaaaaaaaaaaaaaaaaatacagaatgtggtaagaactgttaaataagtaatgtaagatagatagggtcataaccctgaggagaatgagatcagaaaggcctttccaaggagacctttctcctaagatctgaagagtaagggtgagttagacaagatgaaagctggagaaagagtattcctatagggattcgaggggtggtgaatcttcatgacactggcaacagtaaatgagaaggtactgggatgggaaagagcttgatgtgtttacggtaacagaaaggagtttggaatgactgtcataaaagaagctgggggcagtcagtttgaaatgagtgggggatgcagggtcagaactaagcatttgaggagtttgaactttaaattttgtgaaaagccattggaaagtttcagcagagaagtgtcatgatttgattttttaaatgcctcttataaatgatgactgtatttcctgaccttgggctctgttaagatatccttgtgttgaagtctcctttaaaaaacaaacaaacaaacaaaagctggtttgagtagatctcagttacagttaattgcatccaaaagactgggttaaaacaacatccttgtagctatttgtgtctgcagccctggccctttttaaaggacaaatttctggaaattgaattttaaagaacatttcaaagagtttaaaacttttgtcagaaagtgtttatttatcctcaggggaaacaaaaatggcagttattttaaaaaattcttgtattataggtaaaataatctcatattaattttgtctttgattatttatggggtttttggccatttcttttttaaaaagtccctttttgtaactgtccctctttctgttggtaaatttgactttttcttattttataaggaatcttgttaagagtaaactttctttcatatttatttcattattctcttagtcttgctcgtgttactttttgacattcagaaggtttaagaaaataataacattgtgataaaattcacataccataaagtgcaccctttcaaagtgtacaattcagtgatttttttgtatattcggaaagttgtttattggtcacctaactccagaatgtttaattactctatgttcattagcaattactccccgtttttcatttttccctccttcaatctcctggcaattactaatctactttctgtgtggatttgtctatcctagacattatatataaatagagtcataaaatatgtggccttttgtaaaatatgtggcttctttcacttagcacattttcaaggttcatccacgttatagcatgtgtcagtacagtgtgtgtgtgtgcatatatatatatatatatgcacacacacacatcacattttatttgttttgtccattgatggatatttgggttgtttccacttttgtaacattattgtgaatgccacaatgctgtgaacattcttgtacatagaaaaggttttgacttgtatttggccagatcaccattgctcttttccttcgtaaagattaccatctttcttggcatgttggaagagttttctctggcaagggactatgtaaatattcacctgtcttttaaaaattatttttatgctggccaggtgcagtggctcacgcctgtaatcccagcactttgggaggctgaggcgggtggaccacttgaaacccagcctggccaacatggtgaaaccaccatctctactaaaaatgcaaaaatcagctgggcacagtggcatatgcctgtaatcccagctactcaggaggctgaggcacgagaattgcttgaacctgggaggtagaggatgtagtaagccaagatcgggccactgctttccagcctgggtgacagagcaagattctctcaaaaaataaaaacaaaaattatttttatggttattaaatttcagtctttaattcatagaaaaattcgtttttggtttaagatgtggagaaagggtataattgttcctaatagaatcactataggtacttgagataattttttttaattattatacttcaagttctagggtacatgtgcacaacgtgcaggtttgttacataagtatacatgtgccatgttggtttgttgcacccatcaacttgttatttacattaggtatttctcctaatgctatccctcccccagccccctaccccccaacatgccccagtgtgtgatgttccctgccctgtgtccatgtgttctcattgttcagctcccacttacgagtgagaacatgtggtgtttggttttctgtccttgtgatagtttgctgagaatgatggtttctggcttcatccatgtccctgcaaaggacatgaactcatccttttttatggctgcatagtattccatggtgtatatgtgccacattttcttaattcagtctatcattgatggacatttgggttggttccaagtctttgctattgtgaatagtgctgcaataaacatacgtgggcatgtttctttatagtagaatgatttataatcctttgggtatatactcagtaatgggatggccgggtcaaatggtatttctagttgtagattcttgaggaatcgccacactgtcttccacagtggttgaactactttacactcccaccaacagtgtaaaagcattcctatttctccacatcctctccagcatctgttgtttcctgactttttaatgactgccactctaactggcatgagatggtatctcattgtggttttgatttgcatttctctgatggccagtgatgatgagcattttttcttgtgtctgctgcagaaatgtcttcttttgagaagtgtctgttcatatcctttgcccactttttgatggggttgtttttgttgttgttgttgttgtacatttgtttaagttctttgtagattctgtatattagccctttgtcagatgggtagattgcaaaaattttctcccattctgtaggttgcctgttcactctgatgatagtttcttttgctgtgcataagctctttagtttaattagatctcatttgtcaattttggcttttgttgccattgcttttggtgttttagtcatgaagtctttgcccatgcctgtgtcctgaattgtattgcctaggttttcttctagggtttttatggttttaagtcttaacatttaagtctttagtccatcttgagttaatttttaactgtttatttcattacattagaaagttttacttctggctgccagccagcttattgactttttcttaggtgtaattgttttcagttgatcccctgttttcacaaggaacagacagaggtcaccaacagtaacaaagtaggggaaaatgccctgaagaaaaagtttagtatgtgataggagctcaaaacctcattttgcttggcaagtcagggaaggccttctaaaggaagtattgtttaaatggaaacctgaaggctgcaacaagagttagccagacaggtcggaggaagagcttccaaacagagaggaccagcatgtgtgatggtctggaggcacaatgcaccagaacctggagcagagatgagtggccagaaagacaaacagggtacttgagaccatgttaaggaatttacatccaatcatgagtctagtagtcagcaactggaggtttttgagcagagctgagatagatttttaaataattactctagctgctttgtgaaaaatggactaaagactgggaaaggagtccagtcaggaagcagttatagtagtttagcaacttactcatgttggactaggctatcattgataccatccttctcttcagccctttagtctttaaggagtaaaatttaaatttgtattgggttgaaaaagtacatattggaaaacatgggattttctgtttcagattggccactagtagactatattttattactgcatggcttgtactttataaaaagcatatgttgacacatttgtcaggtttcctatgttattcgagatgaagtggagaagtacaaccgaaatggagtcaatgctctgcagctggatccagcactaaatagacttttcacagccggtcgagactctatcataagaatatggagtgtcaatcagcacaaggtaatgcagggattaaaatctgtacccagcaaattctggacaaatggcttttactgtctaatatgacacttttcacagtttcagatttaatctctctgaatgctgagttatttggtacactctataaagacatcgcaaccagaattctgtaagcctctgagaaaaaccatccctaggaaagtttcagaagtgtttcagctaagacaaggactccctaaactaggtttgccttacagagttctttgccacaaaggaacaaagtgatttggctagtagggggattactttcaacaattaatttttttgctttaaatatgttccccaacaacctcttggtaaccttactaaaaaaagattgaatattcttttacatttctaattaatcttgaaaaaatattttattttcctcacttaaaagtaattaggatcctcacaaaccccacacggcctaactaggtaatacaaggttaggctgagcatggtggcccacacctgcaatcccaacaatttcggaggccaaagtgaaaggattccttgagtccaggagttcgagaccagcctgggcaatgtgacaataccctgtctctgcaaaaaaaaaaacttaaaaattagctgggcatggtggcacacacctgtagtcccagctactcggggagctgaggtgggaggatcacttgattgagtatgggaggttgaggctgagtgagccgtgatcacaccactgcattccagcttgggcaacagagggagaccttgtctcaaataaataaataaagataatataaaattggtgttaaaactatgaagacaacatgctccccttcaaagatttccctttcttaagcagggaacagggtttaaatatgtgtaaagataaatccccaggcaaatggtaacgagcccttttagtattttgttggaacacctatattgtgaatgacagagaaaagaagaatcagggaagaaaaaaagagcatttattgatcttctaattatgtgccatacgctctttgcattttcatatccaatgtgattttaattttcagtgtccctcaaggtacctattaggatccattttcttttttttctttttttttttttgagatggagtctcgctctgtcacccaggctggagtgcagtggcgcgatcttggctcactgcaacctcttgactcctggcttcaatcaattttcctgcctcagcctcctcagcagctgggactacaggcacacgccaccacatccagctaatttttataattttagtagagacggggtttcaccatgtgggtcaggctggtctcaaacttctagactcagataatccaactgccttggcctcccaaagtgctggtattacaggcgtgagccaccgcgcctggccagatccattttcatagatgagaaaatgggctcagagaaacccatggttatgtggctaggaagtgacagagaattagtacccagcccaacttgaaaaccctagtgctagaccttgtatttttaaaagtttgtgtctttttagcaagttttacaagtctgatattcagttcagaaaaagaaccactactttatgcgcctataacttcagtctggcaggctttgaattctttagccaatggaccatgcagtggtggccaaatgtcaaaagcatgaaaagtaagaaaactatgtttggctttgaaatgctttttggtacttataattgaattggaatgtctcctttctgagcattcacagtatttcaaacaaattaagaaaaacacccaaaagaactaacctgaagaatctggaaatctgcctgtcttgccccaaacatcttttttctggtcttccttttatgacaagattgaatagcattatttgtcaaacagacttgtacagagctgttctgtttgcccataaagtgtctcaaacttgcctgttttaggtgtaggatgtaactaaatactgttctttaaaaggcctctcctggttattaagccaggtaagagaagtagaatctcgaatcacctaattgaaatggtgacacaggttgtcctttctcagccgttgggtttcctttcatctctgaaggcctgtaggtaccatgaggaaaacatttaattcagagggtgaacccaacagtaggaagctgaaagcagaagtgtttatctccctctgcattcagaccaggctccttagtgcactcatcagactcattgctgcccctgctgtctgctgttgagccttcaccaccactcattcaaatccccacagcctacagattcctacaagtcatgtcctttctagtgaaccctttttaaagggttttatgtcacacacagtgcctagtccagagcttgttgccttcactttaacaaggcaaaaaaaaaaaaaatgaagtatttgtcctggaaacctaagctttcagtaagagtaaaactgtcctgaaacaaaactgtttacatctgttatctggaagcatcacctatttggtgagattctactcagaattcaggtgttagttttaatgcctagagcagtatgtcacattaattgaagaatttaaccatatctatcatttgtaatatatttcattctctcatataaactcttaggatttttcttttaatttcagcaagatccatatatagcatctatggaacaccatactgattgggtaaacgacattgtactctgttgtaatgggaaaacatgtaagtatttctttggattattattgggcttctgatatattttttgttttttatataagcttttttattgaaacatacatacagaaaagtacacacacttcgagattgcagttcaacacaattttagaaagtgaatacccaaatcaagaaacaatattactagaagccctcttgtgccaccctttgccaccctttcagttattccctcttgccccaaggtaactgctcttctgtcttctgaacaccaaagggtagttttgccttcatttgaactgtatatagactcgtactatatgtattcttcttttagccttattaatacctctttttgttctaattttggtgagatccattccttggttttgcagtccgagttacaggaatttttctcaatcacattagttgagccttcaactggaacattaaaaatgtttgcactgcttgttttaaaaatatatttttttctttgaacatgtgtcttgagattttaaaaaattgaggcaatatacaataggttctagaaagagcttttaggtatgtttgtgtgtgtaagagagagaatatgttagtttgaaataatgttacattgttgtaagataagttttcaaagttttaagtcatactactaaggagtttgttaattctttgcttcttctagtaatatctgcttcttctgacacgacagtaaaagtatggaatgcacacaagggattttgcatgtcaacattaaggacacataaggtaaaacaatacagttctcagtgtctttagtgtaatattgggatctcagtactttgtgtggctcattttattactgatctacagaatagatcatagtatgtctgttctattacaggattacgtaaaggccttagcatatgccaaggataaagaactagtagcatcagctgggttggacagacaaatattcctttgggatgtgaatactctaacagcattgactgcctcaaataacactgtcacaagtaaggtgtttaaaagaaacttctttgaaagtgatccaagttaacataaataaagaatggtttataaaacatttttgataggtttgcatcgagagagtgtttcatattttgagagtgcttctacctacagcgttctggcccccaagagtatgattgaacaacaaagagctagttcctcactgcagtctaaaaatggtaacttctccaggtataacctggttattttttgtacgtgtgcatgtcttagctccctagctaaaatgtaagtccctgcagggtagaggagactgtcttactacttcgtatctcccacagcattccctggtccaaatccatacactcagcaggtattattgaaggaggtggcgattttctgacaaagtaggcggttttctgactttttaaagtgttaagagcttttgagttaatagccaagatgaaaaatacccaggagaaagaaagaaaaggtttccagtgccagtttatcaaattttctgccttttagagcagccctgaggaatcaagccaattccagaagagccagaacggtagagtgcttctagaggcaatccagagatgttcacagcatggatgattcatcagctaagagatctcagactaccaagtcaggctcatacaagtctagatttgaaattgagcttcatgcttggcccaacctagtagagtcctctaggccaggtttcagaagggactgttaggagcacatttttggctaggcctgacctggaaagtctacattgaagacatgggcctgcattctctggatccctacattataggtccattttataacgactctgtggagtgttcacattgacatagacaatacagttttactaatatagcctagtatgtgccaagaagggtaagttgggagacttgtgtttataatctcttgattgttgttttgccttgttttccaggaaatatgtgaaggtctcaacattctttttcccttgttcttgatttttcacctgtacattatctctgattcattagctggtccctgttggggctgtcatggtacatcattaggttttaagtctggatgtaaggcctgcctcaaagagacactaatgggagggaacaaagcaaaaaaaaaaaagcaggttgtcacaaggtcagggcccaggcttagtggatacagattctgctacatcttgcttagagttgtttagagaggatatcacacttttttttaatacataataataaaaataatactaataatggctaacctgtattgagtacttgctacaagtagacatttttctaaacagtacatgtagtaactcatttactcaactttttaatatgtttgtaaaattgggttcatactatatagacagtttcatatacatcttttttacttcagtgatactgagagtatgaacatgatttttgctatagtctgaattccttcctgaaaggttgtacctatttatcttcacataagtaatatatgagagttccattgtactgttttctttttacaatcaagtattaccttgttttttgtcttggtgtatgaaacagtgtttttggtttgatttgtgtttgaaaaatactgaaattgaacattttttcatatttatggcacatgaatagctttaaacatatcatttaagcggatagcttttcaatggcactgcagtttatcagatattgagcatttgtatatattcaaatccagaaaatatgtaaattttgataataatactgtttagatttatctccattataggtagatttcttttccgtagaggacttataaagataagattttctaaattgaataaacttgcagtttttgctgactagttactaaacagctgatgatcttgttaacatttagctccgtttatcctcaatagcttcttctttaagtggaaacaaagattccatttatagcctggccatgaatcaactgggaacaatcattgtatcagggtccactgaaaaggtaaggaggagcttatttctttatttaaaaaaaaaaattatttttcacataccttgtctcctattttttaagcaggtattttacgattagcttctttatatttatttatttagagactgggtctcactctgtcacccaggttggggtgcagtggcatcatgatcctggctcactgcagccttgactgctgaggctgtagcgatccttccacctcaatctcctgagtagctgggaccccaggcacacaccatcacgtgcatcaggccactccttgtcccatctggctaatttttgtatatttttaatagagacagggtttcgccatgttgtccctccaactccttagtgcaagcaattcacctgccttggcctcccagagtgctgagattacaggcatgagagccactgtgccccaatcgggggagcttaaagggtggtttgaacattagaaaataaagaaaccaaaataatttaatctgtgtaattattaaatatatggacagtggttttgcctagtgggtgctaaacaaaaggttttatttgaataagtaagagtataactataactgttgtgtgtatagtgacaagataaagaggctgtgcatttttgatgtttgaaaggcctaattccctgaggttgggaggcttagacagtgtccattggcagaagtggtattgccttctcagaatataatggttatcatttgacttatgagagttgtctgttatttaaatttgatactgatatatttagtttgtgtaatactctattaaaattcacaggtgttacgggtatgggatccaagaacatgtgcaaaactaatgaagcttaaagggcacacggataatgtgaaggcattgctattaaacagagatggcacgcaagtatgcagtttcatttgggtgtttacctaataaccttgttagaaatttccgcactttgtatactattgcataggttgatttgaaccgaaagccacacttattataaattgtctaattaaaaaattttaaaatactaaattgcacatataagctacatttaaaaactattctatttgcatcacttttaacaaaacaaagaatttccttagaataattctgatgcagatgagtatatgcatttatggtgcataggggctaaaataactaaaaacattacctgtgtaaagcaaaaggaagctttgatatcaaatgctttttgccagtgtattaagtggaaaatttgctcacagtgggtctgacttaggggcacattttgtcagttgactatgtagatatagttgataaatttagttttctaacataatgctcagagtgaacatttcaaagaaaaacattttggtaatgttatacattagctctgttggccacgtaatttgtgaattataaatcacaattctgttctgtagcaatggaaaatactttttcatcaatgtagataataaaaaacaaaaactgagcatcattttatgggtatgacatatgtctaccatgtacccttgactcagccattttttttccagaatgcagtgataagtcagagataactggaattgattgtgatagggttagaaaagggcaggtagaaagatgatgaggtgagaaacaccatcagtttcttttcctgtggaagttaagactttagacatgaaattgctaaaatttcacgtctaagaaattgctttagacatcaatcagagaagccgtcgcctccagaaatgaacagaaggtttggaaactagtctaaggaaggaaatcatttttcagaaccaggagaagaaagatttaaagatacctgtggaggtatttggagatgtgaaggatctttttttttttttttttttaatactttaagttttagggtacatgtgcacaatgtgcaggttagttacatatgtgtacatgtgccatgctggtgcgctgcacccactaacttgtcatctagcattaggtatatctcccaatgctatccccccacccccacaacagtccccagagtgtgatgttccccttcctgtgtccatgtgttcttattgttcagttcccacctatgagtgagaatatgcggtgtttggttttttgttcttgcgatagtttactgagaatgatgatttccaatttcatccatgtccctacaaaggacatgaactcatcattttttatggctgcatcgtattccatggtgtatatgtgccacattttcttaatccagtctatcattgttggatatttgggctggttccaagtatttgctattgtgaatagtgccgcaataaacatacaggataggatttcactttagtccttaatttgcttatctgcaaagtgagaatcataatatatagtttatatagttggtgagagtgtgtgtatatgtatatatatgtgttaataataagtattttcttaactgtaagccagggcatttcctagagctctcaagttcctttgtggcctcattttcacatgactgtaagaattacccagtgcagtcagctcctcactgttttgcagtgtagctgcaaggctgcacttgagatggttgcccgtgtctcttcagttagctttgccaggattgggcgggatcatatcatctccatggtttccagaagggggctatgggcctggcagaccttctaaagctctacctgtctgctccatctcttgtttcctatctatgcaattatgaatgtgcttctataaaagatgatttaagtatcacgtgtacagttagaaatgcacttcatctgaagtcagctacagtcattgtaagcagaggaaatattgtggttctactttaaaaactgcctgttagtctcagagtgcaaacttgataggtatcactcttcatctagtttctcttccacccattttccttattggcaactatggactaaatgtaaaattaccaccaacaaccaagcatatttacgttagtgaattgatcaacaaaaaactataataactgcttatttgggaaaaagagatgagaaaaaaagaaactcttactgattaatgaattgaccaacaaaaaactataattacttatttggaaaaatgaggtgaggaaaaaagaaacttctacttacagattcttgaattcttgtaatatggaagaggtggttatcagttactgggccaaagtttatattgcatcctgctaaattgccctgtgagcttgtaatatagggtacctggtggctttgtaaatcaggaattggcagtaagatacatatcttataggccaatgaatcccatgaatatctacctgttgcctgattcttttgttgtagaataagattcttatttaccaaatttatttgaggttctccctaagggagttctgcctgtaaagagatcagcattgcagttgctttgattggtgctaacattattgggcagagccacctatctttttattccttttacttaggcaattcattgcttgaggagctgggacaacctgccatcttgatttgagtcagtcatgtccttgtatgtcactcaaagggttcttttggtaatacaagtctgctgatcctagcttatgggtctgagggtctcagagcatcaggccacttattgccccagcttatgtcgtccacttggctgatctctgttggcacttgagattgtgtgttagtgaccatcccgggaacactcctgttggtcagcagcaacttggcctcagtacactggtacttcctatcttcattggcagaaacaaagagcacctgattagggctacagactattccactaaatctgatttagcagaatcattgaaggacattctgtcctagtcccaggagttacctcataatgaacatcttcatgtttatctatgtttttctagtggaaggatggaggcagtggaaatgttttgatgactcctccagctcctacaagatctcaggcactataattcctataaaacaggacattctttaattatactaccaaatgctgcgaagaagttggccaacataatacttttaaagtggttgctttgttgggggatctgcttttccgtagtcttagaatactgattaccatcagagattacttggcgttctatatcagggttgataaaactgtgtttccttatctgcttccaactgtgcacccttagtttgggacttatcctttcctgttacaagttgccccaggccacgaggacttctaaccatcatatcttactttccttgtcctctttaagttgtcaaatcttactctgtagatgcatagtctaggatctgagggatcaaagctttactaaaagctttgccacctcagaataacacctcttcctggaatggggagcccctccttggcccctacaccatcagattgccacatttctcactcacatatgttgcagatttgctttaactttgctcctgacgtttgctttattggttagtttcttggttcccttgtaaactagctggaataggttattaaactactgatgctcctggcatcttgtgggagagtttcctagtatgtgttcatttaattaaacatgcttagagttctcaagggcccttaaagtcatggggcaggccagtaaatttttattcctgaaggcctcatgtatttgggcaccttccaaatctccaagcccacaactgtctttccttctttgaagctctgcttacttaacttcatactccagcaccagcaattgctttttcctccgggccattctttttcctaaggaaatcaagtttttatactcttctgcaagtcaccacagtaacatgctgtgtggatgcagggtgtctaattcagtctttttccacctgagcacactcacagtgtgctcagccctaatttgtgtgtcagcagcttctatgtagttgactctcttgagccatcagaaattgtcagaattgccagtgttaactcacttgaggctcatatggaaagtgtccaacgcaaagagtgaatggtaagcctgagactagattttgtttctgattcccgtcagtagaatccaagagacctggcctcatcaggaatccagagccatgagacagaggtgtaacccaggacttcaaaaggcttgctggcctagtgcagtgtttgtcaaagatagtgaacatcagaatcacctggagagcctgttaaagcaccagttgctgggttccaacagagtttctgccttgttagctctgaatgagacccaataatttatattttaacaagttcccaggggacgctgatgctgctgggaccacactttgagacccatgggcctagtgcatacagctaccttcatttccactgctttcaaactctatctcccttagtagtagataatgcgagtagggcttgtctacaggattgaccagaaatcaacaagtggccaggtagagaggacaaaggcagttctgctcagagatttctcctgctggagtatctctaagcataatgaataggtgtcattcatctagtttctcttctatccattttccttattggcaactatagactaaatgtaaaattaccaccaacaacctagcatatttacatgagtgaattgatcaacagaacaaccgtaactacttatttaggaaaaagagatgaggagaaaagaaacttttacttgcagattagtgaattgatcaacaaaactaccctaattacatatttgggaagaataaggaattttcccaaaattacataaatttggtcactttagcctgtggtgcatggttgtcaagcctttatcagaggcagaaacacaggttaatagagtcgtgtgtttgacagtgtggactcgggagaagtcaagtgcaaagcacaagaaagcaggaactttgtggcaagttctaactttgcctttctttgtttgcagtgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaaggtatgtcatatgttaatattttagttttataattaaggttgttacatgtgttagccaaatagagcaaaagctatattaaaacatgactcaactgcagggttcggagggggaaggtttgtaaaaaagatattccatcatgagcagaacttgacagggtaaggaagagtaggcatctgtctggagggaagagtgtcagtatgagatactctgggtcagttctggggcacttttgtgttttgcttttttttttttttttttttttaacagttttgtaagtcgcctatagaagaaagtgtgacttcttggtacatcagtgatgcatggctctcccactgatgaattgtagtgaaattgtctcatacttgctcctgagcttgcctggctttcctgagcagtccttaggaaaagaaatatgaggagttaaggttatctgtgagcagacaacaaagcagaggaaggtcaggaaatgtgtccatggtttcaggagtaaggaagtggaagagtactctcctgaaagaagagggagcaggctgcttcatactccaaaccaccactgcctcagagcagccctaaccatcaggatctgccatgtgggtcaaagggttcttgaggaagtctttggaagccatccatatggacacctgctgaaagtgaaggctgtactgaaaaatggccagtcgacatgttcaacctcaccgatagtcacagaatttcacattaaaacaacagtgaagaagtttccaaaatttttttttttttttgagacggagtcttgctctgttgcccaggctggagtgcagtgatgcgatctcggctcactgcaagttccacctcccaggttaatgccattctcctgcctcagcctctggagtagctgggactataggcacccaccaccatgcccagctaatttttttttgtttttttagtagagatggggtttcaccgtgttagccaggatggtatcgatctcctgacctggtgatctgcccacctcggcctcccaaagtgctggtattacaggcgtgagccaccacacgtggccggaagtttccaagttttaaaatggaggcagaaaaatactactactcccttttctcagaaatcacctaaaaggaaaatgagaaacagaactgcagatacccattctctacgaaactaagtgacatctgaaacctcagactgttgtgtaggaggaagggctgaaaagaggaatggaggtcaaatgcgacggttgggaggatgtctgcagtctaagaattcagacaaaactggccaagtacggttctttaaaatagatggcatatcctaatggaccgaaccagtaatcctttagagaagcaaggagtcagagctgaattaataatcatacatatacaacatgtgtgcaggcagcaggctgatgtgatggggagacaaacttggaggagaaacactctgcattatgagttctgcagctgcctggatctcttgccgggatgttggctgtgggggaaagactgaaagaacttggcacaaacataattatatgttataaggaatatcatcttgaactgaggaggattgctgctagctaggagtcctgccctgttcccatcactgcaaacctgcggtttcctgatgtgggaagaatagtggatgaatgtagagtgattccgcttgtgtaatatatacatgcacataaacatattcttatatgtgcagtattttacatacagaagaatatacagtaagctattcccaggtgtcccgtccttaggcgagggttattttcacttttactatgttgttaggatgttttttacttcagacattttcaaagtaaaaagaaatttatttccttgttactatagaaacataaaaactggagtaacaagaagagaaaattatggaaagtctttatccttttgactgtatccattcaagtacctcaaattgaccacacttaaaattattggccactgttttaggtgagaaattaccccattacacttttatagggctatgaatttatttagcaaagaaaaagactctctcatttttctgtgcatccttagtttttcacacatgcccaggtatagtcaccacaattgttgaatgaaggagttgatattaataacatatctagtcctggcagttcagaagagttgacattccacaaagcaatatttttgtgctttgttttcagatggagcttgatagatcagctgatcctcctcctgcaatttgggttgcaacaactaagtctacagtaaataaatgggtaagtgagctattaacctggcaaaggtttataaacatgtattttgttatcacagacctgtagacgccagttgcaaatgctcagtgtggccctaactctagcatgcttttgggcaggggcaaaaacctgaaagccctgtgaatgtaggtagaatcctaaagatcatactaaaattaagataatagtcaaaatgactattctgacttctttgtctggagccaagatacatgttccatgtccttagaatagacactgttgcctggtaaaaccagtaagtcttagtacatcttctgacctcatgaagctacatttgaagataggtagcccaagtaccaacaaggcagggaaactcaccaggattcaaatttggttaaacataagagaaagcagaaaattgtgctttcaaattagttttctttttcctcatagcatgaagaacagggatagagatagaggataaacagaagtcatccaaagtgcaccgttaattcttaaatcttaatttaaaaagacttaagttttcttgcttaccagactatctgtaggtaacaaaagagaaggtgtttgcatttattcctgttgacatgcaggtcaagtgttctttctgtatacttattttttaaatgttgtatatcttgtgttaatttcatcatgccaacttatgaccaatacaattttacctggaagagcactcctgctttcatgcatagttttctctcccaaagacaatattcccttcttaaaatttgtttctttctaaacgatgatagataattgtactgtgaccaaatatttttcggttgatgtagtggttgttgaggttttcttgtttgttttttgactttatttttcttgccactttaaacaggctggcaaagcttgtagagcataacatgatcaaataacaaattttgtaattttagactttgaaaggaattcataattttagagcctctggagattatgacaatgactgtacaaatcctataacacctctttgtacacaacctgaccaggttattaaaggtaagaaaatggaaggtactgtaccccttattgaagttagcgatagttacttagagattgacaaaaatcaagacaatgacctttctttaaatataatcctgatgtaaacaaaagataatacattggtttatttttaatataaggaaaaggtttttttttgtttgtttgttttgctttttgttttgttttgtttttttgagatggagtgttgctctgtcacccaggctggactgcagtgacgggatcttggctcactgcaacccctgcctcccgggttcaagccattatcttgcctcatcctcctgagcagctggaattacaggtgtgagctaccatgcccagctactttttatatttttagtagagatggggtttcatcttgttggccaggctggtctcaaactcctgacctcaaatgatctgcccgcctcagcctcccaaagtactgggattacgggcgtgagccaccacgcccagccagaaaaagttattttaaaaaatgctgttaatgggccgggcgcggtggctcgcctgtaatcccagcactttgggaggccaaggcgggcggatcacgaggtcaggagatcgagaccatcccggctaaaacggtgaaaccccgtctctactaaaaatacaaaaaattagctgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaatgctgttaatgacttttaaagtggactttcttgagtcagtttatttgcctaacatcagaatagccatgataaagccagtaaccacttcataaaatacataggatttaatattgtacttagatatgaggcagaaaaggacagatatgatcctcaaattctacatgctgctgctgattatggcaaaaaagcagtatatgtttaatgtcagagtttgggattagaattttgtatggcacattcatttgttcatgctgttaaacctttagaatattcattcaggaagcaaaagatgggaaaccaaagttaatgcaaaatgagactaatacagagacttcctgtcatcattttgacttttcccagtggataaagctgttgtccctcaacaattttccactagtacccccttgacatgaagagccctttaatccataatgtattattaaaatcagatagtttttctttgaatgtttataaatggacataaataatttatgggacttgaattgctttagatataattatatagtctttaggtttgccttttcctttctagtagctagtacagtttatgttcctgttagataccagttaacaattgttaccacaccatgaatttaaatgtagaaagattgttttaccaattgtgtttttttttcccattagggggtgctagtattattcagtgccacattcttaatgataagagacatatattaaccaaagataccaataataatgtggcatattgggatgtattgaaggtgagtattttttttgggctaaatataggttgttagattgtataccccctttattttttattttttgtatgtgataagataatataaattaagatgtaattgcagtaatactttatggggtggtatatactttcttatatgaatattagataagatcataattcatctttttaagtaaataaactgtttaaatggaatcattttctctggttagtgtattgcagacaatcttatatgctgccttaccttaaaagtctcatccttgtagctattgacatcttaagccagataattatttggaggtggaggagggggcaggtagggggctattccatgcattgtaggatgtttagaacatctctagcctccacccagtagttgccagtaatacccctccctccccctaggtgtggcaaccacaagtgtctccacatgttgccagatgtttggagggaggaagaatggtgtaaaatcaccctagatgagacacactggagtgcacacaataaggttggctgtttcttaggatttatagacatcactatgagcattagttacaactctgggtcatgttacaataactccttctgggacagttgaaatgcatgaagctattcaatcacattccaaatagcagtgaagcatttgtaggcagattaaaaagttagtctgcttttatcattctcacaagtctctctcttagtgttgttggtatacttgttcatttgttcaacagatatttcctagatggaatgactgtcatgtgcaaagaaccatgcttgagggtcataaatgatgaaaaagtctttaccttgatcccctttggtaggagggacaagtggaatgggaaaaccttatagataaagaaggaacagatttcaggatagcttatggatgagggaagtcaggagagcttcgtggtggagaaatcatttgaacaaggacttaaaggtttccagtagatgcataatgggagtagaaggaagagcatttcaggaaaaggaaatgaatggcagaggcacaggaaaaggatggtatgtgcttatttggggcaaggtgagcagttttgtttatttggagaccagagtaaatataaggaagtaacaggggtgtaagattgaaaaatgacatttaggtcatttcccaaagagccttaagctgcaggacccaaagttggcctttcttttgtactcctagaagaaccttagataattttagagcaggaaaatctcatgttgagggcagtagttgttagtgtatgtaatgggaaactgaaagctggaagacgtcatgattggagatctaaaggaagagacatgagcaccataggaaaggttaaataaataaataaaaataaaggacgagacaggtgttgagcttattataaaggaagaattgaaaacagctggtattttggttaagctcctggttataaagaaaagagattcacttaatgaactaaagaataagacaggcaagtttcttgctaggaaaaagggactgtcactgaacagaaaccttggcttgactaccatttttgctccctgtgggacatctatgtgggaagtccattatgaaacagttgtttggtgagcattgcttcagaatgagaggctttagttctttgagtagaaagtttagttgcggcaagcttcaaaaatctgattagtttttctctacaatagagagatgcctgttgggggtgggggtagaaacacattgatttcagagagggttctcttggggactggcaggatccagaacagccctaagaaactcatcagcagaaattattgattcttcactttgatactctaccacaaatgtgtccctaactctgtcctgtggctggacttcgcctcatgctgcccaggacctaattgtctccagaatacccaagagaatctgatcaggccagctcctctttgagagttgacctatctgttttctgtatatgggtctgttgcccactcttggtctggttaactgaggcctgagtagaatcctgctgtctgaatgggaggtacttctacttagatggggccagcatacatcatgattggcatttctgtgtacctagcagcttcccatatctagaccttgaagttttgatatcaaatgatctggtgtaatagacgtggctaaacagtgtgggacagtcaggagttttttaggaacattggcttgggagttggacagagctgcattctaaccttggctgtgccaaatactcgccaagtgatctacggaatatgctagggaacatctctaaaatggtttcttcattcctaaaatgtcgggggtgcctattattggtgatgttgagaagcacagtgtctggtacataataggaggctgttgcactaatacaggtgaaaggtgatatttgtctagactagggtgggaacaagggggatggaaaaaatcgaatgattaggaaaatatttaggcctgtgaacaagagtgatacttttttttttcttttttttttgatacggagtctcattctgttgccccggctggagtgcagtggcgcaacctcagctcactgcaacctctgactccctggttcaagcgattctcctgcctcagcctcccgagtagctgggattacaggcatgcaccaccacatcgggctaatttttgtatttttagtagagacagcgtttctccttgttggccaggatggtctcgatctcctggcctcatgatctgcccgtcttggcctcccacagtgctgagattacaggcatgagcaaccgtgcctgcccacaggagtgatactttaatgaaaggagtatgaggaaaggaaaaagcaagaatgagtcccagatttcttgattgtccagtttggtgaatggaagtgatgtagggaatgtaagatgaaaaacaggttatcaggagaaaaggacatgctgagaaagatgttgaatttgagtttctgtgggatatctgaatagaggtgtttggtgggcagacagctgtacagtctcatgcacagttaaagaactgggctggagaaaaaggctcagcagtcatcagcttgtgggttacagtttgatgtcataggaaatgtcagagtttccaagggacatatgtagactgagaagaaactaagtcatcagtctttcagggatgttgggaaaagaggaagccacaatagtatatgattttaaaaagttgcgggggagtaagaaaatgaagagccagtggcagctccagaactaattgagtgtttcaagaagaagcttgcggttagtggcattaacctgctgtgagttgatttaagatgtgactaacatcatggatttaaataaagagggtggcctctgggtagagtcttaagggcaaaagccaggtagagtgagttgagtagtgatttgaaggtgaagaaacagaaaatttgactggataatctttgaagaaatttgattggaggggtaggcaggaagcggcggaaactagagaagatgtaggagtcagagggccaaaggaagcttttgattttgtttggttttgtttggatatttgggtatttttcagatgtaagaaatttgagcatatttcattgctcctgggaagaagccagtagagacattcatgggtagatgacaatacaaggtcatcccaagaagcaagaggtgagggggaccggagcacagtcagaagggacaccgttttccttgcaccagggagaatgatagagaaagttaaggggattctgtcaaggcttctctttgttttgagaaaaaggaatcagagtcatgtgctgaggataatggggaaggtggcaaggtcagaggtagaagagagatttagttgagatggactgcaagacagtgaccccagggctcaagtctccagtaaatgagggagagtggcaggttgctagatggcagtgaaggaaaggtgtaccgtttactgttgctaaatgacataggcctcagagaaataagtttttacatgggagatggtagagtaatggtctccatggagcatcaaggaacaatgggatgtgggaaaataagcagtccccctttgagaagatggccgacaactgggaccctcgaaagagccacgttgctgttaagatgaggtggtatattatatcaatatcagcacaattaaatacagtttcttcccaaatactattttgtgcttttttaatttaaattttttatagcagcagattgttattttaaaaaaggaccacattctttttgaaatgtattttagactgtttcacttagacacatgtgaaaatatgtaaaattttgaatagcaaagtcagaatcaagtgaattcaccacttaatattgatcattatactttcttttgatgtataggcatgtaaagttgaagatctgggcaaagtggattttgaagatgaaattaagaaaagatttaaaatggtgtatgtgccaaattggttctcagtagacttaaaaacaggggtaagttagcaattgatacttgtatgatttgggataattgaagattttcattatagcttataattattattagttacagagtcctgtgtttttaggtgtgaaaaaaaaaatttgtgttaaaacttaaaatgcaaaatggaataaaaaagaaaaaaacaaaattaaaaatatattaaaaaagaaaaaaatttaaaagttacaaaatgcctttggtatcccaggaaactaaattgtgttgttgcattgaatcacacaaaacacattttggttcctgaatttatgacttagcactttagtcaaatagtacaaataaatgaaggtttagagacttgtttggagaatatattcaaatgggatgccactaagttttttcttttgatagatgttaactattactttggatgaaagtgattgttttgctgcctgggtttctgcaaaagatgctggtttcagcagccctgatgggtcagatccaaaatgtgagtttaagtgtccttcatttttttcctcccttctaaagagaagatgaatatgagctgttttttgctaagtacttatctttgtaaaagttctctatattttgttgactatgtcctaaaaatgtggtatgtacaaatacctaatgtatacaaatcattttagtaatttcatatggaaatagccgtttaaagaatctgattctcggccaggcgcagtggctcacacctgtaatctcagcactttgggaggccgaggcgggtggatcacgaggtcaggggatcgagaccatcctggctaacacggtgaaaccccgtctctactaaaaatacaaaaaattagccgggcgtggtggcgggtgcctgtagtcccagctattcgggaggctgaggcaggagaatggcgtgaacccgggaggcggagcttgcagtgagccgagattgcaccactgcgctccagcctgggtgacagagcgagactctatctcaaaaaaaaaaaaaatctgattctcatgtttgtttttaaataatagctgtatctgaacaaccaagtagaatatgtctttgctccatagcatcattgctttaaacattctaagataaaattttagcagaattggcaaaatgactaaagtctttattttagacatcattcgcattgggttaagaatgtaacatcagaatatgtacaaacttacaatttttattctatttttaggttaaagccaagtaactcgcttttccattttatctctttttaattaacttttttgcagtgaatttaggaggacttttactccaagcactcctggaatattggcctagaacacatgtgaatccaatggatgaagaggaaaatgaagtaaaccatggttagtttttatattcagatagttgcataaaaagttagaggtacttacttaaaaggtacttactaaaaggtacttacttaaaccgttagctaaaatatttgtggtgtactcagtttattgtcctctcttccatatctcaaagtaggaacatccatccagtcttaactgagactgagattccaaaagagcagaccaccttatgatatggcttttagtgagactgctcaagataaataaaatactctatattcagatgacttttgtcttaaaatgaggcaccttaacagacttatttccaaaatattcttcaaggtacctctgatcttttggattaacctccaaagctaggtagttagctgcatcagaaagccaggtttgtcattgcatagtcactcttcatgttgggctgaaatgttggtatttcctagtctcatggcctacctgattttgactctgtttcaaaaaaaaattcaaattccaactcagaagtgacagggcatatgctcaagcatgtgtaaagaattaatgtcactgaggacatctgaaacgtgtgtgtgccataggcagtggcagtaacgttccctgagcagcagaggagaacatgttttgaatatatgcatttggctcagtttgatcaaaggaaggggaaacaagaacttagaatttcacatcctcatgtgtaacctacagctggttgaggaatcattgagtcccatcgactgaggcttactctgctgaagattctctgctggccaccaggagtgagcaacaatggcgagtacctcctgccagggactttgttctggctgtcagattcacccataatgatatgtggaatttaaatctctcacatgaggatgacatgcttccttgaaaaccagtcttctgatgttcctgtcagagagagggtgctgttgccccacccatggtggcttttcttttacatcacctgacacactttgatccctgtcagaattgtacagtggactttgagctaaagaaactgatggaaaaatctttccacagagggtcaagaaagctaggttctggggtgggctctgctgcttaacagctatgttgctgtgggcaaatcatttccagttagatgggatactctcagccacccaaataagcaataaggattaagttatcaaaacagtggtatagtcatgcaccctttggatctaggctttgggtgaggagtataaggaagacatcaccagaaatcacgtcatccttaacatcagactgcatgggaaaggtagggcagggcatggctacttcctcatccagagctcagaccacagcacctgcagcatactcagtggacactctggagttgttcagatggtgcttggtgagcagctctactattcaggggcccttaccaagtttcaggtgggggtactaaagacacatgggtatggtccctgtccttcaggagctgatgttctggtatggcagagagttacttatggaaagcattctgagatagaagggtgctaggagagaggttccacaaatgctataggatttcagggggtcagatgcttccagtttgatgaggaaagtgtcatgaatgaattggcacttgagttggtatcacccacctgtgctgggtcaaaagtttatgaagaaagcagaatggagctaggcgtgatggctcacacctgtaatcccagtgctttgggaggcctctaatatttgttgacagtgattttgacgtctgtgcttgttgggtcatttactacttgatggcttatgtttaggctgccctgcccagcagccttgaacccaggagtttgaaaccatgctgggcgatatagcaagatcctgtccctacaagaaatgtaaacaattagccagttgtggtggtgtgtgcctatagttccagctactcaggaggctgaggtgggaggatcacttgagccaggggaggttgaggccgcaatgatctgtgatcacaccactgcactccagcctgggcaacagaatgagaccccgtctcaaagaaaaaacaacagtggaaaggaaatctgcagagaacaataaaagcaaaattgtggactccttgaggattttttcacaaatgcttctgtctttagttatggctgccattaaatgtaatttttttttcctcaagaaatttttctgagcttggtgttctacaaaaaacaaaaacaaaaaaactctagatcttcgtttatatacaggctgtcctagacttccttgtggctgaagtagctggttatgtttttgttctgaatctcaaacattaatctcttttattaaaatcctctaaaatacagtcattttttccatgaaatagaccacaagttgctgtgtttcttattttcagaaatttaacttgtttttaacctttatttctaactctggtggacttagaggacatttgaatttaatcttgcaatgtttgaagcttgtgggagtaaaatgtttagaatctgtatttttagcactaactctgatattaacaccacctgcatcttttcctagtaaatggggagcaggagaaccgagtgcagaagggaaatggatattttcaagtgcccccacatacacccgtgatctttggtgaagctggaggtcgcacactgttcaggtatgggtaagaaagacaagaggttctgcctgagaaggtatcccatttgctaagaagtgtcgactcaaactcagtatttcgatattagaaatagtttattattaaattctagggatgccagggattggaagcatcccatgtccatgagatagtgaaatgtctgctgctgttagaccacattctaattgggaggagaaactctagtgttcgaatgaggtagaatactttgcctcgaagcagcttctctattggtttctgtaggtaattctcactttccttcactttgcccgtgtgactgcaagggccaagcaacagatgataccactagaattccctgcccacagaagagcttcagagtacattacattacttttcttaggctgatccagccaagatgagctgggctgctcctgggaactgttgaggctgacactgacactgcctggggtgccagacagttatgtgtggggcccttcagggaagggctggactggttcacctccaagttgctagcaaggtcctggtagagccgggggagagcttactagtctataggtgccagaagaaagaaagaataagacatgcttgtcttattcttgagtgcaggattatctatctttctgatagtttcctgagtggttaccagaaatattctgacttccactgtgtgtgaaagtctctgccatgcactgtggcactagctggggacctttactgggtgctttgcttgcacccaggtttcctgtcatcacccaaggactccaagaagcagctgtagtgtatgcctggccttggaatctgggggcctgattttagggcctgctttcccttttagctgagtgagtcattcttccaggctgtacttttatttcctcagctgtcaagtgggggttatcctacatgaaaaccatgagggttcctcccgctaatatttgttgacagtgattttgacatctgtgcttgttgggttacttactacttgatggtttatgtttaggctgctctgccgagattccgggggtgagactgagtctatgcttcttaatgaaacagtgccacaatgggtaattgacatcactgtggatgtaagtatcctccactcccactttgctcttttatttttttgtaactcatgaaattaagaactgctttagacattataattttaaaccttaataaaagctagactcccaagtggaatccccatctgcttccttgcagttccaaagttgcagaaatagtactgataattatttatctatctagctttgttggtttttaattataaaaataatatatgcttattcaacaaaataataaatgaatgaagctctcatcttccccaagcattcattcttgcccattcactccctatccttcctcccagaggtaacaactattaataaattaatgcatagccttcagtacttttttctttgcatacaagcatatattatttgtgtacatagatgtgtctacagttcattttatattgcacaaaatctcttatactgttctgcaacttttttttcacctaaaaaaatgtatcctggacatcttttcatgtctgtacatcttttcatgtctgtacatgtgaatcattcctttttaatgactgtgtaagattctactgtataaatgtaccataatttatttaatcagtcccctattaatggacatttaggttgtttccaatgttttctattacaaatagtgctgcagtgaacatccttgtacatatatctttgtgtgctttttaggataaattcctagaagtggaattgctggatccaaggttatgcacattttaaattttgatagatactgccaaattgccctccacaaaggctgtagtagtctacattctcaccaacagtgtatgagtgcccatttccccacacctgcaccaacactggatacttctaatctttgctaaaaaataggcaaatagtatctcattatttttatgtggattaaaaacaaattaatagtgaggttaagcatcttttcatattggccatttgtttttcttctgtgaattacctgtttgtattctttacccatttttctattgggtcatttttcttactgatttgtggggtggtggtttatattgaatattaaccctttaactattatctgtgtctcaattaaattttcactttgttccttttgccaggtgaaaagttttactttttatataatcaaattgatccttgatggctcttagtttcatgtcttgtttaggtatttcctactccaaagtaacaaaaatattctcctatattctcttctagttcttttatgataattatgtctagctctctaatctattagaatttagtcttctgtttggtgtgaagtaggatttagactttttccaaagggacagctagtgtgctagcacaatttattgaaaatctgtcctttttctacttatctgggatgctatgtttatcatgtactaaatttctgtatacacatgggtctgcttctagactctcttatgtactgttggtctattttgtatctttctaaagccatatgaaaaggaatttaatctttagaaccttcagaaactttattttctgtcccggatatacctctaagacttaaagccaatgtgacacctgatggatattccatggtcttctctatgcctgagcaccccataagccactaatttctttgagtgtgaaactcacctgggacgcattgctgactttagccctgtggcttattcttgagaggagacatccagacaggatgtgacatgaaggcttggaggggattaataccctgagaaaagatgaccacgtaattttatccttcatctaagaatgtggtttacttcatggtagacatctgggttcttggctgaagtttccactctttcttaacacctcagacctcactgtgatgtcagagggaaagaaaatgggaggactttgattggccttttcagttggatgatgggcctcaccagcacagaatgtgtggctttgctcaaaggtgaatgctgtgggtttctctcaagacacttaagtttttgtttgggcctttaggtatcaactccaatattttaatgtagaattgagattctggtttgtatggcttaaaaaattaaagtttgtttccctttaataccttgtactgttatctaagaagagccatgctacaatttcatattacctctaatgttacatatatttttctgatgaattttctcgaaggctgacttaggtaatttgatagcttactatacatttcatagaaagtcacttttaattgtaagataattattacttgcaagtcatgttttcctattaacattattttcatttatcaactaatagaaactgttatacctttttaacttttactgtttcagaaaaatatgcccaaattcaacaaaattcctttctacctccaacctcatgcatcttcaggagcaaaaaccttaaaaaagtaagtaaatatatggtttcttgatctaattaactactagagagaattccttttccttatgattgcttttatagcaaaggaagcaaataccagatctaaggctgattttataatattcaaagtttatacaattaaaccacttaccaggtaccaactttggccgattacaggtgttcaaaaataaataaggccaggtacagtggctcacgcccataatcccaacactttgggagggtgaggtgggaggattaattgaggccaggagtttgagaccagcctgagcaacgtagtgagactcctgtctctacaaaagatttaagtaaaaaaattagctgggcatgggagcacacgcttgtagtccaagctagccaggaggctaaggcaggaggatcatcagaagtttgaggctgcagtgagcaaagatcatgctactgcactccagcttgggcaacagagagagaccctgtctctaagaaaaaaatgataaataaaacacacattttgtctgttgccttaattcacagtttaggacccaacctgtatataatagttgtttttatggatacttaaggaataatgagagtgagagaaataaatgagcttttggctggagcttcccagtaaggcttcttgaaggacgtggaatttgagttggacatgtaatgattggtagaacttcaaaagatagatattccaagtccaggacacagtgtgatcagggatgtggaagtgggagcatgcataagatagtggaaagtaacgtgaggacccatgcacctgcagcatgggatggaggggcagcagggggatattaggaggtaaattggaaaagcagttaaaggttttgttgatgttggatttgaatgccaagccatagagcgtgcagtgactaaacaccagaaacttttgagccaatgtgggatatggtccagggagacccaagagaagaattttagtagtgtagtaatgggatgctaaactatgaacaatatgtattctagcaaataaaataaaaaaaatttttaaacctttttattacagagatttccaaacttatatagaaagaagctagtgagcccccatcgtcccatcagatagcttcagtaattatcaataccttgctaaacattttgcttcacctatacctctacctgccctcccacccatctctgtctacacacacacacacacacacacacacacacaattattttaaagtgagtcctagacatcagttcagatagatttaacaactgaagttcaaatgattttcagagcgtaggccttagttttttggtataatagttattgactgttatcagagatacagaagtagggtgttgatgagtctagtttgggacatacagagtttgaggtgcctgtaggacatccaactgaagatacccaaccagctgttgggtttgtggtttagaagagaaggttgagactcaaggtctagactcaggcattgtctgctcacaggtgctagctgaaggcatggcagtggggaggagagcccagggaaaattgagcactaagagtgtcggaccctggtaagcactgggagctgcctgcctttccagaattatttagtttgcccaggttctgggaaagtattcaagggaataaaacccagaaggctactatgtatgtatatgtaaatgtttttgtttgtttttctgagatggagtctcactctgtcgcccaggctagagtgcagtggcgtatcttggctcactgcagcctctgcatcctgagtagctggaattacaggcgtgcaccaccatgcccagctaattttttgtattttagtagagacgggatttcaccatgttggttagccaggctggtcttgaactcctgatctgaagtgatccacctgccttggcctcccaaagtgctgagattataggcgtgagccaccacacctggcctgtatatgtcaagttttaagaacacatattaatctcatttagttgtacataaactgtgtcttagaaggacactgtagaaaatctttccgcagctctaaaaatggattaaggtaatgactaaaaacatttattggtttatttttcatctttaaaatgtttgcatcaaagaaaaataatatggaataaataatatctagtgatttccctgatgtcacaatatgccattgcttttttacagagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggtaagtggacttgaggactacagccccaatttttccagtgctggtgctcataaagagttacatgcctttgggtggggggcttctacttttagaggggctctaaggagccctgggcctctcctacctaaagcccaccctaaagctcctctttactgctggggagattttcagagaagggatacatagacaaatgtggatgtgctggtagcttttttttctgacaagaaaaaagacacatggtcttcttgatttgcaaaaagcatgtgccatgtttatgatttagagtgaaggtgtgcggagaaatggcagaactgttttttaaatcaagatgcactcaaaacgtatcctcagaggaatggctgaaagatggcctggtgtttctggcatagtcacaaaagatgtacatctcactaagctcaatttcattcccgcatgcatggaagccgtgacagcaagaattggataccaggcataggggaggagtgagcaagctggatcacctgatgagagtccctgagttaatgataaggttttagatattagagactttgaaatttttaaatttaattttggctattcaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttc

SEQ ID NO: 38754 - DNA, 55959 bp, Homo sapiens; identical to SEQ ID NO: 37692

SEQ ID NO: 38755 - DNA, 9121 bp, Homo sapiens
gcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgtaggacagcccacaggtagaagaattgctctcgtttgtctgtccattcatcctcctctcctcactttatctatcccacgcgacttcagggtagactcctgctggcaggcaggatcataagtccgcggacagaacggaggcctggagtggaggaatgtggtttgaggtttggattggtgaactcagctagaaaacatacttgcatttgcccgaataatgaataaccaagaaaaaaactgacaaacgattttctgcaaactaaagcaaagcatttaggccggggagggagagtttgtaacctgactccttccacctttagcgagttggagcttgtgcgagttctttccactctgtgtatttctttttaatgattttgtgtgcgccttttgtgcgggttgcaacgttgcgctgagttttgtaaccgctgcctgtgcgtgcatcctgcgctcacgggagggcggatgtggagagggcagaggagcaatggtgacctgggaaggtaccctgagcggctacgctaggatctctgttctgcagacttctgtcccctttcccccttataaggctgacccaggcgggctgaaggcggtggggccccttcgcagaacctgcttgggaggtctttcccgggtttgccccgcctcccagtttgcactccctctcgcggccataattctgctctcaagcactgttgaaagtcactgccggtccttcctgctacggccttctctctgtgcagtgcttattctccagttctttttgtttcatcactttggtgcctttttccttctttaactctctcgcgtgtcattttttaaagaattctccccttttcccctgctcctctgctcctgggagcaaagtggtcgcagcccagtttaggactttctgcaggggttgggtctcagtccggagtggaaggctctgttccaaataatcaatcatgcctggaagctggaacttatttcgctggggcagtgggagtggggccagaggctgctgggcagagtgggtggtccttgtgcccggaattggcaagagcggagcaccccagggacccctggaatgagacagcagagctgtgcagtctgagattccttaaggcccggccccttggcagcagcccaggccctacccgaggccttccacgtggagcctgatgatctcattcaggatttgagccctcgcctgtgaaagagtgactcagggcctctgcctgccgctcttgctccaagattttactacaattgggtaggattatgtgcgaaattgccttgttcagactgtgggatttcaaagagaacagaagaaatcctgctcacacacagaaagatcctgaccatgcaaaggagcgcgtggtctttttatttaaaggagaggagagaactttaaaaataacacttggagtgaagatatgcaaatatttttgttattgttgttctgggtatatttttgctttgtttgctttgactggttaggctttcctaatatatgctaggaaggtaactattcttggacagcctgaccataagcaaacttttttttttctttacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggtaagaggaagatggtaccagctgtgagactgtcctcttaggagtctacgttgtaccaaaaagatatatacaaggcatttcaccagtgtttttgcagttaaccttttttaattggctagcatggtttatcttactcatttctactgtaatttaaatatctcaagtttcacagttctattttaaaagcattagaaaaaagcttgattaaagtcacatgaagtcttcttatgtcaacaataatgaatgtagatgctccaaagcatatgtgaaggcacaccctgccaaaaaagttagatcccaagggtcatgctccccttattaataagtatttacctttgctttttgtaggacttgtgtgggtcccagacatgtgatactcttgggatggctgatgttggaactgtgtgtgatccgagcagaagctgctccgtcatagaagatgatggtttacaagctgccttcaccacagcccatgaattaggtaagtctgcttcaaagtagaagttaagctcaattcagaaatgtaaactggtaaaacaatataagaaggagagtctgtaggttatattgctattttaggtcctagtgcatcttagaaactatagaaaatattttgtcactatttcaaacatggtcatttttattaaagtaaaaaataagatagtagtagctctggacatttggaaatgtgtatgtttgtttacaccctgtgaaaagtagacatggtctgcaaaagagccaatctcctaaatatatttctttctctagaaatgttattttgggacaaatgaatgaatccctgttgggaaaaaagaacctgctgcatatcatccatattttattttattattattttttttgagatggagtctcactctgtctcccaggctggagtggagtggcacaatctcggctcactgcaacttctgcctcctgggttcaagcgattctgctgcctcagcatgcccagtagctgggattacaggtgcatgccaccacacccggctaatttttgtatttttagtagagacggggtttcactatgttggccatgctggtcttgaactcctgacctcaagtgatccacccgcctcggcttctggaattacaggtgtgagccaccgcacccagccatgatccatactttaatgtgggttctggattgcttcctaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggtgagatattccagctactctctctagatggcatccaacctttcacgcataaagtttagttaaatgaactctttcctttttgttctttttattttccccacttcaaaattacttttcctctgtcaagatcctaactgttgagatcttaattccaaataaaaaatagtgcttccggttgagtagctcccaaagcccattcattcacattgttcgcagatcaataacttcctgtcattgttaatatagaaataccccattgaggataagatcttaatagtaatctaaatctcttcagcatttccctcccccagctttacagttttcagatcactttgctgtctattttctcatatgataaatattttctgaaatgggatctaccccttcatgccctcactaactctgtattgatattggttggcatttcctttgcaggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatgtgagtttttctactgaaacacattcagaattgaaaagaacaaagtgatggtaaaagatatgataccaagttaaacatccccatccgtgtcctctagcaggaatgcgagatagcttatttttagaactgattctttgtcccatgtggctttctttgataccctaaaagttctctttagataattctaatgctgatgatttatgtctccatttagacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggtgaggagcaacggactctggttttaagaaactggattaaaaaaagatgtacccacaaacaggtggctcaagattggaaactgataatgttatcatattattctctttccaggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggtagttcgtttttaccttatttttacctaaaaatcaaggcctgggcttgctaccttttcaaacaatttttgttatactttctttgctttccatattaacatatcttcaatttcaaatttgaactccttttcttttacattaattggcaactgcctgctttgagtttagtgttttcagttatgaatgaagcttaaatctaacacttcacatgcttgcaattgctcgctattactcttttatatgcaaagaaaagctttttggacagtcaagcgctcctctgtgcgactaggcttcacatacagctcatagttagatacattttatattcacacagtaaccagtagttttggaaaatagtctatgcatggtccaaaatacttgttactgggtaactagcagtagcaggtgcaaacagaataatagaagtggtagtctgagtattgattatttttatgtttgaaaacacatattgaactaggaaaagcatcatttcttttgctgttttgctaagggaatacatctggatctgagacagaaaatggaatttaatgtgattgagatgatcgtgtgtcattagcaccataggctatgaaaatattcccaagttgcagattcaatattcagcaagtgatttctgaagcacttactcttgccagatactaattattctaggctctgaagatacagcagtaaacaaagtgacaaacagctctactttcattgaccttagctggaggagacataggtcaatagataaataatttttaaaaatatctaatttcttcagatgtctatacgtagtactgaaaaatatgccaaagtgaagggtaaatgcatgaaatgcataatgtgtagagggtactgtgtttaattagcatggtcaggaaagtagagagaaaatgtttacacttatcattgcagcatctccttcctttgcttgtatgtaacactagacatgtgtccttttttcaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaagtaagttttaaaacacctatttgcagaccttataatttaaatgggcctttcaacaggtctgggaaaaaaatatgtctcataaaagattaatgtgtttttaagctaaataatctaattagccaatgaatcagagatttatgcctgtttttgtcacctgcagacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttgg

SEQ ID NO: 38756 - DNA, 10212 bp, Homo sapiens
gcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtgagcggcggcggtgggcccgggccccgtcctcccgggcgccgctcccttctcggccgccggcggaatctgggaacccgaggccatcacgtctccatgtctgcgggtttctgtgagggcgtgtggttctccctgtgggtccctggcgctctgttccggtttctgtctgtccctgtgggtctctgcctcccccgccccctctccctttccgcggcactcgtccttcccccagcaccttccccccggcccgtgggtccgtatttctccattgacttccctttgtgagtttctgatcccctctttgctagtctctctcgttatgtgtttcgttgtgtctgtgtttctccaccagcctccctctatctgcatgcgggtctctgactccgctgacctctcaccatggatttgtgtttctcaatttgtctctgatccctgaggacgtgtattccgtttctctggtctctgccttcctcatcacatccatatagcctcagaccctacccttcctccttaacacttccccccatccttcgcaggccaccagcagaacccaccagacagaagctccgtgctctgcctggctggtcactgcctggcacgtactagacactccttatacacgcattagtccatttcctgtgcagctgtattggccctacgtgaaagatgcgagcttggcccacaccttagctaattttgtttctcactaaagcagaatggggaaagcgatttgactgcctccattcgtggggcacttgagatgtgtccctgtaagtcttctcacagaacacatgactggatctcctcctcgtgaatgacacctcatttccttcatgtttcttaagtccgtcaggtgccataagattctggaatttagtggccacaacttgtacttttggggatttttcagacttggtgttgaaaggggaaaacaggaatataatagaaagcgtggactagcgttcgacctgggcaggagtcctccgtaattatgtgagcagagacccctgcatctgtccgaccgcagcctttccgtcactgagccagttatgacagtattggctctgcagggctgtgtgaggattaaaggaccgcacacatgtaaagagcatggcactgcctagcacaacaggaggtgccagttgtcttcccgttacctttgcagttttgaggtcctgtaaccagagcagctgaggattcaaacctcgtagtacgaaggtctgtatgagacaagaaaggaaaggtaacagaggagcatttctatttcctgatccttttccatagctgtttccagagaaatttactgatgtcaattctgtgcttttgacacagggttggtgcaaagatccacgcaactgatgcaggctagtgtagctatctagtgtaggctctggagccagcctgcctgggtttgaatccgccttttactagtcttgggcagtgattgatgagggagacaaagcctcttctggactgcccctcagagccagggtggcctgggcctgggagccactgggactgcaaatctggtttgccacctggtggcaccaggaacaattgttctcggtgtccactgtcctgaggaattgggactctgggttcaatccagttgctctgcggtttgtgctcttagagcacaggatgatgcccatggggatgtggtcctcataggagaggggagcagggccgagggaattagcgtgtggacgtgctcggagtacccagtccacgccgttcccctggataatagtcactgcttcttttcatgaaggtgggatatcaccccatatccatctctccagtctctaccctgtccccagaaaaagcccagagggcaagggagaatctgtagaggttccagccttcccagaccactctcaggactgggctgtgctcctccccagctgaatccaccaccacaggataatggggggtaagtcagaagccctggggggtttcctaccaggccacctctcagctgcgtgtggaacctgggcctggctgcaaggctactggcttccaggttggcggtctctctagaaaaagggaggagttggtctggctttagcatgtgacttaaggcatgccctgactgccttacccctttctgtaactcacttggcaagctctctgctgtctggcctgtgcttgctgtgctggggccacagataagaatctgacacggcctgagaagcaaggacacaaggcattacaaaaaagtgggaagatgccgtgggaatacaaaagtgggagcattatgggggcagggggcagtgctggccatgacattggagttcggctctgaaggatcaacaggggtcctcaggcagataaagaaggacatttcaggcagaaggagcaggctgtgtgagggctggagcaggaaggaatatagcaagtggagaagctccgaggtgcccaacatgagaacatggggcgaaggcttgggagcacctggagttggggccaggtcatggagggctttgactgtcaggccaaagggcttggcctttgtctggcaaacagaggagggtcattcagaagactgaaggggtctgagcagggcaaggaacagatgagtgaggaaggatcagagggggacttaggagatagaatttatttatttatttatttatttatgagatggagtctcgctctgttgcccaggctggagtgcagtggcgtgatctcagctcactgcaacctccgcctcccagattcaagctatgcttctgcctcagcctcccaagtagctgggactataggcgcgtaccaccacacccagctaatttttgtatttttagtagagatggggtgttaccatatttgccaggctggtcttgagctcctgacctcgtgatgcacctgcctcggcctcccaaagtgctgggattacaggcgtgagccaccacgcctggccaggagatagaatttataagacctgatagctaatcgctgactcttaagattgtgaagtggattcctttgcagattactttggggagaaggtagggggagtacagaggaagcttctcccttcatggattcctcagctcctgtctcagcatactcaggaacttccagaggagcggcaaaggaatctggtgaattctgtttctttgtatttgctaaccaaaaggctgtctcctggcatcaccccagtgtctgtgatgttcagctgtttttccagtttctgaaatcagtgcctgtgctgtacccagccctcatctttctttccctctccatctcccatcttttatcatgagctgcctcttggactaaaggtttgaggctcgttcagtgaaccgccactgacagtttgggccttgcattgcttcggggggcacgtctgatcttcccagagtaaacattggtcattttacctggactaatgccagcacacacccgtgtctgggtggcctttctggtcattcttggaagcaggatggagccacggtttctgctggggtggatctgtaggggagcgggtttggaaagcagtgggttgcatctctaaggtggggactcctgtcattggctcaggacattgagccactatcgtggggaggagcacctgcaagtgacaggagcctcctcatccttgccctgagcagctctgaccaggactcagtcacagaaagtaagagagcattgaggagccggggcagctctgtgaactgggagtggttcagagggcttcccgagagcgggtggcatgggttgggtctagagaggcaagcaggattcggatgcatggtagtggcatgagcagaaacattaaagttgcttctgtactaattcccaggtgcttggggtagacgagttatgtgcagcctcctcgtggggaggccagagaacgggtctgtcacagggccagccctgccccgccctcctgaccctgtcccgcgcttgctccaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggtagcgcccgcccccaccctctcccctcggcacccctgcccgggctcaggcttctcaggccctgtgagaggccacctggggcaggggcaggagggcgggaggtggcagacccctctcactgggtgtgacaggaacctttggagagggccctgatctaatttccattttgaaaagctcactgtggctgccgtatgtggaatggattataccagggcaagaggagaagcagggagagcagttaggtggtcactgctgtggtctgcggtgacagtggcttgatggcctggtggggggtgggtagagagaggtgctgtggaggaagcccagacaggactccctggggattggcccggggattagggaaagggagggtcaaggccacggctttaaagttgcccacagtctggcgttatcctaaaatccctgcccttaccaaaaagtgctcccttccatgaccacagcctgagatctcacccaccagcccccacctcctttccctctaggtaactcccactggaagatggattctcagccccaccagcctgatcttcccaccttttcaagtccccttgatccagatccccagaccccccccttttccctgccacccttcttgtctttacttcctccttacccaacctggagtccaaggtccatcattaaaaccctccctggcatactccctcaagcctctggtcccttgctgctggcgtaatcccagcctgatttactccagctctctgctccacacctgtgcctgggcactggagggtatggagaggaaagacaacacgtgaggcggccatgctgctgtccccatgccgatgatgcccctgccaggaaggccctctgccctgctgggagcctcactttcctctggtctgtccactgcagcctttaaaactatctgttctcctcattcatccctcgtcctcactcatagctgacgactttgcttccaatttcagaaaacagaatgaaatggaagagaactttccccagttccctccacaactcacctgccagcctctgtgcacagggactcaaggctgttccagcttctgtccgggctgactcccaccatccccatccttcagtatttccccccaccccacagttgggcccttcctctccctctcgatcagcgttcctctcctggagcatacccatgagcacacacaccctgaagtggctcctctctcaaaggaaaaagactccctggatcccacatccctcgaggctgtcacccttctctgctttctggcagacctccttccctttctctcccctcgtctctcttgaaccccttccgctcagactcctgcacccaccatggcacagagcagctctcactgaggtcaccagccacctcctccactctgttggtccagaggccatgctgggccctcatcctgtggacctgccagcagcatcttctttcgtaaaatgcccctgcttggggcagcaccctctggtcctccctctgcactggctgggcctctgtgtctgtgggttctgctcatctccccgagctctcaccatcggggcttctctggactcggtgcttcggcagccccccttttttaactccaggtgttccttggggcatctcatgtcatctccagcattaaaccacgtctctgatgattcctgaggctgtttcctggagttctctcctaaactccaggctcaacagcccagccatctacacagtccctccacgtggtggcctcagagctactgcaagcttccatgatcacagctgaattgctggtggcctgccctgccccaaacctgtagctctgtcctcttctccatgggaatggaagctctttgctctcattgctcaagcccaaaagcccgggggtcatcctcagctgctccttctctgtcatacactgcgtcctattcgtcagcaaaatccatctagaatctgcccgcttctcgctgttgccactgccacctcctgagctaggccaccttcatcttttggtctctcacctaaatcattgccatagtctcccagctggtctccctgctttcacccctgctctgacagtctcttccagcacaacagctagggcggtcctgtccaggcataagtcacagcacgcctctaccctgctcagagcctccatggcacccatcttacccgagtcaaagccccgtccttcagtggcccttgggccttgtgcagtcactgtgtcacccccaacatccccacctctgccctcgccctgcccagctgcccgttggtctgctcctgcctcctgccgtggcagtgccatctctcctatgcagagccctaggcacccactgccctgtgggtcatctcttcaggccttcaggtttctgtcactcagttcccctggccctccctgacggccccaccgaggacaagagccacctccacccccagcaagatcgccctccttgcctgctttgcttttccccccagcacgaaccactgctggccacgctttgtgtttgcttgtttctgtttccttctattggaatctcagttccttgagaacagggcctggtttttcactgctgtacctcccgtgctttgaatggtttctggcacatagtgggtgcttagtaaatatgcgatgagtggagggactgccccacaggctgagtgaagtcagtgctgggccagagggcagcataggcaccatggggacccccgggtgggtgctgagccccaggcagtgagcccgtgtgctgcccctgcccagccttgcccaccctgcacaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctggtgaggcccggacagcctgctctgctcagagccgggagctccctccaggctgcgggtggtgggaaggatggggcagtgcctctggggcccagcagatggagccctgccctggcctagcaggagaacttgggagcagccagagtgcgaagagcaggcgagccagtcagccgcagcagcagaactgcttgcacgggggcttcagaaacctgggtggttagtggcccttaacactgaagagtgtaggggcggttcaggtgtaccttgcccacctctcagacagtgtcaccaggaccctgtttctctgtgcatctcccagctctccttccctgcactgggtttattggcaaggtggtggttgttactgcagtctgtatccatctaggccccgggctggtgggagatggggcccttcccttgtagctcaggcaggagtcccgcagtgagctgcactggctcttgattggccggcttgagtgctgagcccacccctcagccagtcactggctggtggacgggcaggcaggaagaagcacttgtggctcaggcctgggtgtcctcctctccaggccatggcaggggccagctttatgtaaatgaagcccctgagccaggtgcaagaatgggtgtctgtcatggaaccctgctacccctctcacacacacaggaagagatgagggcagggccaccaggagaaaggggaatgggggaagcagaaatcaagtaggagctggcgcttctgcccatcgacagttccccacagagatcccctctgggcagccagccgtttttgagaaggtgagcctctcacacaggttcaaggccccgtgagaacgggagagggcccgggacgcgctgcttcctgccgcccgcactgcagaagtgcaggagcctgcaagcacccggggcttattcagaggcgctgggggagaggggcactcccgagcggtaggagaccaaaggcccccccccccgggaagatgggccgagtgacgctgcttgtctctgtgtcagtgcaatgggatgtccaaccgcttctggggctggggccgcgaggacgacgagttctaccggcgcattaagggagctgggctccaggtgagattccccgggccccgccgccacctcagctgcggtggctgccctgagattttcttctgtttcctcagatgaagctcctggggtctggagatggccctgattctgatccctgccctaaccctgccctgcatggtcatctagccagttccttgccctgtgggccccagtctcctctcctgcaggctgggagtgcaggtcccttcctgtgggacctcgggagctggtggtgagggctggggctccaggaagggcagcctgaccccgacttccttggacctccctagcttttccgcccctcgggaatcacaactgggtacaagacatttcgccacctgcatgacccagcctggcggaagagggaccagaagcgcatcgcagctcaaaaacaggtgctggcagggctcctcattggggacagataggtggtcatgtggggagccagcaggcccgggctttcaccaagttctccttggcccaaatggtcccatcctcccctgcttggcccaggtcagtcgacgggcattctgcttgggcaccgtgccctgctctggtggctgctgtgggcaccctgggcactgtgggtcagcccagacctcagggtccatgcaggctggcagggtggggtggcggaggcgtagctgaaggtgccagaatcccagccacacccgggatgcagggatcccaccctcaaacagccccttctctaggaggcttatgcatccaactggagatcccggctcgcctgcttcctagtggggcacagccctgggcaagaggcttcactgctttgagctctgggttcttcctctccagtggggaccacaggacctctgatggcgaggttgtgtggggtcagtgggtagctggcacccatgcagccctgagtccgtgctctttcctctcttcctccccaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagt

SEQ ID NO: 38757 - DNA, 285669 bp, Homo sapiens
agctgcgatacgccgagcgctcaacatccgaggactttggcccagagtaaccccgctctcgtgacctttcccctccattccgcacctccgagtgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttggtgagacccgtcacccgtcccgcagggcgagtttagtctggaagatgggccgggggctgcagttggtgctcccgaggggctctgggggacttgccttgtgtcgggctctcttttggaggggtcggagtgttttggggggtcggtagggggaagggggaggtcgcaagggaaggatataccaattcctgcaagggagaaggaggaggggaattagagattgagctgtcatctgaatgcctgttgctaggaagaggatggctcccaacttttagaattaagtttaggacacttaaaaacgttaattcaaagaccagccttattttcctctggcctgccttgtgatggagaggtatttgtaggtcagcgaggctatgagaaggacctgcaatctttcctcatctagtttcccctgttttattttgcttttttttttttttttttttaatgaagaaggcatatttggccctaagtccctgtggcctcagatcttgactcagttttgagatgacaggattgtgatttgggggttttgcaagtgtttttgcaagttcacagaacagactcctgggttgagattgtgtgtggtgatttaaagggtgatgccagtctttcagtcagtgaacttggttaggacatctgactttgtgtcacctaggaccttctgttacacaactttacatacagggcaattaatagggaatatttggcagtatgtatatgtaacactgaggactattaaagatgctcttaaatgttctccgcaaaatctttttttcaataatcttatccttgatattaaagatttattattactttggccattgaagtgcattgtctcattttcttgccttacagtttgtgtcctaagaagacagatcatattttttgtatgtcttctaaaagtttcaatattcagcagatgatcaattattatttctcattgaagtaatttagatttataccctaatgttcctgaaagtgtgtcatggctgtatctgtagtacttcttgaaaagtctgattatgtatttcagagataacacaggagaaggtgatgactttgtttgaggttgcaggcacccatttcatttttattgtatagactgatgcttctcacattttcatgtatgttaggaatcctctgaggattatgttaaaatgggggttctaattcattaggtcctggtggggcctgaacctctgctttcctaacaaactcgtggtaatgctgatggtgggggctgcactttgaataataaagatctagagtagaggccagtaattgttattggagctggaaattttttccttgattttctttggcaaagattcatgtttatctgcttttccacattcactgtggccagtctatgtctcagaatttttctttttatttttggatacagggccttgttgtattgccattctggctggagtgcagtggcgcaatcacggctcactgcataaggctcagatttgtaaaaaataaaacatctacaaacattattgagctcttgatatacaactatagaaaagattgttcctgctgtgagaggattatgatataggtggaaagagagtttatgctatctacttctccctctgaaaatccatagcacttttcattcattaattcattcacttaacaaatatttgttgaatgcctgatacttgttatatcaatagcctagacaatttatggattatagtctatgatagggacattcagggtagcaatagaaacataggttctcctactccaacaaggtaggttgggggtgttcaggaaaagagttgtgttttactactatatctccaacaagattaagtacttattgaggataaattttccatctcatgtggccttgtacccttacatctgtgtatttgaaaattttggttgctactcctcggtagttgtgaaataaaattagtgggaactgaatagcattttattttatattagtgaaatggaagaaaataaaaaatgttaggacatattgcgcatactaagggtaagcattatttcatgacagttttgtttcagttatccatgtaggtatgggtggggctacttggagcatatagctgttctctttgtgagtgttggatagttgattaaatgtatacccccatgtactaagatgcaaggtggtgtggtggaaagaaattggactttaaaaagtgatcaggccaggtgcagtggctcacgcccataatcccagctctttgggaggccgaggtgtgtggatcacctgaggtcaggcgttcgagaccagccagcttgaccaacatggtgaaaccccatctctacgaaaaatataaaattagctgggcgtggtggcacatgcctgtaatcccagctactcgggaggctgaggcaggaaaatcacttgaacctgggaggtggaggttgtagtgagctgagatcatgccattgcactccagcctgggaaacaagagcaaaactccatcacaaaaaaaaaaaaaagggatcagggtatcaggatttgaatctcagctctatcatttaccagctatttgactttgtatatgttactttatctttctttttgagaattaaatgaaatcatgcattgatgatgtatcacatattttctagtttatcataggttttgaatagttacgcatatttttcttcctcccttctccggtggcacttaagagtgaagttcatggaaggtgggtagggaaggcctcttgaagtaggtggcccttgacttgtgccttgagggtaaggctatacagacatttattcatgcagtagacatttatagcatacctattcttaatggagaggagggaggataatgtaaactgaggcagaaaactaagtggttttgtaagagaagcaatgaatacattgtctataacagaacgtttgcgtacaggagttgtgagcgataacaacttacatttattatgtgcttagtcctttacgtattttatcttttttaacccttacacaaccccagcttattatccccattttataggtaagatacctgaaggttagagacattaagtgattcacaagatttagagctagtaaggaaaaagacaggattcggttctcatttttttttttttttgactgaaagactgaaggacaggctaaaggagccactgttctgtgtgcatgctattgaggtttctttttgaacaaaggggttacaagtacaaaatgatgctttcagatgctaaatctggtagcactgggaagaccggatagaaaagatttttgagaaattgatgcagcaatttcactaagtagtggaaagagtcagaactcctgtggaatctcaccctgcaatttactatcaatatgatctttagaaaaattaccgaatcgcatggagccttagtccccttgctttgcagaagatgattgtacccattttttaaggtctgttgtgaggagttaaatagggtaatagtgcattaattatgatatatgtctctatcttctgttaaaacagtggtttgtatttagactagtgtagtacctcattaaatgcttaatatatgtctaaatgagtgaaggtatgaatgaataagcatatgaatagtgcgggagtgaagacatatttggcaggtctgccagagaagatgaaagggcagttctagaggcattttgtggcagaatgaacaggacttagagaccaaggatattggggcagtatgaggacttctttatacttctaggttgtcaagtcagattgttgcagttgccattattgctagaaatggagaagttctaaagacaagctggtgtagggaccaatggagagctttccccttggccctctgaaggttcaccaaaaatcactgacaggaggccgatggattaataggagaaagggcatgtaccaatttatttaacgtgtatacacgggagccttcagaatgaagacccaaaaatacaggggaaattatctgtttttatgcttaggttcaacgaagtatagacagctatgtagaaatgtgattggacaataatggtaatagactgattggggaagcaaggtctgtctgtctagattcttcttggcctctctgtctaaattcttcttggcctctctgagcattccttcttttcttttgagtatggggcaggaccctctctggaatgggggcttatgacctacagtcaaacaaggtaggtcagatagtttctttatggccagtttttacatggaaaggcaaagggaaagttagtatgatattttaagttttatggctggctttggggaaaataggttttggtttttatgacctgccttggggaaaattctagtttctaaggctagctcaggggagagtgggactaggagacaggagagcaggagaaggtcagaaaaaaacttctgcttctaaggctgcttctgaggccttcattttgtggtattgtattctgagccccaacatgaaggaagatttttatcaagagtgttttctggagcctataaaatgggtcttatgtatctgcttttcattggaaacattatcatgtgtgttgtactaaactgatttcttcatgtcatatttactttcttgttctatacatttgccctcatgcttcttttaatcttagtatctacaactgtttagtcggtattcatcttctactgtttaaactatttcaaaatgtagatgtatgattccttttattataatagtgaatctttgtgttttcacaatttgtaaagaatatcagctctcactcatcatttatttctgtagttttgttttgtttttttttttttgagacagagtttcgctcttgttgctcaggctggagtgcagtggtgtgatctcggctcactacaacctccgcctcccaggttcaagccattctgctgcctcagcctcccgagtagctgggattacaggtatgcaccaccacgcccggctaattttgtatttttagtagagacggggtttctgcatgttggtcaggttggtttggaactcctgacctcaggtgatccacctgcctcagcctcccaaagtgctggaattacaggagtgagccactgggcccagcctatttctgtagtttttttaaaaagcagattcttacatattttgtgatatacggtaacaatgtatgcatgtaccaaaaatatattttagaattttatattgtatttcttgaatgttagttattgctacatattctaaataggtggtaccccttgctgcacacatacatatgaaacagttattaaactgttggctgggtgcggtgtctgacgcctgtaatcccagcactttgggaggctgaggcgggtggatcacgaggtcaggaaatggagaccatcctggccaacatggtgaaacccgtctctactaaaaatacaaaaattagctgggcatggtggtgtgcacctgtagtcccagctgctcgggaggctgaagcaggagaatcacttgaacctgggaggcggaggttgtactgagcagagatcacgccactgcactccagcctggcaacagagcgagactctgtctcaaaacaaacaaacaaacaaacaaaaaaaactgtttaacccctagactaccactaagattaaggaaagcataaggcccttgtttttgtggcaaatttagaatatacagttgcccacttgggagtatggattctatgctgttgagattcttaggtaccttccctaagaaggaaaacttgttcactaacctcagatggttctaacactaagacctttcttttcctagttggttttctttaggacctctagattaaggtactggcatttacctttagctgagtccaaagtagaatcttttgcatttttgggaaagaatgattttaaaacctgttttttcactgacctttagatgtttagactcttcagtggatgaacatgtttactcaatatttactccctttgaaccatgtaatccaacaaatctgttagattactaaggatcagttaatcacttctaggctctgaataaacatttaagccagagttgaaatttctaggaataaaaaacggtttatggacagtctcattggttgctaaaggcttgaaaaccactgattgaaaaaatcagttcagtgatacagactgagtgttttaaggcagtgagtgctttagcaagttttctagaggctacaagaccagcaatgagactaaaaagtttttggtaataggcatttgtttttgtttttggcttaaaaaaataaaataagaaaccctgaagtcattaaagaatgtaaactactcagaatatctgtctagattatctgagctttggagaccatggaattgtaaatgtgtgcataatccctctttgatttttgcttgagacctaacttatgggggtgtaaataaggggctcactttatctttcttttcaataactaaatgatttttacataatttcttattatctctttggagatataagtcatatggttttatttatttatttgagacagagtcttgctctgtcgcccaggctggagtgcagtggcacaatctcggctaactgcaagttccacctcctggggtcacgcccttctcctgcctcagcctgccgagtagctgggactacaggccgcgccaccacgcccagctaatttttgtatttttagtagaggtgggtttcaccgtattggccaggatggtctccatctcctgacctcgtgatccacccacctcagcctcccaaagtgctgggattacaggcgtaagccaccacgcccggccgtcatgtggtcttttttaaatgaacaattgaataatgggttttcctattcattaatgtgacgttttgagtttgttgaaggtgtttttatttttatttttttgagacggagtctggctttgttgcccaggctggagtgcggtggcgcgatctaggcttactgcaagctgcgcctcccgggttcatgcaattctcctgcctcagcctctcgagtagcttggactacaggtgcctgccaccacgcccagctaatttttttgtatttttagtagagacggggtttcactctgttagccaggatggtctcgatctcctgaccttgtgatccgcccgcctcggcctcccaaagtgctgggattacaggcgtgagccaccgcacccggctgaagttgtttttatatgtgagttcttgttattctttggctgctctctgttgagtacaaactacagcctctagcatgtcgcttccagttgagaggtaagggcttagtattgcagtaaacactttctcaactcactgttttctgtagcagctaactctgagtagagcaggccaattctgatttaccattatttgcctcttagttgtcatagatgagggataaaaatacatattggtagaaagagacccacctggaggaatgagggagtcaattctacactaataatccctctggtaacagattttccatcagattgccttcatatccaactaattagttgattttattgtgatagagattagtctgaataatcaggccttttattcattttttagaaaactatgcttgaacttttgactcttaaaaactttcttttcattatttgccaataaatattgatgaaatatatggtgaaggggagactgatatttgatgattagtttagtaatatctgaacctagactattggtattgaaatatttgtcccctatttgtttaccaagtatttattgagtctgctatttgcagggtgctgtttgtggcagctgtgtgctatgtggtatggtgaagaataaaatgaatgagacatacttcttacattgagtttatagtttaggaggggagattaggcacatatactcctgtaatgcaaattcattgagataaatgccataaggtacagataaaaataaaagtaaagtagtatatataactattagattaacagtgtaactcaggccgggcatggtggctcatgcctgtaataccagcattttgggaggctgaggcgggaggatcacttgaggtcaggagttcgagaccagcctggtcaaatgctgaaacccctcccctactaaaaatacaaaaattagccagcgtggtggtgggcatctgtaatcccagctacttgggagactgaggcaggagaatcgcttgcagcgagtggagatctcagctccccagcctgggagacggagcgagactgtgtctcaaaaaacaaacaaacaaacaaataaacaaacaacaaaacaaacccagtaactcagttttaaagatgtaagttcgaaggatcaaataaagctgtaagattttaagccttgcttattaggatatgtagaagttagtgctgtggaaaaaatattttcagtgaaacatactggcttgctttgggacatactgagttttaattaccagtgcggtatgtaagtggagaatgaccatgagacattgagaaatgcaggggtagagagaaactgaggctagagatttaggtttatatgtcctaatcctagagatgaaagttgagcccatgattatgggttaggtcgacgagggagagagtttagaaagagaagacaacctagggaatgcttatatttggagcagaggaaaagaaagaagcagacagagctgtatgaagagattgaggtggtagtgttactgagtcttgaagtaaaggagttttgagaggtattgtaagagatgggaagagcatggacttgaatctcagtcctgccacttactggcattgtgaccttgagcaaggttcttaacatttgtgaacctcagtgtcctcatctataaaatgaggataaaatacctatctattatcctttaaaaatgcaagtcagcttttgttattcctctgcccataactctccagggactttccaatgcaatacaatgtgaaatcctcaccatggccttcagagccttatgtggtctatctgttgcttgtttaattacatttcatgcgattttcccctttgcttttccacctcgatctagatgtaatcacacaatttatttaatattttgaatctatgttttatgtaatttacaacagagagctcttgattttctggggaatatcttaaattgtacaacagccagattgttaaaaaaaaagtgtattttgggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcaccgtgcgcgagccgaagcagggcgaggcactgcctcacctgggaagcgcaaggggtcagggagttccctttccgagtcaaagaaaggggtgatggacgcacctggaaaatcgggtcactcccaccgaatattgcgcttttcagaccggcttaaaaaacggcgcaccacgagactatatcccacacctggctcagagggtcctacacccacggaatctcgctgattgctagcacagcagtctgagatcaaactgcaaggcggcaacgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagtcaaacaaaaagacagcagtaacctctgcagacttaagtgtccctgtctgacagctttgaagagagcagtggttctcccagcacgcagctggagatctgagaatgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaactaacaaccagaaaggacatctacaccgaaaacctatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacatctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcaggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccactgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacatgcagagacacacataggctcaaaataaaaggatggtggaagatctaccaagcaaatggaaaacaaaaaaaggcaggggttgcaatcctaatctctgataaaacagactttaaaccaacaaagatcaaaagagacaaagaaggccattacataatggtaaagggatcaattcaacaagagaagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctgcagaactctccaccccaaatcaacacaatatacatttttttgagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacacattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagaagaatcaaatagacacaataaaaaatgataaaggggatatcaccaccgatcccacagaaatacaaactaccatcagagaatactacaaacacctctacgcaaataaactagaaaatctagaagaaatggatacattcctccacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtattccagcatataaacagagccaaagacaaaaaccacatgattatctcaatagatgcagaaaaaacctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgtcctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacatcaacaacagacagagagccaaatcataagtgaactcccattcacaattgcttcaaagagaataaaatacctaggaatccaacttacaagggacgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagatatcatctcacaccagttagaatggcaatcattaaaaagtcaggaaacaacaggtgctggaaaggatgtggagaaataggaacacttttacactgttggtgggactgtaaactagttcaaccattgtggaagtcagtgtggcgattcctcagggatctagaactagaaataccatttgacccagccattccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaacgaaacaccgcatattctcactcaaagctgggaattgaacaatgagatcacatggacacaggaaggggaatatcacactctggggactgtggtggggtcgggggaggggggagggatagcaaaaaaaaaaaaaaagtgtatttttatggaatacataaaaggtaactcttgtgagttatgactttgagaaaaaaattcgtgcctcaatttgtgcataagcaatatatatatatatatggatactttttttattgattatgaaaagatgatgtggattgaaaggctggaatgcagacttatgttgtataaatctatctgtataagctttggaagtgaaaaatgtggtaagaccttgacaatagattgatcgtttatttattatcatattagttattgagtacttacttaggtggtaggcaggtggtaggtggtaattagggaaggggagttgaagtgatggcttaacaaagaactaaataaaatattttgaagaaagtctttttaaaatgtcagtacaatttcttacattacagttacttcccttacttttatagtatagtgaatgtgaaatatgttttcatccccaaggacttaaactgggcacatagaatgcctaatagtggttgatgctttgatgattaatggtcttataatacttcagatttattattcttccattatcgtaatatatacataatatagtactgtattaaagacttaatttgaatctctgttgaccgcaggttaaacttttaaattgccttttaattactcactaatcttagttttctttctactcattgatatgctcttaatgttgtgattgagatttgtgtattttttccttcaggtaataggatatgaatctgttttatctttggatactaggaatatagttaataagtatttgttagtgagcctgaataattaatgagtcaagttagtatggtgaattgttcttacatatcatatgtgaggctctgtcttcctcataattatacttgaggggaatcaataactgaaataaattaaagaagattttaactaacttggctcatagcagtattgaaaaatatttagtggcggggcaggttggcttacacctgtaatcccagcactttgggaggccaaggtgggcagatcacctgaggtcaggagttcgagaccagcctggccaacatggtgaaaccccatcttcactaaaaatacaaaaattagctgggcatggtggcgtgtgcctgtaatcccagctactggggaggctgaggcaagagaatcactggagcccggaggcagaggttgcgatgagcctagattgcgccactggactccagcctggcaacagagtgagactctgtctcaaaaaagaaaaaaagaaaaaaagaaaaatatttagtaaaatggaccttaaataatttatatgtgaaagaaaagtattaaggaagagtgctaaatcaagtatcatcagatttgagcaagttccttttataagaatgctgaattttttcaacttactgtcatttattttgtatagccctttgactcattagatttgtcaggttgctttggtttcttgattcttacttgatcttgggggtttggattgtgattaatccactttgggagtttccttgaaagattctgcacctattgccagtgatgaaggaaggcttattctgattagattcgatttttaaaccttgaaagaaatacacatgggacaattttttttttcagacccgtatgtcagaaactctcaagcacaggaggcactgaattaaccagaaacagccaaatttctgtgtgcccctggctgcatttggagtgtagtataactgtatttactctgaatcttcatttcctttcactgtctcttatctacccttatttcattaatcaaatattacatgttacctacaatgagtaagaaatactggagtgaggggaacgtggaggttaacaatgaagggggaaggtaaactttaaataaatacgaaattatctgtggtaagtgctattaagaagacgttcagaatgttactaggctgtttacaagaggatccattctagtgtagagggtttgggaagcctttcctaaggaagtgacatggtgattatatgaatatatatgaaatgcacatatattaggtttaacatttatggcacaaaaaacaaattttaacgtgacaaatcaagagaaataagaagcaattactttatagaaaaatagtttatttgacaatttcacaaatccaataccctggtcaagaatttggcctttacttacctgaaagtcaaaggcagtaagaaaagttaactgcctacaaacacctcgattaacagatgctctgaaactgaaacttccttctagtaaaatctatgttttaaattatagtagtcagaaattttcaattacaaatgttagaaaaactattttgaataacttctatttgtcttcctccatttaaaggtaagttgggatttttttcgacaaaattgtgaagtctgagaagttaagcatcttttttttttttttgagatggagtttcgctcttgttgcctaggctggagtgcaatagcacgatctcggctcacgccaacctccgcctcctaggttcaagtgagtctcctgcctcagcctcctgtgtagctgggactacaagtatgcgccaccatgcttggctaattttgtatttttagtagagttggggtttcaccatgttggtcaggctggtctcgaacttctgacctcaagtgatccacccgcctctgttacaggaaagggatcctgatttagactccaagagagggttcttggattttgcgcaagaaagaattcagggcaagtccgcagcgcaaagcaaaagcaagtttattaagaaagtaaagtggtgaaaggacagttactccatagacagagtaggatgttcctcaaagtcagaaggggaacgcgtccaccctaggtacaatgcttgtatatagggggaggtgtgctctgctacaagggtttgtgttgtggtaaaggattaattttcttaattgctatattttgcaagaattgataaagcaaaattaggaatgcctttgttcttcagatattgggatatctggccactaccaagtctgggtctgttttagtaaacgttattaatttgttcctttaaccgtaaacatccagaggctaggaatgcctaattttctgagaatgcagcccagcaggtctcagcctcattttcctagccctcactcaaaatggagcctctctggcttgaacacctctaacacctctgcctcccaaagagctgggattacaggtgtgagccacggcacctggccaagcatctttttaaagctttctttttctgtgctcttttctctttttcccatggttaaatttcatgattagatttcctttctggttcaggtaggtggttaggattaccctatcaaagattagtaaaggattttatgtccatcaaatggttgacagactaattattagactttaatattaatgtgttgaagtgcagtttaaaccttttaacattggctttatcttctttttagtggaatttatgtatcaacaaatagtgaggcagttgttattttttagtcaagtagttactgttatctgtgatttcttctctttctcaaatcatccttcctgggcttgaactcttagtgttcatgagttctgtttaaaggattcaattcattacccaatattcacccaatttgtcacccagtattcttattggagagactggaacaaatatgtatactttctattttttatctgaatattgttgttcaattagaaatatattagttttttccaattaattaaagtatttcacattagagtccatgatatttgtacttaagtatgcagaagatggcagggtatgaaagagtgttttggtttaaagttgtagtgctgcctgggagttccatcactaaaagttgaagtgacaggtgtgtgttttcaagactttccctatattacaaaaatattggtattactcagttttgaacatgggtataatatacgcaggactcagtctgagtcttgttcctgatcacattttgtttcagtattgtaacttaagtatatttttatttttatcttgaaagcctatctcaacttttatataaaaatttgaaaatgtaggagaggaaggctattacaggtaaggtatgtaaggcttaatggtcatcgctaaagtttgaatggtatgattttcattacagggaggctttacagtatcatcattacggaaaacttttgaagattgcttgtatcttcccacatatattattaacaagttgccctagttttttggctttcttgttttgtttttaataagctgattcttgtatctgttgggggcagcatggtgtaatgcactggttgtgagttacaagatctgagtttttgttttgctttgcgatttatgatgcgatttcttcatttataagtagaagagaatcttgccttaacttcgtggcttgctgtgggaatcatatgagatagtgcacatataaaagctttaaaaactgtaagaagataggtaaatattggtctataatacttggtttcttgttattttgtttgagatatttatatttggcttttgtagcttatgattctaaccttaaaaataaagacgttggaagcaattcagatttagcttattagagttcttcaaagaaacagaagcctctgtgtgtgtgtgtgtgtgtgtttgtgtgtgtgtataaaataaggaattggctcacaattttggaggcttaataaatgccaagatctgcagttggcatgctggagacccagagagccaatgtgtaattccagtgtgagtccaaaggcctgagtactagaagaggacaatggtgtaagttccagtctggaagccagcaggctgtagacccaagaagaactggtgtttcagtcaggtctgaaggcaggaaaataccagtgtcctagctcaagaaatcaggcaggaggagtttgttgttttgttctcttcaggtcttcaactgagaggatgaagcctactcacattaggaaggacaatctttttctcagtctactgattcaaatgttaatctcacctagaagcaccctcatagacatacccagaatatcatttgaccaaatgtctaggcattccttggcccagttagattgatacataaaattaaacatggtatacagaaaaatttgtttgttacaacaaataattctgcctcctttattattattattattatttttttgacagtcttgctctgtcactcaggctggagtgcagtggcgtgatcttggcttgctgcaacctctgtctcctgggttcaagtgattctgctgcctcagcctcctgagttgctagaattacaggcgtgtgccaccacactccactaattttttgtatttttagtagagactgggtttcgctatgttggccagactggtcttgaacttctggtctcaagtgatccacccgccttggcctatgataaattgttttttaaaaacaaggtcttattttattttattttatttttgacagagtcttgctctcttgccgaggctggagtgcagtggcgcgatctcagctcactgcaagccccacctcctgggttcatgccattgtcctgcctcagcctcccgagtagctgggactacaggcgcccaccaccatgcccggctaatttttttgtatttttagtagagacggggtttcatcatgttagccaggatggtctccatctcctgacctcatgatctgcctgcctcaccctcccaaagtgctgggattacaggcatgagaacaaggtcttatttttaattttaattttaatttaatttttttgtttgtttgagacagagtctcgctctgtcacccaggctggagtacagtggtgcaatcttggctcactgcaacctccacctcctgggttcaagcaattctcctgcctcagcctcccaagtagctgggattacaggcacccaccatcatgactggctaatttttgtatttttgtggagacggggcttcaccatgttgggcaggctggtcttgaactcctgacctcaggcgatccacctgcctcggcctcccaaagtgctgacgtcagccaccgcgcccagccgaaaaatttttagaaaaaaaatacaggaggtcttttgattatggatgaatatcctactttagttctgttgtttgaagttctttttttttttttttgagatggagtctcgctctgttgcccaggctgaagtgcaatggcgtgatctcggttcactgcaatctctgcctcccagattcaagcgattctcctgtgattctcctgcctcagcctcacaagtagctgggattacaggcgtgtgctaccacgcctggctaatttttgtatttttagtagagacaaggttttgccatgttggctgagctggtctcgaactcctgacctgtagtgatccactcgcctcagcctcccaaagttctgggattacaggcatgagctaccacacctggcctttcccagatactctgattaccagagaggaaatctcttcttaacacttaataaaacaaaactgcacaacacaagaaggaattggggttgaatcaggaagcaattctgcagagtgaaggaaactagcattttcaaaatgcctactatgtgctagttactctgctaaatactttatatttgttatcttatttataaaaagtacttattaacagatcttggggccgggcgtggtggctcacgcctgtaattccagcactttgtgaggccaaagcagacagatcacgaggtcaggagttcgagaccagcctgcataaaatggtgaaaatctgtctctactaaaaatacaaaaattagctgggtgcagtggcacatgcctgtggtctcagctgcttgggaggctgaggcaggagaatcgcttgaaccgggaggtgtaggttgctgtgggcggagatcgcgccactgcactccagccttggcaacagagcatgactctgaataaaaaaaaagaaagaaaaaaagtaaatcttatagatcttggacaaggaagagggtaaagttaattgcacagctggttgttgtccagtctctgctattggaattaattctttttatttgctaatttagtgttgtgaatgttgtttttccatcttctttcctctttatttttttgtagactggaactgtagtttctagcccctgagtcatcatgggtgccttatttagtctttctgcaggttagatcaccaaatttttgaagagtcaggttatttttatatcttagttgtagtttccctatgtttttgtgtttttctctgagaataggcaacttgatcttctgtaggagctagtaagtcacaggtttaaatttataacatgcagtatggataagtgataattctccttatttagaatgtgttttgacttcaacatcaattggtagttaagagccacttgcctgacttcaatccctgctctgcctgtatcagtcaccttgagtaacttcgtctctctgtactttttcttttttctttcctttttttttttttgagacggagtctcgctctgtcacccaggctggattgcagtggcgtgatctcggctcactgcaaactctgccttccggggtcatgccattctcctgcctcagcctcctgagtagctgggagtacaggtgcccaccaccacgcctggctaattttttgtatttttagtagagacggggtttcactgtgttagccggggtggtctcaatctcctgacctcgtgatctgcccgcctcggcctcccaaagtgctgggattacaggtgtgagccaccgcacccggcctgtcctttttcttatctctaaaatggtgataataaaatcatgcccattaaaatcatgcccaataaaatgaggagattgaaatctaaagagcatctaaacaaggatttttcatagaaatagttgtggggtaaagattgttatgaaattaaatgagttgacatttgtatggtatataggatggtgcctggcacaagtgctatataagcattttttttaaataaaataaaaattctggaactaacatattcaaaatatataaattcattatgctctttcctttaaagcagttgttcttactcaataaggggcacaatcttacctcctaggagacatttaacaatgtaggcatttttggttatcacagctggggggattctattgccatttagaaagtagagggcagggatgctgctaaacatccttcaatgcataggacagccctgcacaacagatgatctggcccaaaatgtcaatagtgccaaggctgagaaactctactttaaagaaatcattttttgctagagattactttaagaaagattaaatagatacaacataaaattgactcttatttgcaaactatttaattttccaaagaaactagatttctcacactatcaccctttagaaatgtattcttctagaagagtttaatgatcaaactcggaggctcacagtaactactaatttagagtttggtactagtaaggctaagatcatgggtctttgaggccaattagctttattccatggccgtaaagtgcaatcccaatacagtcaaccatctctatggcaaatgtgcagcactaatcacatggggaaagaaacgggaataacaagagaatgtatatagtgctgatggatgtttaatagtgataatcttatgaagagatacttctaaattgggggcctgaccttataattttgtatcactcttcagtctgtgcccatcgtattagtcaggttggtctccatacttgcgtttaatcaactctgcttattgctgcctgtcttttgactcatgcctggaatatttgtgaagatattaacttatgtttgcttctgggtactttttttttcttgagacaaagtctcactctgttgcctaggctggagtacggtggcacaatctcggctcactgcagcctccaccttctgggttcaagcaattctcctgcctcagcctcctgagtagctgggattacagggacacaccaccacgcctggctaatttttgtatttttagtagagatggtatttcatcatgttggtcaggctggtctcgaactcctgatctcgtgatccgcccacctcggcctcccatagtgctgggattacaggcgtgatccactgcatctagcccctttttctgggcactttattgttttataattttcaaatttaggtacatgatttatttcaaattactttttgtgtatagtttcaggtaggggtcaaagaacatttccccccaagcccccccccccccccgcatagatgtccaattcttctaatatcatttatttatttatttatttttgagatggagtctcactctgtcgcccaggttggagtgccatggtgtgatctcagctcactgcaacctccacctcctcgagttcaagcgattctcctgcctcagcctcctgagtagctgggattacaggcgcctgccactgtgcccggctaatttttgtatttttagtatagatgggatttcaccatcttggccaggctggtcttgaactcctgaccttgtgatccatctgcctcggcctcccaaagtgctgggatataagcgtgagccactgcactcggcccatttatttttaaaaaaattacataattttagaagtagaaaaaatgaacagttttgttatttaatttaacctctttatttagtaaatgaggagattgaaatctaaacagcacgtttctaaacaaggatttttcatagaaataattgtggggttaagattaaaaataaaatctgttaattgtattgtattatgctgattgtttccactccctgttgagatttgtttctatgataattaatccttatttctcacacttgttctccttgccccaatattataaattgtaacatatatttattgtagaaagtctggaacgtatccaaaagtgaaaagaagaaaattaaaataatctattatcaaccatttagagataatcagtgtataacattctagtatttgttctgtatgttcattacaaattattttttggtaatctgtcttttcactttatatattttgattcattttcctagggcatgaaatagtcttctaaaaccaggtcatgtaaatacataaatacagatatgtattttaaccatagtggtatgatgtgcctttttttagctaaatctttatatgcatgtttgaaaaattcataagaaattaatgaatgtggaattatttggtcaaagcatatgaacattacgaagtctttgattataaaatgtgatgtttctgaaggtatctgatatctgatgattttatacatgagtgcaagtgctattgtaattactacatggctaacacaattattggtatgttatttgtttagattagtgcttcctaacctttttcatgctgtagtgtgctgtggtttacatagaaaatgataaaaatacgtggcacactggggaaaacagaggcagtggtcaccctgccctgttaccttgtgtctggcctggctaactagactactgagaggatcattattttagccacttgtaaaccttggttagaagctctgggttacagcacagtgatgataaggtcctaggttattttctgtgtcttgtgttagatatttcctgtttctcacaatagactgtacagtttggtctatcaatatggtaaatatgtacaatttatgtactttactgttaatggacatttaggtggttacagtatttgtaatgacagataatgctataaatatgtcttttggcggacataagcacttatttcttttgagtaaaatacccgggaatggaattgctgagttatggggtagacatttaattatgtctgggttatggggtacacatttaattagatgctatccaacggttttccaaggggaccacaattttatattgtcatgagcaatatatgagaactaatcctaaagctgtgtgagaattgtagttgctctacattcccaccagcactttatattatcagttcttggcattttagccattctaatgtgtgtgtggtggtatttctctgatgactaatggtgctggtagccttttatatgcctattggtcatgcgaatgactcctttttttttttttttacacaaagtattgaacttttaattttgagataattgtagattcacatgcagttgtaagaagtacagttcttcaagagattcagttaactctttatccagtttctcccaattgtttcatcttgcaaagtagtagtataatatcacaacaaaaatactgccattgatacagtcaaaatacagaacatttccatcaccagaaggatccctaatgttgccttttatagctatactcacttcttttccacttacccactcccccttaatccctggcaaccactaagttattcatttctataattttgtcattttaagaatgttatagaggccaggcacggtggctcacgcctgtaatcccagcactttgggaggccgaggtgggcggatcgcctgagatcaggagttcgagaccagcctgaccaacatggcgaagccccatctttactaaaaatacaaaaaattagctgggcgtggtggccggcgcctgtaatccctgctacttgggagattgaggcagggagaattgcttgaatctgggaggtggagattgcagtgagttgagatcatgccattgcactccagcctgggcaacagagcgagactttgtctcaaaaaagaaacccaaaaaaacaatattctagaaatggaatcatacagtatgtagctttaggattagctttttttttttccccccactcagtataattctgtggaaattcatcaaggttgtttcatatatgctttttattgttcatttttattgctgaatagcatttcatgtcatggctatatcacaatttgttaaaccatttactttttgaagggcatcggggttgtttctggtttttgacgattgcagacaaacctgctataaacattccttcacaggtttttgtataagcatatgtttttatttctcagagataaataccccaggactacaattgctgggacaaataatagttgattgtttaatttttcaaaaaactgctaagctgttttccagaattgctataccatttcatatttccaccagtaatgcatgagtgatccagtttttctgaatccttccaacatttgatgttgtcactgttttttattttagccattctgatagttgtaacacctcattgtggctttaactagcattttcctgatggctaatgtgcttatttgctgtctgtttatcctcttctgtgaaatgtctggtcatatattttcctattttctaattgggttgtttgctttttattgttgagttttgggacttctttatgtattctagatactagttccgtattagatatgtgatttctaagtattttcttctcttctggagcttgcctttttaaatttcccaacaggtctttaatagagaaaaagtttgaattttgatgaagttcagtttatcaattttctcttttgtgagttgtgcttttgatgtcaagtctaagaatgcattgtctagccttgtatccataagatttgctccattttttccccctagaaattttgtagttttatgtttcacatttgtgcctgtgatccattttaaattaatttttgcataaagtgtgagacttaggttgaggtttagtttttcttttcttttaacctatcatttaccacactggcatattatagcttactgctgttgtttgtgtctatttccctacggagattttatgttccttgaaggaaaagattgggtcttattcatcattgttttgcctgtgtatgagagttgaatcgaagtaatagatggtcagtttcagaggcttgaagagggagggagtaacagaagaattgagaagatgccattagatttgttgatcactgactttcggaaaagtattatctctagaaagatggagaataaatggagagttttatagtctttctgttctgaagttagtttttctctttcttacaccctcttactccttccctattatgttctaacctttttggttatgttgtttcattatgatggagaagtactcttttctacgactagtgaggagtctattattcttcccagttcagctcatatcccgttctccatgaaattcctgccttcccctgtattaaactgactctgctaaaattctgtggtactttctattatattactaacacttaatcagtcctcagtatctatatatcttgcacatattatgatttatattgctttatttcctggaacgttaatagtctgctcaataaatacttagatttcatgtctatccatataattgctaaattatttcagggccttttttggttttaatctagaaatcttcctttcatattcagagttcaccaaaaaaaaaaaaaaaaaaaggttttcaatctaaatttaaaagctaagtcatgaagactgataggttgatattttttataaaacagtcctatgataaacttctgcagtcttttgtattgggacttattcgtgtttctgtgttctggtcacaggtgatacatacttgtgttgttactagattctttcttttttttttttttttgagacagagtctcactctgttgccaggctagagtgcagtggcacaatctgggctcactgcaacctccgcctcccgggttcaagcaattctcctgcctcagcctcccaagtagctgggactacaggcgcccaccaccacgcccgtctcattttttgtatttttaggagagacaaggtttcaccatgttggccagaatggtcttgaactccagaccttgtgatctgcccacctcggcctcccaaagtactgggattacaggtgtgagccaccgcgcccggcctagattcttaatattattttttcaggtctttttttttttaatgggctccaggaggccagaaatcattattttttaaatttactaaatatatatatatatacacacactatgtatatatatagtaatatactatatatatgtagtatatatatatttttttttcttgccacacagaagtcaagtttgaataactgaatgaatttctctggtttctattagtgaagttctctaatagtaatagcctgataaaatctgtaatatagttttattataccatccagtttttatttgaaatggaatttttttcatttaaaaatatattccatttttcagtttaaaattgttttaaggcattacaaatatttacctcaatgtatggagattattcaacgtatgacccatatcgtaattccttggtgtatattttaccctcaataaattcaggtgtcttcctttctatcctgaacattgtatttttatagaagatccagtgaaatgccagcatttttactttaacttataaatatatgcttttatacagtagcttccacatataagctaatttaagtgggaaatgttggttggattaaacaaaaaatcctttctctttccagattgcagcaattctccggaaacggaaattagactattatttacacaaactactccctgagatcctacaatccgcttcatttctaactgctaatggggccttgtatatggctttcttttgcattttaaggttggtactcataatcaccatagatactaatataggttcttctattgaaatggaaacaagtatgtgtttacataaatgttatgtgggttactatccccgccccccctttttttaatctgtgaagtgacatttatgtcaatgaaagcttgtaaaaccaggaactgtgggcctcttgacgtcaagatgtaatataaactttaaattattggtgtaattatatagcataaatactttaagatgttatacatattctgaggcctgttatatttaccaagttgttgaataggatttcttagcttttcagtttcatagatcaggaattcaaagcaactgtctatgacatgggttagggccacatgcagtgaacaaacttcaaaaggactataacatacacatttttatttgtaaaacagtaagttaactcctggtatattctgtttttggaacttttggtcctgattcagtcttatatatattacctgtgctacatctttatacattgtagagatgcagatagaattcagtcttttgagtgctcttacttatctgacatatttattagctattctttttatttttttcctgttgattgctgaaaactcaaacttacgtttatttatttatttattttttaaaatactttctgttagtgttgaacaaagtagttgtgcaggtatattttaactgcaattaaaagtataatttctgaccgggcgcggtggctcacgcctgtaatcccagcactttgggaggccgaggcgggtggatcacaaggtcaggagatcgaggccatcctggctaacatggtgaaaccccgtctctactaaaaagtacaaaaaattagccgggcgtggtggtgggcgcctgtagtcgcagctactcgggaggctgagccaggagaatggcataaacccgggaggcggagcttgcagtgagccgagatcgcgccattgcactccagcttgggggacagagtcagactgtctcaaaaaaaaaaaaaaaaagtgtaatttccaaatgtctttcacagatttttccctaagatcattatcagatcattaatatttataaacttttagattatgcagaaaataattgataaggcttttatactattgaacaaatcatgcctttaaattgacatgaaaatctatgtaaggaactctctttatcatgtgctctctagaaagtttctatgacggccgggcgcggtggctcacgcctgtaatcctagcactttggatcacgagatcaggagatggagaccatcctggctaacacagtgaaaccccgtctctactaaaaatacaaaaaattagccgggcgtggtggcatgcgcctgtagtcccatctacttgggaggctgaggcaggagaattgcttgaacccgggaggcggaggttgcagtgagccgagattgcaccatgcattccagcctgggtgacagagtaagactccgtctcaaaaaaaaaaaaaaaaaaaaaaaagaagaagaaagtttctatgattaggtttttaaaaaaattgcagttaagtataccttgctattgcagcatctttatgttctatgaacctgtttggttaagttgtagaagcatgtatcctgaagatactaggagaccataagaactcatgaggtggttgagggtcagggtggaattgaaaatgtcacttacattttgttcctaattgggtagatgagatgctgttacttgaggtagggaactcagaagtaaaagcacatttgagaaatacagtgaaatctgctttggacatgttgctttttatggtgcctatggacatctacgttaacgtgtccaatagacatttgaaatttgaacttagaatatatttaaggtaacattcatgttctccctataactgattcactaagtccatttttcttaagattttacattcaataacttaagtcctttatggattttatattggagtcttcacaggtggaaggtttctgatgtccatgtcaaaaaatacccaagttacatgtcctcaatagcttttctaatctttttgaatctgagcttcagtttaagaaattatttcaggccaggtacggtggctcacacctgttatctcagcactttgggaggccaagatgggaggattgcttgaggctgtcagttcgaggccagcttgggcaacatggtgagactctgcctgttaaaaaaaaaaaaaaaattaaccaggcatggtagtgtgcccgtagtcccagctaacttgggaggctgaggccaggaggatcccttgaacccaggaatttcgggctacagtgaaccatgattgtagcactgcatgccagcctggtgacagggcaagaccttgtctctaaaaaaagaaaaagctttattcttatatatatctatctatataattttcataatgtataatttagcaatttaccaactttgttcagataatttcttataatttttacttgctacttctccctttcttaggaacatatgttttcaaggaaaaaaaacttcctcatgtctccaaatatttttttttctcttaaaaaacctgcgttggctcacgcctgtaatcccagcactttggggggccgaggcagatggatcatgaggtcaggagttcgagaccagcctgaccaacatggtctctactaaaaatacaaaaaattagccgggcgtggtggcaagcgcctgtaatcccagctactcgggaggggctgaagtaggagaatcgcttgaacccaggaggcagaggttgcagtgagccgagactgcaccactgcactccagcctgggcaacagagcaagactccatctaaaaacaacaacaacaacaaaaaaccaaaccaaaaacgaaacccagacagctactggtcatttgtcatttgtcatttatgaggcactgtgaggattcctactttcaaggaatatactctagtacatgaaaaatgatgtacacataaaactaaaacgtataaaatactttagtaaatgctgtaagaaaaagttatcaagggttgtggaagcaaagaagggaaaacatttattgaatgtctaccatgtgttgaaaaaatagtcataataatagtgataacagctaacactttctgagtacttgttatgtgtcctgcctggctctgggaaatatctcatatagttctcttaatggctctatgagataggtaatattatcctcatttgataaataaaggaaactgagaagccagagggtttgcatagccagcaggtttggatccagggaatgcctgaatgaatgtggccggctgttactgaaaggagtgttacccattagttgttactgtagccgccttaatgagagttagtgagagacttaactaaggcaggggcagtaggttggagaggaatttgaaagataaattgcatctgtaataatttaagggaataatttaatatgtggggtaagggaaacaaagttgaggatgacgcctgtcaaacataagtggataggtggttgttgatgctattaacctaggaaaatagaggagagagaacaagttcatggggctaggggagacagataatgagtttgattttgaatatgtttattttgaggtagtgtggtacatttaaatagagtatggatggagaagggaaacttctattcataataactgaagtgaccaactaggaatttcatacaaaaattccaaatttgaatttcaggaagatacttggaaaattctactcatggactcctggctttggtgccgctctgccagcatcttatgtggccattctcattgaaagaaaaagcaggtaaaatttcatatatttatttaacggaactgattacctgtcccctaccccaactataatttttttttttttaattatcacttacagggatgagaaatatttctagatatattttttcggttctgcagatatttaattgaaaattaattttatattaatgtttatatgtattttatatttattgtctataaaaatataaaagtggacattatagagcagtaatagcctctgtttactaaaagattagagagttctataatgtgacctaactaaaatatggctatgcaaattctaggccaggcagctcattcctgtaatcccagcaccttgggaggctgaggcgggtggctcacttgagccttggaatttgagaccagcctggccagcattggaaaaccctgtctctacgaaaaaaaatacaaagaatattagctggatgtgatgatgtactcttgtagtccctgctactcaggaagctgaggtgggaggatcacccgagtccccagaggtcaaggctacagtgagccgtgatcatgccaccacacttcagtctgggcaacagagtgagactcctgtctcaaaaaacaagcaaataaacaaacaaattataatcaaagattttttccatagccataatagcatttcacacttaagaaaattaacaatagttttttattatcatctagatctgtacttcgcttactttgcttcaggctctttgagtaattgagtaattgatctcaaatcaattattattattattactaatttatttatttttctgagccagagtcttgctctgttgcgcaggctggagtgcagtggtgcgacctcgacccactgcaacctccgcctcccgagttcaagcaattctcctatcttagcctcccgagtagctgggattacaggcgcatgccaccatgcccggctagtttttgtgtttttttagtagagacaaggtttcaccatgttggccaggctggtctcaaactcctgaccttgtgatccgcccgccttggcctcccaaagtgctagtattacaggtgtgagccactgtgcctggcccaattatttttaagacatcttgtatttaaaaaaaattttttattgttatcagcctgaaattttccatgtgaataaatatgatttctataaaatgttgcaaacttacataaactgttcagtcaggtaaacagttaaagtttaaaggttttgccataagaaaatacttgccatctcatgaataattgtttttattgctgaggaatttatccacctttgtcccagataaatcaagaaaggatcatgtactgaaaccacttatgaagatgcttattgtagtcattggccctctggtaagagtgtgagtaattctcatcaaataaccaaatattaaactactggaagccactcttacttatttatttatttatttttttgaggtggagtctcactccgtctctaggctggagtgcagttgtgcgatctcagctcactgaaacctcctactccctggttaagcaattctcttgcttcagcctcccaagtagctgggactacaggcacgtgccaccacgcccagctaatttttgtatttttagtagagacggggtttcactttgttggccagtatggtcttgatctcctgaccttgtgatccgcccacctcggcctcccaaagtgctgggattagaggtgtgagccatcgcacccggcccatgaagccactcttaatacatttttgtaagtgtcatagtatctaaatttttgtggttctctgtttgattatatcaatgactacaatacttaaacttttggattattagaatgactaaaatcaaaggattggtgaatgttataacctcagcaaaatcaagtcagtaattccaggaacataggttactccacctgaaaagagagtacagcatgattgttgaagcatggattttggagctgtgctatctgtcttaggagcccagctctgccactgactgcgtgatattcattacttgaaaaatgaaaataatgataatctatttgtaggattgtttattttatttttttttttttgagacggagtctcgctctgttgcccaggctggagtgcaatggtgcaatctcggctcactgcaacttctgcctcccaggttcaagcgattctcctgcctcagcttcccatgtagctgggattacaggtgcctgccaccacgcctggctaatttttgtatttttagtagaaacggggtttcaccatgctagccaggttggtctcaaactcccatcctcaggagatccaccagcttcggccttccaaagtgctgggattacctgcgtgagccactgcgcccaggcttattttattttttttgggacagagtctcactccgtcacccaggctggagtatagtggcttgattttggttcactgcaacctctgcctcctgggttcaaacggttttcctgtctcagcctcccaagtagctgggaccacaggcatgaaccaccaagcctggctaatttttgtatttttagtagagatggggtttcgccatgttggccaggctggtctcgaactcccaacctcaggtgatcagcctgcctcagccccccaaagttttgggattacaggcatgagctactgggcccggcctgtcgggttgtttagataattaagtgaattaatatatgttaaaatgcttagaacagtgcctgacacatagtaagagttatatatgtgttaagtattatttttgttttttttgcctgtaagtagagttattctggtgatggtaacttcctaatcaatagaaaaactgtgtatattggttttgaaaagatatttttgaaatatgtcagttacattaaactaaagatgctttaaatcaaggtagctactatttactcttatttagcactcaaataattagatagcatttttgcagttatgtacctacttttcaacacaaactgttgaacacctttgtaacaatcaactagagtcaatggttattaacattttgccattttagtttatttgtatgtgaatatatgtgaatgtgtgttttttctatgtgtgtgagccatatggaaacatgttataaacatcatgccactttactcctgagtacttcagcacgtatctcttaaaaataaggatatttttctacagaattacaacactcttatcacacacaagacaattagcaaccattttttcataccatccagttcatattgtcctaaaatggcttttaatgctatttttttgaaccagaatctagtcaaggttgatgtgtgttgatgtatttctttcttttcctttttctaaaagtactttttcttgagatagggtcttgctttgtcacctaggctagaatgcagtgatgtgatcatagctcactgcagcctcaatctcccgggcctaagagatcctcttgccttaacaccaccctcccaccgcctccccaacccccgaccagtagctgggactacaggtgcacaccactatgctcagctaattttttattttttattttttaatttaattagtttattttttttgagacggagtctcgctctgtctcccaggctggagtgcggtggcgccatctctgttcactgcaagctccgcctcccgggttcacgccattctcttgcctcagcctgccgagtagctgggactataggtgcccgccagctaatttttttttttgtatttttagtagagacgggatttcacagtgttaaccaggatggtttcgatctccggacctcgtgatctgcccgcctcagcctcccagagtgttgggattacaggcgttcgccactgcacccggtccaattttttatttttatattaagtagctgaggtctcactgtgtagcccaggctgggccggtcctgagctcaagtgatcctcctgccttggccactgaaactgttgggattacagatgtgaaccactgcacttggcctattttcttttaatctaagatagtgtctccactttttccctctacagcattgctttattgaagtgaccaggccagttgtctcgttgtatgtaatacatttctgatttgtctgagttatttcttcatggaattggtgaattggttcaacaattgggtcccaagcccaatatcattatggtttttgctgacgtgtagaggtacgtactgccttggtggtcttgtataagatccagaagaaatctctggattaaagcagagattcttgttcttttcccttactttctcctaaataaacagggtctctctctctctctctgtgtgctgaactgcttggaactgagcatgaggtgacacaagcatccctgtggctaccatccctgggactgcgctgggtcagacttgaagctagcacagcagtgggtcttgcccaaggcttgctgtaaccattacttggctaccacttgtgttcactcaaagccctagggctctataatcaacaggtggcaaagccagccaggttttgtccttccctctgggtgacaagttctcccgggccctgggcaggtccaaagatattgtctgggagccagggataggagtaagaaaagtttgcctgatattcttttccactgtggctaaactggtgctcaaaccacaatataaagtccttcccactcttccctcccctttccacaggcagaggagcctctccatgtgggcaccaccaccaccagcccatggcaggcttctgactggccactgctgatgttcacttaaataccacaggctcttcagtcagcctgtagtaaatgctgccaggcctgggactcacccttcagggcagtaggccccccctctggcctagggtaggttcagaaatgctgtccaagagcctagacctggacttggggactccaggagcctgcttgttgctttaccccactgtgtccaagctggtacctacgtgcaagacaaagttcccttttgttttccttctgcttttctcagacagaaggagtcttttgccatagccagccacagctgggaatgtgctaggtcacatctgtagtgggcatgtctcagagcccaaggctacggcatactccttgggtatcgctcctaattattcagggtctaagggcttgttagtctgcaggtgatgaatcctgccagtactgggtgctttccttcaaggcagcaggttcccttttggcccaaggtatgtctagaaatgtcatccaggagcaaggcttggaatggatccttcatgactctgcctggtctcttctcctactgtggctgagctggtatccagtgatgacatcttatttaactgtagtataatataaaaccaggaagttgacattactgtcaactacactatagacttcattcagtattcactaattcttatgtatactcatttgtgtacatgtctatgcagtttgttcccatgtatagagttgtttacccaccactacaatcaatgtccaaaactgtttcaacactaccaaggattgcccttgaactatccctttgtagttgcaccattttcatcaattcctgtctcctggtaacaactagtctacttttcatttctatatttatatcatttcgaggaagttatataaatggaatgatgcaatgtataacgtttggacataggctttttcttttttaaactaagcatgatgcctttgagatccatctaagatgtagcttgtattactaagcttattccttttttattgcccagtagcattctactatatggatgtaccagagtttgttaaacattcacttgtcgaaggacatttatgttattttcagtttttggctgctccatccatggacatggtttatctctccatttaattagatcttttatttcttttcatcagtttttataatttgcagaatgcgtttcatatacgtgttagatttacacctgtttccctttttgggaacaattgcaaatgatttttctgtttttgtaatagctttattgagtcataattcatattccatacagttcacccttttgaaaactgcacaattcatttgtttttaatatattcacaaagttgtttaactaccatcacaaacaattttagaacactttattcacctcaaatagaaacccctttaactgtcaccccctaatccttcatcctcctcacccagccctaggcaaccactaatttctgtctctaaagatttgcttcttctggacattttatataatggagtcatacaatatgtgtcattggtgactggcttcttttacttagtgtaatggttttgaagtttgatgtcatacgtatcatttcattacattactttttattgccaaataattcattatatggatatgtcacattttatttattcataagttgatggaaatttggattgtcccacttcttggttatgaatgttgctacactaaacatttgtggacacatttttgtgtggacatatgtttttatttttctggattatgtactcaggaatggaattgctgccttaatatggcaactctgtttagctttttgaggaactgccaaactgtttaccaaagtggttgtaccattttctgttttgttcagcagtatataaagggtccaatttcttcgcattttggctatcacttgttattacatgtctttctgatgatagtcattgtagtgagtgtgaagtatttcattatggctttgatttttctcagatgactaatgatattgagcatcttttcatatagtttttgatcatttacatatcttctttggagaaatgtctattcaaatcctttgcccatgttttaattgggttatttatcttttaattattgagttgtaagggttctttagatattctagatataattttcttgccagatataatttgcaaatattttctcccattcagagtgttgttttttcacttcattgatcttgtctttgaagcagaaaagtttttaattttgatgaagaagtccaagttatctattttttctttcttttttttatttgtttgtttttttgtgacacagtcttgctctgtcgctgaggctggagtgcagtggcgtgatcttggcttttgcaacctccacctcctgggttaaagcaattcccctgcctcagcctcccaagtagctgggactgcaggtgtgtgccactacacctcgctaatttttgtatttctttttttttagtagagatagggttttgccatgttgtccaggctggtctcgagctcctgacctaaggtgatctgcctgcttccacctcccaaagtactgggattacaggcgtgagccactgtgcccagcccgttgtgtttttggtgtcgtatttaagaaatcattaccaagacgaatatttagctccaagttttattttactttattatttatttatttgtttattttttgaggtggagtcttgctctgtctcacactcactggagtgcagtggcatgatctttgctcactgcaacctccacctgcctggttcaagcaattcttctgcctcagcctcccaggtagctggaactacaggtgcatgccaccacacccagccaatttttgtatttctagtattgatggggtttcaccatgctggccaggctggtcttgaactcccgacctcaggtgatccacctgcctcggccccgcaaagtgctggaattacagatgtgagccactgcgcctggccatgttttcttttaaaagttgtatagttttagttcttacatttaagtctttcatccattttgaattaattttcgtcggtagtgtgaagtagagagtattaagttttaaatttcattttccacatttgttaatatgacatataaatatagtagatttttttgtgttttatcttgacttctgtgaccttgctgaatttattagttttaagagtttttggtacattccttgagattttctatacagacaattatgttacctgcaaatagggatggttttctttcttttccaatctgtatgtccttttttctgcttgtatcttgtatctgctcttagcgggaggcattcagtttttcatcattaagtgtattgttagctgtggggtggtttttcagatgctctttgttagggttaggacgtttacattcatttctagtttgctgtgaacctttatcatgaatggatgtaatattttgttatatggcttttctgcatctattgataagatcatatgatcttttttctttttttcttttcttttcttttttttttttttttgagacggagcctcactctgtcgcccaggctggagtgcagtggcgtgatctcggctcactgcaacctctgcctcgtgggttcaagcgattctcctgcctcagcctctcaagtagctgggactacaggtgcgtgccacctcgcctggctaatttttgtatttttagtggagacggggtttcaccatattggccaggctggtctcgaactcctgacctcgtgatctgccctcctcagcttcccaatgtgctgagattacaggcatgagccaccaggcctggctgagctttcttcttttgcctgtttgcagtgtttttttttttttttttgatatcaacaaggacaagatcattgacagtgatgtttgtctacagctggttttctcaactttggcactattgacatgttttgggccaggtaataccttactgggagggctctcttgtgcagtgtatctatacatgccattagcactgccttccccaccccaccaagttgagataaccaaaaattcctacaggcattgctacatctccccatggaacaaatctctccttgttgagaactactgatctatatctttactaattttcttagtctagttttatcatttgctgagagaaaagtgtaaaatcttcaactgtgattctggaattgtctatttctctttttaatgctatcaatttctgtgaaggttttattggtacatgcactttttttttgttaccatttcttcatgatgtcatgatgaattgaaccttttatccatatggaatgtccttctgtagctcagatattatttgttctgaagtttatttttatttgatttttttatttcttatttttttgagatagagtcacactctgttgctcctgctggagtgcagtggcatgatgtcggctcactgcaacctccacccaccgggttcaagcaactcttgtgcctcagtctcctgagtagctgggattacaggcacgtgccaccacgcctggctaattttgtatttttggtagagacggggtttcaccatgttggccaggctggtctcaaactcctgacctgaaatgatccacacgccttggcctcccgaagtgctgggattacaggcatgagccaccgcgcctggcctatttttatttgatattgatatagctactccaaccttttcatatttacagtttgcagagtgtatttctttccagttaatttcaaacatctgtgtctttataattaaagtttttttttttagcagataatatacagtggggtcttatttttttatatctattctgctagtgttagcctataaattagattatttagttcattaacatttgaggcatttattatttattggtatggctaggttgagtgagccattttattatttgttttctgcttttcatttgtctgttcctccttacttcctttgtattgtttgattttttttgttttgtttttagaattccactgtaattttttttttcgttattttcttttagtgcttgctctatagactacaatatacatctttgaagtttcttaatgttaccattttactacctctcaaaatgtggcaacctgtctaggtccatcttaggactgcttactattggatttgttttttgtttgttggtttgttttttctctttctttgaacgctaacattagttcaaatacagtaaaaccaaagtaaaagagtgttactgatattaagagcaataacttcttagggcataacgagaggtttcctggatgtaaggtgataacgtggatttgggttgctagtttattttctgttttattttcacttttgatagctgagggttttttttttttttaagctttctgtttttcttttcctgtagatgagcttttgcactagtgtttcattcttagacattggttgttcaaagaaaatttttaggtattacagattatgacctattctaaatattagctgaagtagttttattgttttaacgacttaataagaaatttaagtctagctttaacttctttataactgttatcacatggttgctgaagaaaaattgatccttcccttgatctcattgttacattattgaactctttgtgtatgtgttgatttagttcttttgtttattaggtgatgcagttaacaatactgggagatagctctgtagttctttctgttgagagttgtgtatgtctatgcatacaatcacaattcctggttggatttaattaaaaactttaatttttgttttttagtgttgttcacaagcttagtgactttaagaaaaaaatcaggttttgtattttttcttttccctttggagttaaactttaaaactctttaaatctcttgacaagttgccttacagtgtgtcttgttttaagtaaatgtgtctgtgcgtatttggaatttgcgagttactttagtagcttaatttgctctgaaaaagtattcttgacttaccacgaatttatgtaagacttcattaaatatcaagatccattaaaagcttataagtaatttgcaagagttgaagttatgcatattttaaaattattacatctagtgccaaaaatcaagcatattagtattgtagttcttgtttggtaaggaaaaagaatttataattatgcctttaattcacagagaaaatcaatgatatgctggtggaaatagccagcaggcagctggaaatgtgagtctaggttcaagggaaagatggtagttagaaaaataaaaatggaaagttttcctctaataggtggtcgttgaaactgtggaagtagattcatgtgtgaaagcccagtatgagaggaggtctaagattgaacgtttagaagcagcaacatttaaggagccagttgtcaattgaaatgtgtacagttcagtctttaaatttaatgtcagcaatatacgagaaagagtagaagaaacatattgtgatgactagcagtttctttttaaaaaatagcaaataatggtagtcctaagttttaaacctctaaagctttaatagtgcaatctttactctgagattttgcattcagttgtataatcagtttttcaaaaagtatttaatgaggtgagaacatacaatatgcacttatctctctatctggatatagatataaatacatagataaagatctatctgtaaatatcttcatctatattggtttaagtttctttcttcctcttttttccttctctctaatccattcatcaattaccccctccctttctagtagtattaagcgtgcttgcttgctagtttctgacacccagtaagagggcagcttacttaaatcttaatcgcatcattgtggggttctgagagagctttgaggttgtttccagggttgcttaaaaaatttgtgccacaaaggactctgatcatagtaactcagtaggaagcattggtaacatctagtttatctgtaggagggctgttaagaactagtcttctttttctttttctaggaagtgctttgtttgtggtttagaaagaagttgttctgatggattttgttttgtagaattgctgtggaatttgctttgatatttagtattagttaagaattgcagtgtgctcaaacatgaacatggattaaagtatcaacaattgcatatttattgcaagcatactcatttgttgaattattaaattgcactatagtacttatgaaactccaaaccaggtatgaccagaatgaatgatctatataatatgggaataaaagaatactcataaatttggtctgtaagttcttggtatcttcaagtttcattggcatgttaacttcaccagaagattaaacactttgtagccttctgtaaagtttactctttatgtactatataagatagaacatgatcatagactcttgctctagattagaaatttattctattaattcctatgcctcaaggaagtatttttataccttctaaaacattctgacagttaaaaacccattataccttgaaagattttctgagatgattaaatagcatttcttaataagccattacaatgtttaggaattttcactttcttttatttctaatatctccttatttatagaacatataattatttttatatgtatatttcatatgcatatataggatatatacatatttagaatttagaagttgcattgttcctactgtattccccagcggcctcttgtgaagtgtgatatgtagtattattcaaaactttgaggttagctaaataatatatacaccaaagcttctggaaaaaaaacccattattgattacgcatctaattagaaatgataatgctgttagatgataataatgcttagaatttcagcaggatgtgtggatactttttaatctactaagatgttacagaacatttatgttatttaatgttttcctataagaatgatgatactctgactacacagttcctgtagcagtggttctttttttttttttgagacagagtttcacttgtcatctaggctagagtacagtggtacaatcatagctcactgcagccttgatctcttgggcacaggtgatcctcctgcctcagtctccccagtagctgggaccacaggcatgtgccaccgtgaccaggtcagttttttatttttggtagagatgtgatagcacaggctatctcaaactcatgggcttaagtgatcctcctatcttggcctcacaaagtgctgggattacatgtatgaggcactgtgcctggctgcaattgttcttaatactttttttgataacacccctggaggtgcacaaagttgtatgccgcaactttgagagattgaataccttctccaaccaaaataaatagataaataaaagaagggaacaatgagaaaagcttatgtggtataaaggaatattggactgcttatctgctgagctttcccagccttctaatctagtgactctcagtagaatgggagtataggatatgggtatcagaatctcctgtgaagtttaacaagttacttattgtacttcttggccccagcttctccttttcaggcctatgccatcatctgttctaatgggcacctccccctctccatcattgtattagccatgttttaatagataacttggtttccaaagaggatttactcaccagtaagggagtggcctatttgtcttcagatttaggctaaatatagtcaaatgtaaaacaataaattggcatttaattgacttctcagtttttcgtagtgcttaacataactgaagaagtgataaattattggtctgatatagtacagttataaagttgacattggaacagaggatgaagatgttgcgtgaaagaaatcctgtcaaagagtgtggctctataatccaacatatcatacccttcagagataatattctctccgggtctgaattcagcaaaagctgttaaggaggtgatttggggaaagataaattgaaattttgagaacagaataggacttaatctaatagcaatacattctctgctttttcataatagtaacagtatgtgaaggctttagtcttcctcaaagaatagaagcctgttaggatgccatgttaaacaagcaagtgaattacagaacttaaagatgatttagggccaggtgcggtggctcatgcctgttattccagcactttgggaggccgaggagggcagattgcttgagctcaggatttcgagaccagcctggccaacatggtgaaaccttgctctacccaaaatacaaaaaattagctgggtgtggtggtgtgtgcctgtggtgctggctactcgggaggctggggtgggaggatgccttgtgcctgggaggtggaagtttcagtgagccaagattgaaccgctgcactccagcctgggtgacagagcaagactgtctcaaaaacaaacaaacaacaacaaaaaagataatttagtagtgcaaagattttctgtagaagtaatgcattggacagaacctgaaactggagtcagatgaactgactctgaattccagcttgtctttttgttacttttacctttttaaggaaaccacttcacttctctgattcttggtcttcaatagagtaaggataatggtatctgccttacacttcatggtactattgggtgggtaaaatttgatttcataatattgattataccttgtagattgttaagttttatgcaactttaaggaggtctgatcacttctttgctaataaattggtatcattaattggccctcccttgtcctagtggttatctttggtgattatatgtctataatacactttttttctgtaaggatttgttcttagaaataccttgttggctatgtctagtaattccataatcatttgtttagtgcctcgtatgccttaggtgtgaggtattgatgcaggatttttcttgtccactttgccaactggagatctccacagccagtgatgccccctgccctgcacccaggccttgcttagccccaggccttccactggaggcagcacctctacgtggcccgcctgtgttatggcttgtacccatgtttggcagtttccaggctcttgttccgtgtccaagaagaattaggatatgctgataatttgaagggtgaagagggcagagaagaattttattaagcggtggaacagctcagtggagaggagacgtgggggtggtcccccacccccacagtttggtgttttttttcctctcagtgtgcctgtgtctggggcttttatggcctcagaatagggaagtgcttgctgattggtttgtgagtatgcaaaaaagtttaaaacaaagactactcaaaggtgggcatgacagcatagaaaaccaattaggaaagggtaggtatatgtaaaataggtggagggtggggattaattggaggaaagtatgccaaacaggaaggcaagttcttaatctggtctgtggatttgacttgtagcttggctttcaggctttaaactatctttggcttggaggtaggatttcaccagggacccacccctatctgcctaggcatttgactgcctcctgctgctatcaatttccccttctgaagaggtacctctaattgccgttaggttaaggacgatgaccagtcttaactgctttctgctgatgggggtgctgttttgggaaaatggcagtcatgtctctcttagaggcctatctaagggtccccagtaaaagggagccatcatttgaggctccggttgcatgactgtttggagtttgatggcctgaaggtgagaagagacaaaccaggatattagaagacatgcatcaaaacaaaacatgggggtaagaacagctcaaaaactccgaggctgctgacatgcccagataactggtggctatagttatgtctgctaagacctgggtgcatggggcttggtttggttagcacctttggtcttattttcaaaaaaaaaaaaaaaaaccttcaggttatgggcaccccatttattctcaccacttggcaggagttgcaggataattgcccagaattagagtgttgatccagatttttacattacccatccattttctttcttcttagctgcagccagagatcactggctggttcacaggaataagcagggttagtctaaaatgcagacaaaacttaaaaacaactaatgaggtgagaatttaatgagaagtgtatgataagttttgaaacttacttctttctctccagtcctcattttgttacaaacaagtcatgataggaccgagttgtttgcagaataaacttcagtgttatactcggcttaatcatttgcatcaagtgtaccaagaataattattttcacataggcttttaaaattggctctgatggaattctattccatacggaatctcagataagactgtttttttttgagttggagttttgctcttgttacccaggcttgagtgcaatggtgcgatcttggcccactgcaacctctgcgtccttggttcaagtgattctcctgcctcagcctcccgagtagctgggattacaggcatgcaccaccacgcccagctaattttttgtatttttagtagagatggggtttcttcatgttggtcaggctggtctcgaactgccgatcccaggtgatccgccctccttggcctcctgaagtgttgggattacaggtgtgagccaccacacctggttcagatgagactttttaaagctgagcccagccatgggtttgtaccctcaaatacctgtgaattgggtaaattcctctcttcttgaggtgtcaagataacttggggctcctggacctgatagaaagtgacattctttactcaccacaagttaggaaccctgtacaggaactgtgtagacagggtatgaggccagtttccccaaggggcttttattggctctgcaagtcaagcttaattccttaagggaagcacacccttccagtcaaagccttggtaaaacaaccagtctctccagttgtgtcttgttgcaaaagaaaatggattcttattgcagtgatacaaataactatattaccctatgttaagaatactcacaaagtttccaaattctgaagaaaccaagcagaaagaaacaaatattctccaaactttgttcataggagtataccttactcaattgttgaaaactgtagatagctcaagagaaaaacttccgtgactctgaaaaataaaacaaggatcagcaatgttttaagcaaaaagttaaaaaagattacttaagttttctattagttcggtctattcagttaactcttgtcctgcttgatattcatgaacatttcagctcttcatgagtcctgaatgattttcctttattccaatgtcacaatctccaaagatattagaaacctgcatttaagagcacctgtcagagtcctgtagctgattataaaccatttttggaagaggatcaagacaactgtctgtgaatgacaaaatgtccagggtagctccagtcaaaaacacaattgtcaaagagatttgtttatttctgtggtttacaataacaacataataaccttagttatgattgagcaccagcatgatgccataagtggaaaatttcacatttaagtactgaacacaaactttgtttcatgcacaaaattactaaaaatgttatataaaattgcattaagttgtatgtatttaggttggtgcaaaagtaattgcagtttttgccaagtataaggtgtatatgaaacataaatgaattttatgtttagacttggatctcatccccaagttatttcattatgtatatgcaaatactacaaaatacaaaaaaatcaaaaattggaaacacttctagtctcaggcattttggataagggatactcagctttagctcatttcaccttgaaatgcatttgtcagcggggtacggtagcacatgcctgtaatcccagaactttggggtgccagggcaggaggatggcctaaatccagaaacttgaaccagcttggacagcatagcgagactgtgtctctacagaaaattaaaaaattagtaggcatggtagtgtgcacctactgaaacaagtagtttcagctatttgggaaactgaggcagtaagatcacttgagcccaggagtttgagactgcagtgagctatgactgtactactgcactccagcctgagtgacagaatgagatcctgtctcaaaaagaaaaagaaaaagaaaaaaaaattgtcaggctctctcacagaaagtaaagaaatatttttattttggaatttgtaacatatatgttttttcttcatatgtaaccagcttttggtaaaaatgggtatcccttgagaagcacttaacttttctttcttcagtgtatgtgggactcttggatgttaatgttaccctaatttttctcagtataacttatttagaataagcagtattagagtatttttgatttagaatttggtgggaactaatggtgagaactagtaagaacactttcaatccatatgtaaaaatcatagaaaaaaggacattaaaaaaaccttatagataatcttacaagtgattttattattattttcttttcctaacttttcagttcaggagtacatgtgtagaatgtgcaggtttctgccatgttcgtttgctgcatagatcatcctatcacctttaccagtgatttttaaaaattctttttgtaagggcaattgggttctcttgttctgctgaaatgcattaggatctgctgaggagagattcctaggagtgtatggcactgggtgtatggcactgtgggtcctatatccccttccccttttaaccagagtaggtccaatgttatattttatatattggtgataatgtaaattttttctttaataatttttatgttaaaaaaagtagatttaataagtagataactagtccctcaaatgttccctaattttaatgacaaaattacagagtcccagagtacctaactttactttagtactgttcagttaaatcatactgcctgcatgtggctttaggaatattaaaaatcttactaaaccatttaaaataatgaacattcaggactgtgtatgaatcgggcatcaagaagatttcattgataatattaatatgaagattcggcatatttaaatgaaagtgatttgacattggtactttttatatatattttattttctttgagtactgaaaatgttcataaaggaaactaaaataagtttttgtaattttcagaggtcaaactctgcccttgaattcttaaaacctattgaagacatttcctagagaatagaatgtgcttcattcatttctcatatgcagtataagctaagtaaactgattaagggcagaaaaaagttgttatgtttgactttctacctgaatttttattaaataagtttggtaaatatgcagtttttctgtaaagtgttcatagaacttttgtttgtcctttggcattagaaagttcccttagtgcctgacttttcgtttaaaatgaaattaaaaccaatgtgatttagtatgatttgtaatattatttaatgaaacaattgtattgtgtgtgaaacagatagaaggcttgttttatttattttttcataaatttttatttggtcagaattgttctttacattttggcaagatgaattagaattctttattacaaaatttagatttctctagcataaacatagactagtaggaaattataccactcttgccaataacaaataacaatggggaaatagtaattttaaatatttacttaatgacttctaagaatatttaatgaccacaaaacaagtgactttatggaatttatttagatgcagctaaatttaggtcagagagaaattagttcggcataatttacctgtttttctaagataccagtacgtttctcaatttctgagaatataattctttttatagacttctaataaatgataaagtgattactaagtcaaattgaagtttaatatcttccttttaaaattatttgcaggagagggctgctcacaatttatatggccaacttggtaagtattttgttttaacctttgatgtcttcccataagctatatctttttaaaatcaagttttcttaaaaaaagtaaaagaggaaagccacttgtatttgaggataatcttctctgtgttaatggatagaattaaatgttcaaaaaagccttgataccatctggtttgttccatcatataggattgaatttcacttattttagaaggaaatcactgtcttgtgctcttcattgccttttttaagtttacgtcttcatctctgataggctgtacttgtatgtgtatatatctgtctctttatatctctttatatatctaatttcatattctgcctctgttgtgatttcttatgggaaaaatgatataaggatgggtttttatgatgtatgttcttcttgaatataaaaacaacattggtactatctccaaacactcagtgcatttaataatataattagctaggcttccaaatttttaagtttacaaaaatgaagttaatgttatgttgtttgatattctttaaagtaaatatataatcaagtttatgtaaattttattgccaagttaatattttaaaaacatttacattaaaatcttttcaggttgtttaatagacttgataggcaacattaaaaaatttaactaggaaagattaataattatttatttacctaaggtttagttcttgaattctgtaacaagggagtatatttcagagttacatttagcaattcattttagttataaaatatttagtttttgctctgtacttttgtgtttctgtgctagatgctggtaaacaagagatagcttttgcattcatggagttttactctctagtgggagaagtcacggcagaaataataatgtatgaaaaggactgaaagatgatttatagggtcctgtggaaattatatagcagcaaactattctgggtgtgtgcggttgggtcagagaaaagtgggtgtaaccccttttgagtcatagacctctttgagaatctgatgacatatgtggacattctgtatagaaaactgctcatgtaaggaatgatacctaaatttcatttcagagtgttcatggaccaccaattaagaaagcctagggtatgccatcaagtaaatttattttaaaatactccagaaaattaggagttctaaggacttttaattgtaatgaaatggaaatttcaggacagcaggagagcaggatttctttttggcattattctccttgaaagaattcttactaggatgtaagcttttgagcttctaaatagagtctgtcatgtaatagagatttgataaatatttgttgaattaatgacaatcttgctgggtatagaattctagattgacagtgatttaaagataatcctttatctttgttctctgtggttacttttttttactttttgtagtctgttggttttactttttaggtaatctctctttttttctcaaatttttttttaagatttacttttgaagaatttatttttggcatattgggtttactaggatatagatttatttttatttagcttgatcagaactcagcttttgtagtccgagaattcatggttagttctggaattaaattcttatccatcccctctttgaatcttgcttctccccattctctatattctattgttttggaactcctttgagatacatgttaaacattgttatgtccctcttcatattttcttaatcactctttaacattttcctactttttcatctctttgtgctgaattctggttatcttttcagatttgtcttcaagttaactcatctatttacctgtttccatttattttatttattttatgtttttggtctcattgtattgcccaggctggagtacagtggtgtgatcacggctcactacagcttgaactcctgggcgcaagcaatcctcctacctcaccctcccaagtagctgggaccacaggcatgtaccacaatgtccggctatttttttttacttttatttttgtagagatgggatgttgcctacgctggtctcagactcttgggctcgagtgatccttttgccttggcctcccaaagtgctgtgattataggcaagagccactttgcccagccaatttacttgttgtttttatttattattattattttttgagatggagtctcgctctgtcacccgggctggaatgcagtggtgtgatattggctcactgcaaccactgcctcctgggttcaagtgattctcctgccttagcctcctgagtagctgggattacaggtgtgcaccatcacgcctggctaattttttctgtatttttagtagagacggggtttcaccatgttggtcagtctggtcgtgaactcctgacctcgtgatctgcctgcctcagcctcccaaagtgctgttattacaggcattagccaccacacccggccaatttacttgtttttaatgctgaacctgtccagtaaaaattcagtttgagtgatgatattttaattttaaaaagatgataaacaccagacttaacataaaatccagattttatgttaattaaatgttacgtaaatattcatctaacatacctccacagtacttttttccttcatatattggttataaactccattcatttcttcatatgattttatattataattttcttttaaaaaattactgagacaatactgattttatacaaggaatttccatcgtgatctttcatttatttctaaaataatagactctgggtttttaattggtcgtgaaactttgattgctttggtgtcaccagctttgtttggagactgcttggaatgtttgaatgtcaatgtaaactttattccccaaaaaccaaattacatatggctagacttccttttcagttcctatataatacttttctgaagccgtcacgctacaggttcttattatttgtctctcattttcttcttacagcctaggaccaattctgtgtttgatatatttctcattttgttataatttttcagtaatttagaggtcttggaatgagttctgtgctattactggcagactctggatctggagctcctcattacttcttctccccttttttcaatactacttctttcaattccctccgcctagtctttcctctgtctcattagaaattacagtataggctaggtgtggtggtatgggcctgtagttccagctacttgagaggctgaggtgggaggattgcttgagggcagtagcccaagaccaacctgggtaacataatgagaccccgtatctttttgcagtgaagtctgacttgattcatcttgtgtctttctgagcactcaatgaatctgcaaccagaacctcaggtgacttatagttgctcccagatgtttgaattttttcttccattattttctcaatattctttaaactgaatcccatttgtgtagcttcttgtaacataggattttgaaagatggtataatccattcttatagttagtgatgacatttttttcagcacttctcaccagtgactcctcaagtgaatgggttaaatggatattacttatatattcttgttcttctcctgtaatagatatttacaccttggataccacttagcatgttgttcccgggggtgttcaatgggtttccatcagttagccttcttccacagcaaaagcattttactttatcacctttacctaaagcataaaattcagctcctgcatgctgctgcttgttaactgagtacatccacatccccaaagtaatgatctgtgcttcataatgctccatggatggatttcttcagaggatttgttgaattggggaaattcctatcagaactcaacaatgtcagattcacttcaaatattaacattctggccgaaaacaaagaagcaattaagaaagtgttgcctatgttcttctgccaccagccagcactataaggttcccaatttttcagttttctaccacaataaaagcactgcacttggtcatcaatacttgtgtattagagttcagcactaactctctctcttggggttaagtgggcatagtttggccagttctggaatgactatagttgagcttcctcactatacatgatgggtttctgggtttcttgggtatatggtatctgatacatttaagcctgtccggttatcaaaagataatctgcatgaatctcagatggcctgcctaaggcaaattgattactgtttcccagttttcaactttgtactgaccattttggatactaggatttgcaggttttgtgtcactattttaaaagtaaatgccggccgggagcggtggctcacacctgtaatcccagcactttggaaggctgaggtgggcagatcacgaggtcaggagatcgagaccatcctggctaacacagtaaaactccgtctctactaaaaatacaaaaagttagctgggcatggtggtgggtgcctgtagtcccagccactcaggaggctgaggcaggagaatggcgtgaacccgggaggtggagctggcagtgagccgagatcgcgccactgcactccagcctgggcaacagagtgagactccatctcaaaaaaaaaaaaaaaagccgttggtaatctgcaatttgggatactttcttgtgtctgccaactgttgagtctccatattgccttctctctactcctgcatgaccactaaagcaccacatggtgtctccttcaccaatataaagaaaacctacttgtgccagtgttgatgctgaaacaggactactacttggaaaactagcaaaagttttttatccgttaaactcttctacaaattcttcgtccttattgatgtctgcagatacacagctttagatccttcaaaactgttaaaagccatcttctcttgaaaatagaacttgttcaccttttcttaggtgtcaaagagtttggaaaggcagtcttggagagcataagctacccaccctcccacccagttataccttccttcgacagtcctgggaacccagtcacggagcccttgctgggtgggtgcggctttcctgccctccccagcagcctataatatcattttatacagagaaaataaaaaagatatttcagtctttcttcttgcattattgatcacatatgctttaataattattcatatttggaatagttaaaaccatgttacttaatacacagtcaccttttttgaatactgatacaggtagtgattctcaaacataggcattctaaaaaattttctgtagtacagtttccattgggaaaaaaccctacaaagttatgttgcatttataataattataattgtattcacttcatttccttgacaggagataagttggattttggctaggctttgataagagtcagatcttctgcttactacattgcatgtctgatgattggtagaagttttaaccatctgtcttttagccatgtgcattttaaatttatttctttttcattacccacatattttcagggcttggcaccctaggatgtatctatatatcattatggcctctggttcttcacctttgtgtcattgacggggtaagttggcacagtagacagtagagtattcctggaagccactctttttttttttttcaagacagggtctggctctgtcacccaggctggagtgcggcggcatgatcttggctcactgcaacctctgcctcctgggttcaaacgattctcctgcctcagtccccagagtagttgggattacaggcgcacactgccatgcctggctaatttttgtatttccagtacagacggggtttcaccatgttggtcaggctggtctggaactcctgacctcaagtgatctgcccgcctcggcctcccaaagtgctgggattacaggcgtgagccaccgtgcctggttgccactcttttaatgagccactaggaatcaatgttctatacctaaaagcaactggaaagtaaattaatgaatatatcatgctaaacccaaactcaatatatcttgctaaactcaactctactagcaagctggattccaaaacctagtgctgttcatcacaaggtgaagtgtgacagagaaatcagaatgtaaaatgatagtaatcttaactatctatggttaaaataccttacttttgccaatgttaccaaagtgactatgtgaacagattttgtagggctcttttcgaggtttgcaagaagcctgtggttatgggggggtctttatgtttctctggcttccttttaccaccactgtctgcttcctcattctccacttcagccacactgccctctctggtgttgagtgagcatgacaagcatgctttctcttcaggactttgatacttgctgttcgctctgttttgagctcttatcgctagatatctgcatggcttgctgtttcatttcactgagactgctgaaatgtcactgttgtgaggccttccacatctatctcacatagtaacagtcacccttcatgtaacttatacccctgcagtcccaaacctctgtatctttttttcatggagttgatcaacatctaacatgtatcttttttgcttattattttattgtctgtcttcccaccttggaatttaagcttcatgaatgtagagtttttgtgtgttttatacattgctgtattaagcctagaacagtacctaaaatgtactttgtgccataatttgttaaatgaatcatagatgaatgtgtttattaacccatctatgctggaggttgcaaattttttttttttttgtgaaaaatcagaccttggcgatgaccttgagcagtaggaaaataataactcctgtaagcttagcgttccaataatggaacactaggcataaatgggttaaagagaaggatttataggagacataccagattaaacctagatgtttattttaaagcttgttttaaatattttaggttggtgcaaaagtaatggtggttttgctgtaatattatttacaagtaaaaccttgctttatttgactgcattaatgttgtattttagattaaaagatacaaagattaaaagttggtgattgtggtacatagatgaagtacatgacttattttgaactgcgtgtgaacactcctgttttgccagctcatggtgttgtaatcagaatccagaaaaataaataacttgaagaaatcatctactttaaaatgataaacttaaattattaagtgataataaatactacaacctgaaaagaatctaaaacaattgattaatcttggttatagattatttatattgtataacaaagtatcttatatatatatatatttttttgagatggaatcttgctctgtcgcccaggctgcagtgcagtggtgccatgtcggctcactgcaagctccgcctcctgggttcatgccattctcctgcctcagcctcccaagtagctgggactacaggcacccaccaccacgcccggctaattttttgtattttaagtagagatggggtttcaccatgtcagccaggatggtctcgatctcctgacctcgtgatccgcccgcctcggcctcccaaagtgcttggattacaggtgtgagccaccgtgcccagccaaatatcttaaattttcttaatggctttgttgttgtgctgcttttcttatgttttcaagaaaactttaaagtattatgcctgcacgctagcatacatttgagttttagtgtatttttttagacactcacatgcttttctatagtagcacacgctgtgtacttcaatacccaaatactgtgcgtattcatacacttatttgaaaattataagtaaacttactaaaacttttgtgtgttgtctgctttagattgtgaattcctgggaaagagatctttgactttgatattattgatgttggagagcacacttaaaatactgtatttaaaaaaaaattaaaacttttattttgaaataattatagattcatatgcaattataaaaaataatatagggatcccatgttctctttacccattttcccccaatggtagcatatcgcaaaactataatataatataatatcaaaaccagaatatttaattgatacagtcaggatacagaatatttccatcatagcaacacccacttctctcctgttgtcacccctccttaacccctgttcatggtttttagctgttatgaacaaagctgctataaatattcatgtacagattttcatgtttttattggtctgggataaatgcccattagtgcagttgctgggtttatattgtggttacatgtttcatggtggttttttttttttttttttttgaggcagagttttactgtcatccaggttggagtgcagtggcgtgatcttggctcactgcaacctccgcctcccaggttcaagcgattctcctgcctcagcttcctgagtagctgggattacaggtgtgcaccaccatgcctggctaatttttgtatttttagtagagacggggtttcaccttgttggtcaagctggtctcgaactcctgaccttgttatctgccctcctcggcctcccaaagtgctgggattacaggtgtgagccaccaagtttagtttttaaagaaactgtcaaatgtgttcctgagtggtggctgtatcgttttgttagggttcccaacgtagaagaaacctttgaatctctagttctttaaaatggaaaacttttttgagggggtacatttgtctgtaaattttagtattagaaaaatttctgggaaaatgcaaaatgtgaattggtgtttttagccatttataaatgctcagtaattcaaaactttaatgagatcaaagacttgatacatagattttgactatgtctgagggaaagtgaatttgaacatgatcataatattttctggatactaataattacctgatacacttcatcttcctttttatctaaacagagccatttatttattactgtataacttttactacatgaagagggtgcttgtttcagaacaggtagggatttaaagattcagggagaactgaattcaatctaaagaagtaaacttttcttatgacttgattatattgcttatgagactaagttgaaattgttggcttataacatccaacaataaaatttctaaatgttgtgaggttttatttaaacaaaatatttactgttttttggtatgtgtttctgatttggaaaataaagaggaaagtaaaagtcatctgtattttggaggccaaggcaagtggatcacctaaggtcaggagttcgagaccagcctggccaacatggtgaaactccgtatctactaaaaatacaaaaattagccaggcgtggtggcatgcgcctgtaatcctacctactagggaggctgaggcaggagaatcgcttgaacccaggaggtggaggttgcagtaagccaagattgcgtcagtgcactccagcctttgcaacagagcaatactgtctcaaaaaaaaaagagctttaagaaaaagagccatcagatacaagtaagttttgataagttgcaattattagaccattagtttatagccttaacgattaactagcacttaaaaacatacaaattgaaggcaattgtattaatacccatctgaaaatgttgctttcttgttacatgttagttagtgtgtattagagtgaaaagtacccaatttaaaaaatagtagttttctagattttaaatgttgatagtgaattagttattaaaggtcaaaatgaatgaaatgtatatagaaagaagtataaagagttaaatattttctctggccaagatatgtctctaaaattatgaaaaaattttcctggggctagtatgccagaaccagttacccataagagaacacttgctgttagaatttaactttgccacagtatgatttaaaagagaacacataagcaaaatttgcacttgcatgattttcctttattatatcagttgtgacaataactaagttttccaatctttcaaaatttattatatgctgctaacatgtttaaaatgtgatgtcaaatgtagttagttcacttacattttattataagaaaaaaatttaagacatttaaaaatccttctgtttgagtccttttgaaaacttctctgtaattttatttatgccaccaaacattttaacagtatctacgttttaattgtaaacatacatgtaatgtatgttagcaatttgtctttagcatttggtttttaatgttaaacatgcagtgtcttttattaaaacatctgtatttgatttttcaaacataggtttgaaaatggtgattcagcctaggcacagtggctcacgcctataatcccagcactttgggaggccgaggcgggcagatcaccagaggttgggagttcgagaccagcctgaccaacatggataaacccgtctctactaaaaaaacaaaattaaccgggtgtgatggcgcatgcctgtaatcccagctactcgggagactgaggcaggagaatagcttgaacctgggaggcggaggttgcattaagctgagatcacgccattgcacttcagcctgggcaacaagagcaaaactccgtctcggggaaaaaaaacaaaagaagaagaaaaaagtactttctcttgttctttcactcaacagagaatgatccccacagaccaagcagttctctggaagcacattctctggcagacaccagcttagtgtcctctaattcaatttaattctaatactgtctacctggagatagcatcagattccactggttgagggctcagtttcataagactgcctccacctcagatgccaatagaaagtaatagttgttatctgtacttccaactgatcagctataaattggagttcccactaccccctcttcaagttcagctaatttaccagagcagctcagaactaagggaaacactttgcttacatttactggtttattatagaggatattagaaaggttatggatgaacagccagatggacgagatgcatatggcaagatatgggaaaagtctgacaagagcaaatgttggtatgaatatataggaactggaactatcatattcctgcatgtgggaatgtaaaattgtttaaccactttggaagccaatttgacagtttattaaaaggataaacatatacttttccgtatgagccaaccaatctactcatagacatttactttagagaaataaatttttatttctttttaagttatttttaattgacaagtcataattgtatacatctatggggtgcaatgtgatgttttgatatatatatgtgtgtgtatatatatatgtatatatatgtatatatatatatgtatatatatatgtatatatgtatatatacagcatgaaatgattaaatcaaattaacatcacctcagttgtcagacatttgaaatttactcttagctataatatattttgaaatgtacattatgtccttattaactatggtcaccctgctgtgcaatatatctcaaaaatttatttctcttgtctcactgaaacttatcatcacaaccccctcttcccttgggctctgttaactgccattctactctgtacttctatgagttggactttcataagattccacatataagtgagatcatgtggtatttttttctgtgcctggcttattttaacttagcataatgtcttccaggttcattaggttgattccatgtcttggttattgtgaatagtgctggagtgaacatgggaatgaagacatccctttgacataccgatttcactttctttggatacatactcagaagtggggttgctggatcacttgttagagaaaaatcatatggtatttttagttttttaaggagcttccatactgtttttcataatgactgtatcattttacattctcaccaatagtgtacaaggattccttttcctccaggtacttgccaacactttgttatcttttgactttgatagtagccactctaacaggtgttaggcaatatctcattgtgattttaatttgcatttccctaatttttagtgatgttgagcatttttaaatgtgtgtgttagccatgttttttttgttttttttttttgtttgtttttttgtttttgagaaatgtctgttcaggtcctttgcccatttttttaattgagttgtttccttgtaattgtgttaaatcccttacatattttggatattaaccctttatcagatgtataatttgcaaatattttctcctaatctttggaatctgtgggttgtctcctttttttttgagacaggatctcgctctgtcactcaggctggagtgcagtggcgcaaccttggctcactgcaaccttcacctcccagggtcaagcagtcctcccataacttcttgagtagctgggactacagcgcatgtcactatgcccggctagtttttgtactttttgtagagatggggtttcaccatgttgcccaggcttccaatctgtaggttgtctctttaccctgttaattgtttcctttgctgtacagaagctttttagtttgatataatcccatttgtctatttttgcttttattgcctgtgcttttgggttcatacccccaaaaaaattgcctagaccagtgccatgaagcttttgccctatattttcttttagtcattttatggaagagcttatatttattgtctttaatccattttgaattaatttttatataacatatagataagagcccagtttcattcttttgcaagtagatatccagttttcctaacgccgtttattgaggagacttgttcttttcctgttttgtgttgttagcacctttgtcaaaaatcaattgaccataactgtgggtttatttatttctgggttatttattctgttccgttggtctgtctgtctttttttatgacagtacaatgctgttttgattaaaatagatttaaaatatattttaaaatcagggaatgtgatggcttctagctttgttcattttgctcaggattctttggctgtttggggtcttttgtggttccatttgaacttaaagattgctttttctatttctgtgaaaaattacattggaatttcagtaaggattgcattgaatctatagattgctttgggcagtatgaacattttaacaatgttgatttttccaattcatgaacatgggtgtttttctgcagttttgtttatcagtgttttatagtgtttttagtatgtggatcttttaccatcttggttaaatatacccctaaggattttattttttgttgttgctgttgtaaatgggatttttttcttaatttatttttgaatagttgagtattagtgtataaaaatattactgatttttgtatgttgacactgtgtcctgcaaccgtacggaatttatttatcagttccaacagtcttttggtggaatctttagggtttttagtgtataagatcatacagtctacaaacagagattgttttacttctttctttcctactaggattacttttatttgtttctcttgcctaattgctctggttagggcttcaagtattatgttgaaaagagatggtgagagtgggcatccttgactttttcctcatcttagagactgctttcaacttttcactgttgagtatgatgttagccgtgggcttgtcatatatggcctttattgtgttgaggtacattcctctatacctaatttgttgagagttttattgtgaaaggatgttgaattttgtctgcatctcttgagatgatcataaggttttcatccttcgtcctgctaatgtggcatatcacaggggtccccaaaccctgggccatgaaccttgtcaggaatcagcctgcaaaacaggagatgatacgcgggtgagcgagcattattgcttgagctctgcctcttgtcagatcagcagcggcattagattctcataggatcccgaacccaattgcgaactgcacatgtgagggatctaggttgcatgcttcttatgatgatctgaggtggaacagtttcatcctgaaaccaactcccacggacccaccccgccctgcatccatggaaaattgtctttcacgaatccgttttctggttccaaaaaagttggggaccgctggcctatcacatttattgatttcatgttgaaccatcctcgcctcccagggttaaatgccacttgatcatggtgaaagatttttaaaaaacaagtaaaaacacttaaatggatatatattacttgtacatatttatatgctacatgtaatattttgatacatgcatagactatgtaatgtaggatatccatcactttgaacatttatcatttctttgtgttgagaacatttttccttttttatttacagatttctgtagtgttgggaacattttaaatcttttcttttagctattttgaaatatactgttgtcaactatagtcactcaccctactgtgctatagaacactagaacttatttcctgtatctcactttatgtttgtactcattcactaacctctcttcatctccctttcccctacacagcttctggtatttatcattctgctgtctgtctccaggagatcaacttttttagctctcacatatgagtgagaatatgtgatgtttatcttttgtgcctggcttttttcacttaatataatgatctccagttccatctgtgttgctgcaactgacagtatttctttcttttttttttttgagacagagtctctctctgttgctcaggctggagtgcagtggggtgatctcggctcactgcaacctccacctcctgggttcaagtgattctcctgcctcagcctcctgagtagctgggaatagaggtgcctgccacaacgcctgactactttttgtatttttagtagagatggggtttcaccatgttggccaggctggtctcgaactcctgacctcagctgacccatccgccttagcctctcaaagtgttgggattacaagcatgagccactgcacccggctaactgacagtatttcaagtgaaatattcttttaatgtattaattggatttagtttgctagtattttgttaaggattttggcatctatgttcatcagggatattggcctgtaattttcttttcttgaagtgtccttgtttggctttggtatcagggtaatactggctttgtaaaatgagtttgggcatattccttctatttcaattttttggaagagtttgagaaagattggtattagtttttctgtaagtgtttattagaattcaccaggtccttggattttctttgatgggaaactttttgttatttattctatctgcttactcattattggttgtataaggccattattgcattgctataaagagatatcagtatcagaggctggataatttatgaggtttaattggctaatggttctgcaggctcacggttctgcaggctgtacaggaagcatagtcctggcatcagcttctggggagtcctcaggaagcttacagtcatggcagaaggtgtgaagtgggagccagcatgtcacgtggtgaaagcaagagcaagggtagggattgagggtgccacacacttttaaataactggatttcacgagaactcgctatcacgaagacagcaccaagccatgagggatccaaccccatgatacaaacacttcccactgggccccacttgtagcattgaggattgcaattcaacatgacatttcattggggacaaatatacagactatatcattggtctatttagatattttttatttcttcatgattcagtcttggtaggttgtatgtgtctaataatttatccatttcttttaggttatataatttgttggcatataattattcatagttttttttattatactttaagttctagggtacatgtgcacaatgtgcaggtttgttacatatgtatacatgtgccatgttggtgtgctgcacccattaactcgtcatttacattaggtgtttctcctaatgctatccatcccccctccccccaccccacgacaagccctggtgtgtgatgttctccaccctgtgtccaagtgttctcattgttcaattctcacctatgagtgagaacatgcagtgtttagttttctgtccttgtgatagcttgctcagagggatggtttccagcttcatccatgtccctacaaaggacatgaactcatcttttttatggctgcatagtattccatggcgtgtatgtgccacattttcttaatccaggctatcattaatggacatttgggttggttccaagtctttgctattgtgaatagtgccacaataaacatacgtgtgcatgtgtctttatagtagcatgatttataatcctttgagtatatacccatatgggattgctgggtcaaatggtatttctagttctagatccttgaggaatcaccacactatcttccacaatggttgaactagtttacagtcccaccaacagtgtaaaagtgttcctatttctccacatcctctccagcacctgttgtttcctgagttttgaatgatggccattctaactggtgtgagatggtatctcattgtggttctgatttgcatttctctgatggccagtaatgatgaacattttttcatgtgtcttttggctgcaaaaatgtcttcttttgagaagtgtctgttcatatcctttgcccacttgttgatggggttgtttgattttttcttgtaaatttgtttaagttctttgtagattttggatgttagccctttgtcagatgggtagattgcaaaaattttctcccattctgtaggttgcctgttcactatgatgatagtttcttttgccatgcagaagctctttagtttaattagatcccatttattaattttggcttttgttgccattgcttttggtgttttagacatgaagtccttgcccatgcctatgtcctgaatggtattgcctaggttttcttctagggtttttatagttttaggtctaacatttaagtctttaatccaatgtctctttcatttttcattttatttttcttctctcttagactagctaagggtttgtcaattttatttaaaaaaactctcagttttgttgatttttttatagtgtttttctagtctctatttatttctgctttgatctttgttatctccttcatttgtttactttgggcttagtttgtctttttctagttccttaaggtgtaacattagatttgttatttgaaatcttcgtttcttttttgacctaggcgtttagtgctataaatttcccctttagaactacttttgctgcatcccataaattttggtttgttgtgcttccatttttgtttgtctaaggcatatgaattctgatttctgtgtaaagacttgtatacaaatattcttagagcctttggttgtttgccaaaaactagaagtaatcaaaagttcattaataggtgattcgataagcatattgtgctatgtccaaacagtggtatacgtctcatgtataaaagggaaagagctttgacatactgaacaatatggaagaatgtcaaaatcattatgagtgaaagaagctaagaaaaaaaggataatgtaatctatagtaatagaaagcaggtatgtggtgggagagtagggagtgaagggattgggtgagagagagtacaaaggaacacaaggaaactttggaggtgatagatgtgttaactatttttgtcgtgatgatcattttagagtgtgtacatatggaaaaacttttcaaaatatgctctttaaatttttggtgtttattgtaaagttgtccccctttatctgccgctaaatacgtgttcaaagacctccagtagatgcctgaaacctagacacatgatgtttttcctatatatgcatgatatttttcctatatatgcatatcctaatgaagtttaatttataaatttggcacagtaaaagattaacaacaatagctacaataaaatagaacaattataataatacactgtaataaaagttatgtgaatgtggtatctctgtgtctctgagaattccttggtgtactgtgctcaccttcctcttcttgtagtgttgtgagatactaaattgccagcatgaggagatgaagtgaggttgatgatgtaggcattgtgacatagcagttaaaacttatgagctgtttatttgtggaatcttctattaagtatttttggatcacaatttattgctggtaactaaaaccatggaaaacaaaaccatggataaagggggactattatatgtcagttttatcttaataaacttaaattatgtttgcagcatcaaaaacccttcaatcatcctggagttttacgtgttcctgcagtatgttaaagtaaatcagcttttgctaacatactttgaaataatttaaaagcaccaactcttttttttttgccactgttattgtactgtatgtcagtgtattggtggattttaaatttttctttatgtgttaattagatagagaagtaagccatatatgagtaaatgttattgactggcaaacaagttatcttcctcttaatggaatggataacagaatgacttcctctgggttcttccttctctactgcctggcttttttatgttactccagatttttggttgagagaacttggttgaaatgtccatccctaaagcaatcatttatgacctgagtggcagtgtacccactgtagaggtatagctggttgtggcagtgtcgaaattcctcaaggagagggcagttctccgtggtattatttttggtctgtataccacttatgcaaaaggatatagatagttttccaactcaaattaccaaaaaacacagtaaagtggttaagaacactagctctagagttagatggatttaaatttgaatcctggaaggccgggcatggcggcttgcatctgtagacctagctacttgggaggctgaagcaggacaattgcttgagcccgagagtttgaggttatagtgagccatgcttgcactccagcctgggcacagagtgagaacctgtctttgaatttaaaaaaaaaaaaaattgaatcctggtttaccatttaatagctttgtgactataactgcaaatctaaattttctcatctgtcaaatggaataattcatagatcattttttggtgattattacaaagactaagtcaatatgacccaagagggaaaagaagctattaaacctagcatttctacacagtaataatggattattccactaggtaagagatgagtaatttaaagaaatgtttttttcgtaacattctttgataaagaaacatagaactctatttttgactgctttttaaaggaatgtgtgtgtgtgtatgtgtgtgtgtgtgtgtgatgaataaatgaataattcagggtcaataaaaaattgcatacttttaaaaattacaggcattatataaaggaggaagtaatatttaggttactagcattgcgcagtcatattcataatatgtgattagtttcccagaatacttgcctggagctgacatgaaagtaagttctgggacttagccctgccatagatgccttatgtacttcaacctagatgtttcattttctagttctgcattctttcgctaactgtagacaaaataagtcattgttgaagtcttaaaatgtagtttcctaaacatagctatagagtatatgtagaagcttaggactccttagcaaagaaggacgaagaaatgcttagttatttttctcccatctctactttccttaattaatcctaggagtttttgttgatggcctatttttttggtcgtgaatttaaagggatttttttgtttcacatcttttagttatttaatatatgggttttctgtatttttatttattgttctctgaaataagctcttccatgtctgagattttgtcttctatgtctatctttgaaatttcctagcctggcgctgtggctcacgcctgtaatcccagcactttgggaggctgaggcgggtggatcacgaggtcaggagattgagaccatcttggctaacatgatgaaaccctgtctctactaaaaatacaaaaaaaaaattagccaggcgtggtggtgggcgcctgtagtcccagctactcgggaggctgaggcaggagaatggcgtgaacccgggaggtggagcttgcagtgagctgagatcgcaccactgcactccagcctgggcgactgagcaagactccgtctcaaaaaaaaaaaaaaaaaaaaagaaaaagaaatttcctgcattaataacctgaatgctttgtattcagtgaattatacccacatagaaatatagcttgtgtttgtttattgctttgaaacatgctcccatacatttttccatttaacctgtcaaaagcaccctgttaaataggcatgactggttttattgtcccatttatagatgagcaaaactgaatataaaaggatatatgacttctctaaactcagagtaataatatataaattaatattgaaaactcaggatttgatcctgggtttagtgcttttactctgctattgtagcctatctaaatgttattgattgatgaccttctagaacttgaggctttttaaatagtgataccaggaaacaaaccttatatgtggcaatagttgcaatatagagcatgattgttttatttatggttttttaattaatgttgaatctaaagggctggatataatagcaatgcttataaaaatttagcactactatgacagccttaggcagcctcagcatggatattgactcagtacacgtctgtgttaaatcattttatgtgactttggtctagaaggtaagcattacttgtacttttaggaattaaattattcaagtgtattgtacttttaaaaccaaaggaaaaataacttatttaatttacattcattcagttaactacttaagccctaaaaaatcgctcactgttttactgtgttctgtagctctctggtcatcaaccgtatttcacagagtttttatcatttgtatgtgtttcttttattgtgatatccatggctatggtttattataatatttagtaattttcaaaaacagaagcgaagaacggtgtctttccttgcatgatatttattgaactcattcttcttgtgagatacagtttaattgcaaggttaaatatcatctttacaatcttgtatgtaaaattattataatactaaaatgtaaatgtaagtggtaaaaacacatttacaaatttaagagtttaagtactttagttttaaaacaatacattatatgttaaattttttggaagaaaatcgtgtagggctgatgcctagcatgatacaggttcttatcatttgttaaattatatggctgaatggcatatgataagggtttttttttcttccaataatgaattacatcatttagtagtacctctcagcagattttcatgaaaataacataagtttaacactgaattgtactgcttatcagaaatgattaattgaggaattatgcctagatgtatcctataatgcatagattctggaattttttgcactttggcgtgcagaaaattggtaattggttcaataaagtgagctgtacaatgaagaaatttaagagattataaatggcttaaatgtataggaaaaagtatcttatttagaatatgtctctaaggcatgccctttgtatctccaatagtgattagcaaatagaagatgaaaagtcatggcccaacttataaatgccatttgatgaaagatagttcacattgtaatttccatttttactaaaaagctgcaggagtcaggcaagaattacttttcttggtacttgatcttgtgtttgtgaggaagtatttaaagaaaaatagagaaaggaagaaaaattgaaaaggaaagaaaaaccttttctctaaaatgcaccttgacaatgtaggcctgaatctttcagctctggcttgtattattttaactctacaattattttcattgttagatgattgatgagtttaataatttaataaagatattttaaagatttaactcttttataaaaccaaacacttgtaacaagatttagtttattgtgttggttaatattaagttggctttctgttcttgtaaatgtggcagcaacctggtaaacatgaagagacaaaaagagaaagcatggaagagtggaaagaaaactgattctataacagacctaaattttggtatcagttttcacactaattagtgtccatttgactcctaggcccctgatttactagtctgggaaagctgagatcttttcagtactatttcaggactttggtcactaagaaagattttccagacactgtctcttactggttgtataatgatcttggtgaaacaattttactgttatgcctccattttctcagctgtgagatatagggatcatcacaatatgatccctatatattgtgtatgttgtgaaaaataatacatataaaagacgtactagtgcataggaagatctcaatcagtgtttgcttttattattgctattgtcattgttgttgtcactatgattatgatcatgtctgtgaagcaccttcacaattctgaaggaaaatgatttggatctagaattctatgtccaaccaaactgtgaatcagaatcaagtgaaggcaaaatatagacattttcagccatttgaggactgagagtttacctctcatctagtctctcttgaaggaaaattgagaatgtactccagcaaaataaaaaggaacccaagcaagagaaaaataacagatcctagaaacagtgaaaccaactcaagaatgcaacacaaagaaatttcaagataacagctattcagcacatcttgcaaggcattcatccaagtttaaataggaactcagaggtttcaaaaaaaatgtagatatcatttggaaacatctgactaaagaagtgaaaaactcagtgatgtactaaaattgtgttttttccaacaatgagaaaagaaaaacaattacaagctccgtaaaaaacaacaagctgtataggaaggtgatagtccaaatatgaaacagtagaatatgattttgaacaaccgatggagaattgaccttgacatttggaacatacttgtagagcagtacagttttagttcctgtcattacactgatgttcaattatatgaatcccatcacatttattgattctgagctttatatatttagtattttaaacatgtattcatttttaacttttgagctgcatatgttggaaaaatggactacattataacagttaagctgcttttgtgtgtgttaccaaaccattgtaaacaaggtgggcaaaagaacacagtattggcactgcctgagaactgaggggcatagctgtacaggacttggaaataattgtacacactagtcaaccgaggatgcagtacttgtaatagcatgcttctttttataacaaagggctttgacagacaagttagtcttgcaaatagctaggaaaacagaagcctagaatagatggctgaccatattccattatattcatgcatagttaccattattgatcatctttaaacctaaatgaaagcaatatatacaaagacttttggaggaatgttgaatgttgagctatgtaagagaagctctagtcaaagatgggggctgattaagcatttaatagtataatgtatagtgtagatttaaaattatatcaaagaaatttgtttaattttatttaagaaatttgtgtaggccaaaccttaagaaacatctctctgctatccattattttgttaaaaaactatgtcataatgctcaagtcctatagcatattattaacatctctttaataattaaaccaaaattctaggtcattttagtttataagcattttgtctctgcattggaaatgactgtagcaaatttaatcttaaaatatctctatccttacatttcaagtagaacattttaaaaaagtaaaataaagtgattttatttggcatcagagctatgatttccccctaccccacctaatgccagtccctctttaagtaaatacttttgtaattactttgcctttgacttctgcaactgaactatatttacatttaatttacagcctttgaggtatataaattgtgcaatttaatggtttaattggcatagacttttctattagtttttacatctagttgattttagacagctaaatttagaagtatttactcttgattaaaatattcatgattcacctttttagagagtatttgtatgagaatttacttataacatcaacatttttctttttaaatgaaaagtcagttttatacacatagcattttgggtttaatgtcacaaagagaaaaacagtaaatcctgtgatacttaaattcattattgggctgatcatgtttgaatctcaatccaagaagatcctagggaaacttgtagcatagtcttagatatttattaaacattaaattgatttatatgctatttagtttatttaacctatcagtgaaataaattaaaaatattaatctatttttaagaatatagattaatggtaaattttagttacattaccaaatcttaggattaaaaaatagatttatagaattacttttcatttgtaactcttgaagaaaatcagttaacattcattctgttactgttttatagtttccattccagtttggccaatgagatgtgtaaacatgagaatacctatttattatgtgccataagtacatatattgtcatagtttaaaatgtaaaattccacattttctagatctggaattgacaatttatctgaataattgttagcctttataaacatagttttactgtgcctaaaataagaaagcgatgatattgaaagcctgtgctttccaacatatggcttcaatttgcatttcaatcagaatatggaagtcattactctgacatctgaaactgaggtagcaataaaaaattatcactaacaggacagcagacacaatttattttgtgtttattactgggtggcccacttgaaacttttcagaaacttaattgattccagatattggaaaattataattaaattatgacatttattttagatgcatttaaattagctgtcttaataggattggtataaattgattaatatctattaagatttatagtatatatgtacaaacacacacacacacatacacacacacacacacagacacacacatacatatagtataggcatacctcaaagatatcatgggtttggatctagaccactgcaataaagtgaatactgtaataaaatgattcacatgaattattttttgcttttccagtgcatataaaaatcatgtttacattatattgtagttttatgtgcaaagcattatggtttgtttttttttttgacatgaaatttcactctgtctcccaggatagagtgcagtggcgtgatctcggctcactgcaacctccgccttttgggttcaaatgattctcctgcctcagcctcctgagtagctgggattacaggcatgtgccaccacacatggctaatttttgtatttatggtagagatggggtttcaccatgttggtcaggctggtctctaacttctgacctcatgatccacctgcctcggcctcccaaagtgctgagattacaggcgtgagccaccgcgcccagccaaagcattatgtttaaaacaaagtacacacattaattaaaaaaaacttatagctacaagttgatagtgatatcaggaatgatcaggaagtcataatctttggaaggccttgccccagtgttgatgattgctagttaaggtggtagttgctgaaggttggcatgactgtgccaattttttaatataagacaacaatgaaatttgccatattgattgactctttctttcatgaaagatctctctgaagcatgcagtgctgtttgatagcatttcatccacagtacaatttcttttaaaattggagtcaattctctcaagcactgctgctgctttctcaattaagtttatgtaatattctaaattctttgttgtcatttcaataatgtccacagcataatcaccaggagtaaatttcatttcaagaaacctctttttttgctcattcataagaaaaaaacagaactcctgatctgttcaagatttatcatgagattggaggcattcagtcacatcttccagcttcatttctaattctagttctgttgctctttcaaccacatttgcatttacttccttcactggtcttgaacccctctacgtcatctatgagggtgagaatcagtggcttccaaactcctgttaatgttgatatttagaccacctcccatgaatcacaaatgtccttaatggcatgtagaatggtgagttctttccagaaggtttacaatttgctttgccccaatccatcagaggaatcattctctcatcaatcactcataaagcaactatagctttatgaaatagttgtaagtaataagatttgcaagttcaaactactccttgatccatgggctgcagaatggatattgtattagcaggcatgagaacaacattaatcttgtacatccaacctcttgggtgacctggtgtgttgtcaatgagtagtaatattttgaaaggaattttttttttctgagtagcaggtctcagcagtgggcttaaaatattcagtaaaccatgctataaacacgtgtgctttgttgtttcatttatggaacatgggcagagtagatttaggtaattcttaagggccttagtattgtcagaatggtaaatggtcattggcttaaacttaaagtcaccagttgtatggaaagtcagtctgttctctaaaggtttgaagccaggcattgagttcttttctctagctgcgaaagtcatagatgacatcttcttccaatgtaaggctcctttgtctaaaatctgttgtttagtatagccaccttcatcaacaatcttggctagatcttctggataacttcctgtagctttttttttttcttttttgagacggtgtgtcacactgttgcccgggctggagtgcaatgacacgatctcagctcactgcaacctccacctcccgggttcaagtgatcctcctgccttagcctcccaagtagctgggataacaggtgcctgccaccatgcccagctaattttttgtatttttagtacagatggggtttcactatgttggccaagctgctctcctgacctcatgatccgcccatcgtgacctcccaaagtgctgggattacaggcgtgagccaccgtgcccagcccttcctgtagcttctatgttagcacttgctgcttcaccttgcatttttatgttatggagatagcttcttcccttaaatctcatgaacccacctctgctagcttcacacttctgcaatttcctcacctttctcagccttcatagaattgaagagagttagggccttgctctggattaggttttggtgaagggaatgttgtggttggtttaatcttctattcagaccactaaaactttctctgtgtcagcaataaggctgttttgctttcttgtcattcgtgtattcactgttatagcacttttaatttcctttgagaactttcctttgcatttacaacttggctcactggaacaagaagcctagctctggcctatcttggctttcaacatgctttcctcactaagcttaattatttctagtttttgatttaaagtgaaagacatacatctcttcttttcacttgaacacttagaattgcaaggttattaattggcctaatttcaatattgttgtgtctcagggaatagggagacctgaggagagtgagtgagatgggggaacagtcagttggtggagcagtcaaaacacacacaacatttatctattaagtttgctgtcttatatggtttgcagttcgtggcaccccaaagcaattgcaatggtaacatgaatgataataggccaggcgcgatggctcatgcgtgtaatcgcagcactttgggaggccaaggaggacagatcacttgaggccaggagtttgccaccagcctggccaacatggcgaaatgatgtctttactaaaagtacaaaaattagctggtgttggtgatgcacgcctgtaatcccagctacgctagtatctgaggcatgaatcacttgaacctgggaggtggaggttgcagtgagctgagatcgtgccactgcactccagcctgggtgatagaaagactctgtctcaaaaacagaacaaaacaaaaacattaaagatgactgatcacataacagatatactaataatgagaaagtttgaaatgttaggagaattaccaaaatgtgattcagagacaaagtgagcacatgctcttggaaaaatatcttggatagacttgctccatgcagcgttgctgcaaacctttacttttttaaaaaaaaaaaaacagtatctgtgaagtgcaataaaataagattgcctgcatatgcatatgcagtcattgtatgtatgtagtcatttgcatgacaaaggactgaaaatattcatttgaaaatgctgaatgaattaataattatagttaatatttgaaatggggaacattggtgggaaaagggtttcatgttatataaatgaacttattagtctgtttttttcttcttcttcttttttttttttttttgagacagtctcactttgtcatccaggctggggtgcagtggtgcaatcacagctcactgtaaccttgatctcctgggctcaagccatcctcctgagtagctgggaccacaggcatgcaccactatgaccagctaattttttaatttttaatttttgtagagatggcatctcactgtgttgcctagggtggtcttgaactcctggacttaagtgattctctcactttggcctctcaaaactctgggatttaacagtcatgaaccactgttctggactactttttagtcgtatcatggggatatattacttgtataataaaatatagcatgagatgaaatttctttttttttttttttttgagacagagtttcgctctgtcacccaggctggattgcagtggtatgatctcggctcactgcaacctccacctccctggttcaagcgattctcctgcctcagcctcgtagttgggactacaagcatgtgccaccgtgcccagataatttttgtatttttggtagagacagggcttcaccgtgttggccaggatggtctcgatctcctgacctcatgatccacctgcctcggcctcccaaagtgctgggattacaaacgggaatttcattaatttctaaattttgtttgaactaaaatattaattataatcgtttaaagcacttcagtgtattgtgaaagctaatttctaagagtgaaaatacatgatctagaactttgttatcttgaattaaattttcaagataatgttaattcatttacccagcaaattttgactcttcatatgttttgtacattgaattaagtgttggggaaacaatgatgaattgagaagctcaaggtttagtgagatgtaggtaccattcaatatgtacattactgtatgatatggtaaatattgtttcagcaaagtggaagaaggggcagaacaactgccagaaattgtagggaaagattttctgtggagtctgcattcttgaaggatgagcaagaattttctggataggtaaacaaagcaaagagaattctcacctgagggagcgttgtgtgcacagggagtcctgagttgatggggcatatttattcatcctttctttgttcatttatttattctttattcaactaatatttattgtacacctatgtaccagtttgggtgctgtggatagcatagtgaacctgacagacataatcctgtcataaattcagtataatgtagaagaataaataattaaaattatgatgagtattgcaaaagagtaagcatggggtgttacaggtgtatgtaacaatgttaaatataggagaagcttctggaatattgaggagtggtatgagatgggactggaaggagggatttggtccaattttgaaaggtattatatacagagcacaggagtttaaataacattttattaatttttaaaaaattagctacagaagttccacaggagattaaactttctactttaggacaatcattttgaatgtactttttttttttttttttttgagatggagtcttaccctattgccaaggctggagtgcagtgatgcaatcttggctcactgcaacctccacctcctgggttcaagtgatttcctgcctcagcctcctgagtagcagggactacaggtacacgccaccaagcctgactaatttttgtatttttagtagagacggggattcaccatgttggccagggtggtctcgaactcctgacctcaggtgatgcgctcgcctaagcctcccaatgtgctgggattataggcgtaagccactgcgcctggcctgaatgtcatcttaagggtagatcatagtaggactagatttgataacttggccagttaggttcttatggtgttcaattagtaaaacattttaattgcttagacttggcacatcaacagcgaagagaagattggagggtgtcaatctacatctgaattttaaatcatttttttcaattccattttgtactattttcaggagatctctgctagatattttctgcctacattatacatattaaagcaaattaatagttttattccacattcttccattatatccagcttccccataacaatgactgctgtcatctaagttatttcgcaaagacaacagactattcttgactggcaggtttatgttttgctaggtttttttttttttttttttgtcaaatcctgatttattttaaaactttaaatattttaaaactttaaatttgtcatcataaaatcataaaaatctccagagtttttgttcatttatcatttagtttttatatttatttatttatttatttatttattatttattttttttgagatggagtcttgctctgttgcccaggctggagtgcagtgtcataatctcggctcactgcaaccaccactttccaggttcaagtgattctcctgcctcagcctcccaagtagctgggattataggtgcttgccaccatgcctagctaatgtctgtatttttagtagagacggggtttcgccatgttggccaggctgatctcaaacttctgacctcaggtgacccacccgccttggcctcccaaagtgctgggattacaggcgtgagccaccgcgcctggccagatcatttagtttttaaatctatccggctattacttggtcagatctcatcagtactatgcagtactcatcagtactcagtactgcacctgaaccctctctcaggtattaattcctcccttaaacattaatgctgaagtccagaagttgagtaactttttctatttagagcttcacagtaaattttgccagctttgtgggtcatatggtcccctgtggcaactatttaactttgccagcgtagaatgaaaacatacatagacaatgtgtaaacaaatgaatgtgtctgtgttccaataaaactttatttatggatgctgaaatttggtatcatattattttcacatgtcaacaaatatcattcttttgttctcttaaaactgtttatgttagtcttctagggctgctgtaacaaattatcacaaacgtggtggctttcggcaacagaaatttattctctctcagttcagaggctagaaacctgaaagcaaggtgttggcagagctatgctcctgaagtttctagggaagaatcctttccttgcctctttgagcttctggtagatcctgggaatccttggtgttccttggtttatagccgcatcattctaatctttacctctgtcatcacatggccttcttctctctctgtctgtgtgattttgtatttggattccctcttctttctcttataaagacacctgtcattggatttggtgcttcctctaatacagtatgactttacattagcttgattacatctgcaaagaccctatttccaaataaggtcactttcacaagaaccaacatacaatttatcatttgtggggacaatattcaacccactacactattaaaaaatagaaaaataattgttattttgtgggccatacaaaacaggtggtggggtggatttagccatgtgctctatttgcttattcctgctctagccagagttgcctttttatttattctctcaatagatgccttattcttactgggaaacaagttgagaattaacatttattgagcccctaccatcttccagacattttgctgggtttattgacatcttttctcttgtttattcttcaaacaatcctataaagcacatattatcagtagctcatgaaacaagctgaaaacattattaaatttacttgctcaagcttacataatatagctaagaaacagtgactctaagatttgaatctgcacctgaaactaagtgatgataatgtttttctctttctactctatcactgtagtttctctgtgtgtaatgacttaacattgctccttgcaataggtctataatccttaatctcttgttttagcccttcattaggatgatttcacatgagcaatgtttcacgtctaatttagttgctttggctttataaacagaaaccaatttggttggcttaagataaaaaaataggaattaaggggaaggacagtttgatggctcagaattgaaagaagttctaaagagtcgagtctcaggaaaaaatggaactagggcatctacgggaacttagcagcaggaccttttatatgacactgccattaaagtgactcagctctaacattcccctccttccaccttgcctttaacctcaaattttaattctttagagggagaatctgtttggcttatttaggtataatcttgtgctggatcaaactaccttagcaggtgggaggccgcaggggaagggggcatggctcaaatgtgacctgtgtagcattcttcctgaattaaagcataactcagttttttttcaatgacattttttgagtcaagtgacattcatgaggcttctctgtgtcataaagggtcgtgtggaataatcttcatttaatacgtatgtgttgatatatcctgatatgtaccaatgacagtgataaatctgaatttggaaatctttcctctatgttaggttatattctcttctgttcttccatagctgttagttcattattctgtagtagtaattttccttcctttctcctccttcccttcatttatcccttcctccctcctttttcccctctatgccttcctctcttacttctgttcttctctcattacactgataagcttttccagagctgggattttatttagtcatatttatcttttaatgcttgaaacagaaaatgctgttagggtaaatactaattttgtttccttgctttagttgctacttctcttacttcacaaatactgagtaattgctctgtgtctggtattgttttgaggccagggcacgaatgaggctctgtacttgacttgactcgttagaacttctttcaattctctgagccatcaaagtgtccttccctttaattcctatttttatctcaagctaaccaaattgatttctgtttataaagccaaagcaactaaattaggtatgaaacacatacatgtgtgttgtgtttgaggccagggcacagatagccaatgcgctgtctttgtagaccttacataatagagggaaagtgggacaataatccaataagtaaataaattaaaattgtaaatgtcagaggtggaagtgctaggtagaaaataagcagggtaagagtagttgtgggggagtagaggtgcttttggtctggaaaggcctctctggagagatgacattgagtacactccgaatgatgtaaaggagctgttaatacatcttgagaaaatcttatgcaagagtgtaatgaataataagtaaacaggtcccaagatgacaacaagtttgattcatttgatttatagctaaggagtctgttatgtctggacagaatggtatgaaatgaggttggaaagatagacaaaagcagattatatttaggatattgtaggctgtggtaaagagttcggactttaagtgtaatagaaaaccattggagacttttaaaaagcaaaaagtgatgtgataggatttgcatttttaaaactgttactccagctgatttgggaagaagtaattgtaaaggggatggacagcagttttagaagatgggggtcagttctcagactactgcatcaaattataagagctctagaaaatttacatacaaatgttttacaaaattcatttaaacaatctttacagataatttacttaaatgaagataaattctgtttaactcctaaaatttatactgattttactgttttaacaaagcaaatttcgtactcattacctggaacatataccttttatttccctgccattctcactcaccccttcttgtttgttttcaacagtgatatcaaggaacaatattttattgtattgggatctgctttatggccaggctggtcttgaattcctgacctcaagtggtccacccgctttggcctcccaaagtgttgggttatgggcttgagccactatgcccggcctacaatacctgtattttaattcacaaaatcaacataaatctttattgatcattttgaaaaataattataataatatttatcagtaggctcttaaaacttaatttttgtggctgtctctttagaagttcatactattatgcctgtgtgcataaatgtatatttatatgtataaaatagtgtcaaaaacatttatattaaaattacttcacttttatcaaatattttataatttcattaaacatttactaataattattcatcctttcaataaaaaagtttaaaaatgactataattgaaacaattacattaactttctagcaaaaaatttagtatactgtgttcttttttttggaaggaaatttagttctcgctaaaaatgtatacatttaaaagtgctaagggttttgttttgctttgctttttaaaatatatatatatactatatgtacatacttgcaggagaaaaggactcattgtatggttagaatgtgatggttttaaaaaaacatggttttcattttttgtgttaaaaattgttagtaaagtccccatgaagtatagcaaatgctatagaaatactagaaggaagcattacctttaatgaaggctggttttaattactaagtaggtgtatgtactgtatgtgtttataaaatttatgtttggattctgaattcttattagagtaatttatgatggaattaaaagtcaaaagcaggggtaaactagtacaggaaatggtgagaaattgtggaattagggggaatgattaagaattggaatctgttacatccttttcaagaatacatatataagtgtagataaaaaagtctgagctcatttatggtatatttattaacagccctagcctggtaaaaaacaacattgatttgaacagttttggatattttccagctcctgtttactttgttaaaaccataaaaaaagtaatctggttccttttgacttaaataagacaaagaattcaataccgaggccctgtttataggttgttaaacatttcactttggtgtctgaggataatgtttagcattgtgttcaattagtgtgaactaatctaagttgaagtgtcagattcctaaacgtcttacttcaattaatacaaaatactaagggctccattcattccaaattattgctccatgggtgccagccacacagtctccatggcaggcctttctgtgggctaatcaagattcatggcctccaggttttgtggcactggcgttttagtatctggaacgtcactttttctttttgtgagcttctctgttttgatcccaggttctttctcccattctaagttatgtgtggaattgaacttgtatgatactctgatgtagttagaagtgagtataatttggtatagtatactggaaatctattaaattatataaattcaaacaaaactatatgccaatttaggatgttagtcttcagtagactaagtttctgtaagaggccagttaaagacaacagcaagtttgtttcttcctacctaccagtgttagggctaggtgttgattaagtggtgaagtaggcacattttttgtttggtgctttggcacctttttcagcatgtctgttcctagttttgtttttattatttttttcagttgcttatctttttaagtttcttgtgtccattgatatttgtaacttaatgtaaatatttgttattgaatgaaaaaaaatgctgaatgtccagcagaatacaataatgtacatgtggtttcaggctctgtgagaagaaatatctgctttggaggtgggaggaactttgaacatctcttaaattcaaataggcaaataagtgttctatctcatcatgcttgatctagaatcttactttggctttttttggtccaactctagttattctctgaagtggttacacggataatagagacattgctatagataatagtggtatggtctagtaaaacacttggtttctaaccttaattttctgttaaggattttagagctggaaaacaaaactacagcccttctataccttgatgaccccctttttcctagtcttaattgtgcctgtatatgcatgtatgttagcatgtatgattgtatgcatttgcgtatacatgtttacgtatttgcttcaaatctcttactgctttgtattcctttgactccagatctttgctctagctgtttcaaccttctgcgtgttcttttttttcttgcagatttctgatacttgtaataagagaatctctacaagactaagtgttgattctcttcctactaagagaagtttcaggaaatgcttttgattactgagttactgctatatgtatggtaccattaagcaggtagtcagtaaatatttgttgaacaaataattatgctttgatgtatgtttagataccttcaggatacttgatgaactgttttgttaactctaagaaaaatactagtaggaaatgaactcttatctattgctggtaggagtgtcaatttgcaaacactttggaaaacggtttgttacttttaaataaaaccaaacatgtacacatcaacccattctttaagtatattctagaaaaatttctaactgtatgtagaaaataggagaaaccagcaagaatatttagagcagcatgtttgtaattatgaaaactcaattcaactcgagggtcccttagtagttgaatgaataagtaaattctatatttatgcaatggaatactatacagtatataagcttaagttgattctaagaaactccaatgaattatttcttccaaatgcccttgctgttccctatttggaaattaagcaggtttaaggtttttttttttgttttttttttaacctagagttatagcttaactctaaatatgtggagcttttgtgtcttctaactatctgattttaaaatttaaaacctctactttgctcgtaaaaaaaacttagcataggtttgtagttgaaaggagcagcaaggttggtattattagcagaatttgcttttttctatacatgttccttattccttaatttttttttttttttttttttttttttttttttttttttttttttttgagacggagtcttgttctgttgcccaggctggagtgcagtggcacgatctcagctcactgcaacctctgcctcccaggttcaagcagttctcctgtctcagcctccctaatagctgggactacagtcgcacaccaccatgactggctaatttttgtgtttttagtagagatgtggtttcgccatattggccaggctggtctcgaactcctgacctcaggtaatccgtctgcctaggcctcccaaagtgctgggattacaggcgtgatccaccatgcttggccaattttttttttttttgaaatggaatcttgctctgtcacccaggctggagtggagtggggcaatctgggctcactgcaacctctgccccccgggttcaagcaattcttgtgcctcagtttcttgagtagctggagttataggcctgtgcccccacacctggctaatttttgtatttttagtagagatgtggttttgccatgttagccatgccggtctcaaactcctgacctcaggtgatctgccctccttagcctccgaaagttctgggattacaggcgtgagccattgcgctcggctgttatttcttaatgtttttgtcataaatactatacaactggttacattctgtctttggaaaaaatgtaccctaaattaatagaatgtaagtaattcaggaaatgatttcataattctccagacatctagaataaagaatatgggaatgcagagtgtatactccaagataatgattttattttaataaattgaggcaagttcttcagtgggcttctagatttcttaggatacaagtagcaggatacgtaattacaggtgacttgcagtataagtacatttttaaaaaaaaaaaattataaggagtcttgagggtaccagttccagcatttttttttttttaagtaaattacaaggagtcttgagagtaccagttccaggattcagtgatatcgagggcccaggctttttccatcccctactctgctgatcttgtttcatttgtgttttgctttcatgcttatcaataaattctatgataatgatgatagtaaggatagtgaaggacataaaatttcatctttctactgttttcctaagagggcctggatgaacaaactggaagttaggacatacctctttgaaagtaatgttctattgagatcatgttagaaatcatatgactaattcctgatgtggaaagagaatggcctttcatattgacagttcctccttgtgtcctgccatcccctcttctttccctactgtctttttcatgggttatagagattagactgtgtgtctgggtatcgctatcattatcaatgactcttggaactatagtatgggatgagtagctgttaaaccttttgtaattttaatttcttctaattttttatttaattgtggagactgggtcttgataagttgcccaggctggtcttgagctcctggcctcaagcgctcttcctatcttggcctcccaaagtgctgggtttacaggagtgaaacactgtaccaggctcattagatgttttaaaatgagttaaattcaaattattggagtgatctaatttcacccattttttatattgattaaataaattggtttgtataaaaggtgctaattctaatttatgtgtttagttacagttttcttttttttttttaaccttgggatgtgaccttctggtttcttctttctttttagattgtacatatatcctttaacaaattaggctttatttatttatttatttatacccttcctattgtgctgataggctttatttttttaaaccagtttttgctttatagaaaccttgagtggaaagtacagagagttctcatattactctgtttcccctatttttaaaatcttgcattaatgcattacatttgttacaattaatgaaccaatattgatgccttattattaattgaagcttatagtttacattagggataattctttgtgttgtgtagttctatgggtttggacaaatacataatgtcatatatccaccattacggtatcatacagaatagtttcactgccctgaaaatcccttgcagccactttttactgtctctatggttttgcctttttcagaatgggagaattgtttgttggtgtatccctcactagagtgtggtctgctggggatagggaatgtgttatgtatactattatatctgcaatgctatgtgcctggcccacagttaacattcaactcctcagtgatgaataaatgaataatttattgcctaagactaccatgaatataatttaatcttcatgagaggatatactgcatagtgattattataaacttacttgggctttggacatagaatacctgatttgtgatcctgagtttgccacatacagtgtgtccctgggaaagtgacttttctatgcctgaatttccttacctataaaataaaattaaaatagaacatacctcataggggaggggtccccagcaatactggtccgtggcctgttaggaactgggccatacaacaggaggtgaatggcaggctaatgagagaagctttgtctgtatttacaacctctccccatcgcttgcattgccgcctgagctctgcctcctgtcagatcagtgacagcgttaggttctcataggagcgaactcttttatgaattgcacatgtgaaggatctggttgctcactccttatgagaatctaatgcctgatgatctggcactgtctcctgtcacccctagatgggaccatctagttacaggaaaaaaggctcagggcttccactgattctacattgtggtgagtgtataattatttatttcatcatatattacaatgtaataagataaataaagtgaacagtaaatgtaatgtgcttgaatcatcctaaaactatctgcaccccctccccgccaccacccactgctggttcatggaaaaattatcttccatgaaaccagtccctggtgcctgctgtcatagggtattgtgagcattacttgagataacacatacagtacctaaggcagtgattggcacatagaaaagttaattaatgtttttaaaaattattattgttattagagttttgcataggcttatataggctagcctggcttatgtgcaagaattaatggaaagtccttatgatttaagagttaattagtagtatatatataagtggctttactattgtcactattgattataatgtacatgatattggattcattgtagtataacactaacaaaattaaactttgattttgaggtagtcttgactcttttaatatgcttaatgaagggtataatcagagataaacctctcaatatatgacatttgtctgtttagatctttgtaatgctaactacaattattagtgtttaacaacaactttattgaagtttatttaatatttaataaaataggcttgcagtagtccctgtctatccacaagggatacatcccaagacccctagtggatgctggaatttgcagattgtaccaaaccctatacatacatacctatggtatgtttttttctctatacgtacaaacctatgataaagtttatcttacacatttttcacaataagggattagtaacaataataaaacaaagccgttataacaatatgccagcaccactatttgtgcactttggggccattattaagtaacgtaagagttactcaaatacatgcaccatgataccaggacagtcgatgtggtaactgaaagggctaagtgctaactggtacatagcatctatagcgtggatacctggacagggacaattcacatcctgaggtgagagggggcaggacagcttaagatgttatcaaactactcataatggcaaacagtttaaaactgatgaattatttatttctggaatattccattgaatatttttggactgcagttgatcatggataactgaaactgcagaaagtgagactgaggaaaagactagactactgtatttacaaatacaattcaatacgttttgacatgtttatacacccacgtaaccatcaccacatactaagataatgaacctaaaacatcatccccaaaatttcttcatgctccttggtaagtcctccccaccactcacatacctcatggatgccttctattactgtagatttgtttatattttctagaattttatataaatggaatcatagaccatgtcaactttttctgaagttacttactcttgatccctctttacaaaaccagtttattgaggtataatgaagtataaaaactatacatatttaaagtatattgatacattttgacatacatatatatcagtgaaactgttaccacactcaaggtagtgaacatacccattactctacaaatttatttcctttggtaacctctcctttcagcttctccctcccactttcccaaacaaccactgatctgctgtcaccatggattagtttgcattttctggagttttatataaatggaatcatacagtacatactctctttttttatctggcctctttcagcataattattttgagattcatatattttattttgtgtaacaatggttcatttttattgccgataagcattctgttgtttggttctatcatgattcctttttctatttgttatttgggttgtttctaggatttgatgattatgagtaaagctgctacagaattcacatacaagtcattgtatgggcatatgctttcatttttttttttccctaggggtgctggttatattagttttctagggctgccataacaagtaacacagactgtgtggcttaaacagcagagatttattttctaacagttctagatctagaagtctgggatcaaggcgttggcaaggttggttttttctgaggcctctttccttagcttgtagatggctgttttctccctgtgccttcatatggcttttctgtccgtgtgcctgtgtctaaatattttcttcctgtaaggatgccagtcatattggatttgaacccaccctaaaggagctcgttttaacttaattacctccttaaagatcatatctccaaatacagttacattctgagatattgggggttaggactgtaacatatatattttttggtgggttggggtgcacaataaagctcacagtggaggttatatggagagcacatgtctagtattttcaaatttcgtttagttttgtttttagagacagggtcttgctctatcatccaggctggagtgcaatagcattatcacatctcactgcaatgcaaactcctgggctcagatgatcctttcacctcagactcctgagtagctgggactgtaggcatgtgccaccaggcctggcttatttatttatttatttttgtagaggtggggttctcactatgttgcccagtctgggcttgaactcctggactcaagtgaccctcccactttgtccttttgagtagctgggactacaggcgtgtgcaactgcacccagctgtatagctttagtattttaagaagtgtctaggctgttttccaaagtgatcataccattttacattcatgctggcattgtgtgagagttctagttgccctacatctatgctaacacttggaaaggccagtcttttaaaatttagccattctaataggtatatagtcatagctttaatttgaatttccctgatgactaatgatgataaataaaaaattaaattttatgtgattattaagtatcataggctgttctcagtgaactgtcttttcaaaactattgcatattttaaaattggattgtttttcttattatggggctttgagagctctttatatattctggatacatgtccttgattggatctatattttgtaaaaaatttttttccatactgtggcttcttttttcattctctaaacaatgtcttttaaagagaagtttaaaatttggatttaatctaatttgtgaatttttttctttattgattcacttgatgtgtatctaagaaaattttgcctaatctaaggtcataagagtttctgctatattttcttacttcatagttctagattttacgtttaactctatgatacagtttgccctaacttttatgttttgtgtaaagtatcgatcacagttcatttaatgtcattatttttgcatatagttaaacaaatgttctagcaccatttattgaagagttcatcttttttttttttttaacggaattacgtttgcactattgttgaaaaatcagttttacacatatatgtgggtctctttctggactctcatctctttcactgatctattagtctatgtttaaacccaaaccatgcggtcttgataactgtaggtatatgataactgtagcagtcatgtagtattagtcttccaattatattctctttaagtattgtttttgactgttgtaggtcctttgcatttccatgtaaattttagaacagctcttcaatttttgtataaaaagcctttgagatatctattagaattatatttaatctctagatcaattttggcagaattaatttcttgacaatattgagtattttgaccaatgaaaattgaatagttctgtatttatttatgttttctttaatttttctcagcagtgtttttacttttcagtgtacaggtcttgtatatttttgttaaacttaaccacaagtatttaatattttttaatgctattgtcaatagtgttgttttattagcttgaattttcagttattcattgctatttattttgtatattgatcttatatcctgcaactttgctaaagtcaatttttagttctagtagcttctttttgatatgtttcatagtatcctctatatagatgaacatgtcatctaagaaaaagagaaaattttacttctttttaaatctgtatgccttatgagagttaaaaaaatttttggaatggaagtttgattatgtcagatgctttttctgtatctatagagatgaacatgtgctttttcttttttagcttaatatagtgaattacattgcttgatgtttggccttgtatcctagaataaatcccattcagtgtattattcttcttatatattgttggattcagtgtgctcagattttcttaagaacatttataactatgcccgtgggggatattggtgtgtagttttcttgttaatgtctgcatttagttttgctgcctagacaacactgccctcataagaatgacttaagtagaatttctttcttttcaaattcctaggtgagttttgagaaatgggattatttcttccttaaatgtttggtagaatttatgagtgaagcaatctggtctttttttctttggcaagatattttactactatttcaacttttttttttttgaagacattagtgctatttaggctaagtatttcttcttgtgagagctgtggtagtttgtgtcttccaagcaatttgtccattttccattacatttaagttgtcaattaatagaaacaaaattgtacataatatttcctcattatccctttaatttctgaagagtttgtagtttgtgtcacctcattcctgataatggtaatttgtgccttctttcttcttttccagattatagtctgttttaggaaatgccttgtgtggatctgaaaagagtattctgcatttgtttagtgcaatgctctataaacatcaattagatcaagttgattaatagtattttttaccaggctcacatctttactgattttctctctactttttctgtcagttattagagaagggtgtggaaatctgtgactatagttacggatttgtgatattttattgtgaagttgtatcagtttttgattcatgtattttaaagctctgtttttagatgcaaaaacatttaagtttgttatgtccttctgataatttgtcccttttattgttatgtaacaacctttttcatctctggcactctatgcctatatctaaaaaaaaaaaaatcactgacatgaggaatgggaatactattattgactgagttaagtgaatgtctttgtaaaagaagatgaattatctaaatgaaatcagctttttgtgagaagagaggaaggaattggaggaaggaagacgaatgttgtatactcatccaacaattatttatcacatatgctaagtttgcctacttaaaaaaatttatgataattaaatgaaatgtcaaatttagatataattctttattcctcactctcaaatttgaaattaaacagactctcaattattataatatttggtattatccccatttaatggttgagaaagttcagctctgataggaagagggacactatcttgttttgaaacatagttgaagtataactctaaatctcagcattttttttttattattttgtttgctttgacgtaagtgtaagaagatagcatgatgggggaaaaaacctcatgcttttcttttgttaattttcattatgttaaaagaagcaaagcaagacataacatagtatgttgttacgtcatgtcacattgggtaaaacatgacagaacatatatttacaaaagtacactcttctttagagccagatgactgctctcaatttggaaacaaaccatctgcttatcatttaaattcctgaattacttaccagcccacatctctaaacagaagtaacatactgttacttcttaaaaccgctgttaaggtccattgtctccatatgtaatgcatatttcctgtgtactgaatgaaaacaggttagacatttatgatgtttaaaaagaccaagttgatttctttttttttttttttccttttagactgagtctcgctctgtcacccaggctggagtgcagtggtatgatctcagcccactgcaacccccgcctcctgggttcaagtgattctcctgcctcagccttccaagtagctgggattacaggtgcccgccaccacacccggctaatttttgtatttttaatagagatggggtttcaccatgttggccaggctggtctcaagctcgtgacctcaggtgatccgcccgccttggcctcccaaagcgctgggattacaggtttgagccactgcgcccagctccaaattgatttcattaatatgaaaagctaatgaattattttttcagcatttgaaattgctttaatgtagttaaggaaatatttgttcatactttgctaaaccacataccccaatataatcagtaaataagcacttacttgacatagtccaaacaatgacttactcattagctcttacatcttgcatttattcaatattttttgagtgtttatcaggtgtaagtggcagaggtatattagtgaaatagaatctatattctagtgagaattgtaaatgaataattagttactatatagtatgatacattgtggcagaagaaggattcaggtctgacaactttttgcttggacaaatggtggatgggaacacaggtgcaagagcactcatctgcaagtaaaggtgagattggcaatgcttgtttgccaacttgctggtttttatatagagtacatatttttcttcatgatcaagttaagtgtatactagagcagtggttcttaattggtgacatgtggaattttgtatggaatgcagggttttcataacttacttatcttggatccccagcgtacctacgagtatgacatgcaggctctgtttcatctttcctggattattcatctctagtatttattactggctttagtatttctgttgctttcggcagcttccacctctgctcccagtttctatgaatttaagaagtttatatgaatttaagataaaatctatctctaaagcatatgaatttctttctaaagcatctgtgtccttcctaaaaaatttttcattaatgtagtacccagatttttcccaatgataagggggagttgaattaccactgaattgagagctacttttgggtgggactggggaggagggacaggtagtattttgagaaaacagccttatttatatttaatgaacttcatgtattttaagtttacagtttgatgagttttggcaaatgtttatagtcatgtgactataagcacaatcaagatatagaatatttctctcttccttaaaaagcccctctttcccctttgcggttttctcttcccatgtcctagatcccaagcagtcacttgtctgctctctgtcactaaaattttggcttttctatagctcatataaatggatatatgttttcatttatcttgggtagatacctagggatagaattgctgggcctcatggtaagtatatgtttaaatttacaggaaactgacaaattgttttccaaactgactgtaccattttgccttcccgccagcaatatatgagagttccagtatctccatattctcactatcacttggtattgtcattctttttacttgttctagtgcatgtggagtggtatcttattttggttttaatttgcattttcctacagactaataatattgaacatctttttgttggctttggctattcataaatatttgtgtgtgtgtatacatatgcacatatattcatatatagtatgtatatgatatatgtagatttttttgttcaagtatctgttgaaatcttttgatcatttcaattttttgggttgtgtagcttatttttgactagtaagagttatttatatattttgaatttaagtgctttgccacatatatatttgcagatattttttcagagtttgtggcttactttttctttctttctttttttttgtgtttgagatggagcctcactctgtcgcccaggctgcagtgcaatggtgtgatctcagctcattgcaacctctacctcccaggttcaagcaattctcccgcctcagcctctgaagtagctgggactacaggtgcatgccaccacgcccggctaattttttgtatttttagtagagatggggtttcaccctgttagccaggatggtctcgatctcctgacctcgtgatccgcctgccatggcctcccaaagtgctgggattacaggtgtgagccaccacgcccagctgctttttcattttttaaattaagtaatgggctatcatgggcaaacaatttgactgcaaagagcaaaaggtttttaattttgattaggcacattttatcaatgtattagttgttctgcctccttctatttatgttatagttacaaaggtagttttaaaggtccctggtacaaggagagggaatatgtatgggggacagtcaatgtcacattttaagaagcacatgtgggataggatatatattttggtgtgggcatctttggatggtataatctgcagtgatgaaattttttctttaatatttgtttttttatccccaatgtagtatatctttgctcaaatcaagatcataaatgttttctccagtgtttttcttccagaagttttatgttttgagctctaacatttaagtctgtgatttattttgagttagtttttgttatggagtgagttacgggttgaggttcatatatttccgtttggaaattccgttgtttcacctctgttagttgaagaacctattgattctccattgaattatattgatatctttgtagaaaatcaattggacatatagtgttgggtctatttttgaattctaactttattccactaccacactgtcttgattacttgaatctttatagtaagtcttgaaataagtctgccaactttgttctttttttttttttaacattgttatgactatcttgtatcctttgcatttttaatataaattttatactcagattgtcattttctgcaaaaatgcctgttaggttttgattgagattgctttgactttatgaacaatttgaggagatttgataatattaaatctctgtttatgtacatagcatatttctgcactttcttaggtttttaatttcttgcagcattatttttcactttttagtgtttaggtcgtttacttcctttgttaagctttattcctaaatgtttaatatatttgtattctaatggaatggaaatgttttctaaaatttcattttctagttggtttttggtaggatacagaaaacaattgtgtattgaatacgtacattgtttttaatgagtttgctaaacttatgactagatcactttcttatacatttcttaggatttttctacctgcacagtcatgtcctgtgtgcatttgtaaagttttattgcttctttcccagtgtttatttttataatatcttttctgtgttttatttcactgggttagagcatccggaaaaatagcaaatagaagtggtgagagtggccatcctgaccttatttctcattttaggtagaaagttgttcacttataagtctgatgatagttgtcacttgtcaaatcaaggaagtttcattccatagcagtgtctaccctgcagacagaaactctattagttattagaataggaaaaattttaaaaatttaatattttaaaaaagtaaacatttaaaattaaaaaaatttaaaatttaacaaggaaggcaaaaactcacagttcttaccttatacagcagcagtcttttatgttttcatataaagaaagattagctattgaatggtgtcttaattactaaaaggggtacaagaggaatctgagggatctagcagtagcaggtaaaagctaggggaggttagcaaatgaaggaacccaaggacttgagagagggtcctcctccccaaaccccctcaggctttgctttagatctctttaaagagagtttgtaactcattatttgctggtagtgtagaaacttgctagagggcatgggccacaggtggtctgtagaagagtccactcttgccagagcatggatgagctcgagcaggtctgtagaaaatgcctgctgtcttggtagtgttggtagggagttgcctaggggtgcagctgaagctactgtggaaatcatcttcaggaagttctcagaagcagcaactagtttaggagagcctcgcttgagggcatggatagagtactgtggaagcagcctcatgtagctgtgctgtaagtgctactggaaaaggctgatttgtgtgcaaaagattcttttggttttcccctatctcaattattatttcatttgcatttttcaaaaatagttatttttggatgtagaattctggattgacaatccggcatctactatttgtgtcgagaagtctgccattaattgtgttttctctccctaagtataaagtgtttgcttttaagatttttttctctatctttggttttcagaaatttgagtatgatgtgtccatgtgcgaattgctttgtgtttttcctttttggagttcttttagcttccagatttcctcctcctcctcctccttcctcccttctccctccttcaccccttcctctcctctccctcttgtcctctttttttcccatttccctttctttttcctctttctcctccttttacttttccttctgctccttttttctcttccttctcctttcttcttcttttcttcctctttttttcttcaacattcagaaggtttttgacaatcatttcattttttttttcttcctccttttctatctcctttcctgttgggacctcaattacatgcattgaactatttgatatttcttggtctctgagtctttcatttctcttcagtctttttttcctcgatcttcttcaaattagaaatttctggtatctatcttcaagatcactgattatttttctctgccatctcaactattctgttgagctcatctagcaaatttttatttcagtgattgtacttttttagctcagttatttccatttagttctttgttatactttcctttttctgttgaaattccttatttatccatctattaaataacatattgccaagaattttttgaacatgttttcttataacttttgagcatatttataaaagctattttgacatctttgtttttgaaatgcaatacctggacccatttggattcagtcttcattgacttcttttctttctttctttctttttttttttttaagctgaccatggagcacactttcctgttttgtttgtttgtttgtgtgtctagttgtttttgattggaaattggacattttattctatatatttccaattggtcctccaaccttaagttctgccctctgaaacttcaagccagtaggcttttgctttctttcacctgagctgtgtgcagttgcagaacataacttagtgaaaggtgcagcaaacacacagcagctttgtcttttaggtgtagaaccctttctagtttttgcctgactttttgtcaggctcctgagtatttccaacatgtatgcaaaattaagcagtcagtcaagcttttgagtagaatttatattcagaatttgtgtctcagtctttctgtggatctttcccctccagaatttccttcttaaactatagttgctctaatttttgaactttgacatgtaaccactttgatgtggtaaggatatagttttctgctgtcagaaccgctggggagtttggtgcgcaccccttggcaagaaaggcaaaaactaagttcttacattatacagtagcagtctttcatgagtaaattctgctcgcattttgttgttcttccaatattgttttaaatacttttgtccagattttacattgttttctgtgagacgaatgatgtgacctttacctcaccattattagatgttcctgataaatttcttttaaaatttcaaaactaatatatgtacctgattaaaaaaattgggaaaatagtatagtataaaataaaaaaaactacagaaattattagtagagctgtaaattgtatttgctaagttattgcttattaaaaaaaacaaacaggtaaatatttacaatgaattatcctgatgaatgcatgcctatccgagtagataaatacggtgtttttgtgttaaattaaatcagtggttagcatgcttttttttctaaagggccagtaagtgtttttggctatgcatgccatacagtctctgttgcaactattcaattctgctattgtagtttgaaagcagccatagacaataggtaaacaaatgggcatggtggtgtgccagtaatacttcatttatataaacaggtggcaggctgaattttgcctgcaggcgttgcttttttgaggaaagaaagtcattcccttcatgggaaatgtttggtaatgtaaactgctgtttctcatcatgagggattactccaagtgtcaatttttcatttgtaatgaagaaagtattacctttaatcttctagttgggaacatactttggaattcactctatctaaccataatgttttactgtatgtactttgtgtgtgaaagtgtgtgtgtgtgtgtgtgtgtgtgttttctggctactttcaagagtttttttttttatttagattttataattttgttagtgatgtatctgggtatggtttttcttttttattataaattcacaattcataattgtatacatttattgggaacaaagcaatgttataatctatgaatacaatgtggaataattaaatcaagctaggtaacatatctattacctcaattacttaacttttttgtggcaagaacatttgaaatttactctgttagcaatttggaaatgtgctgtactctattatcaactgtattcaccatgtagtgcaatagtactcaaaagaagaaaaataaaagccatatttctctggagattttctaccctttgatcaaatctcctcatttccccacctccagcctctgtaaccaccattctactttctgctatgggtttcacataagtgagaacatgtgatatttgtctttctgggtacgacttatacagcataatgttctccagtttcatccatgttgtctcaaatgacagaatttccttcattttaaagggtgaatagtattccatagtgtaaatacctcaccttttctttatccattcatctgttgatggacacttaggttgatttcataacttagctattgtaaatagttgctgcagtgaacataggggtgcagacatctcttcaacaaactgatttcaaatcttttgggtgaatacccagcagtgggattgctgggtcatatggcagttctatttttagtgtttttgagaaacttctatacttttttccataatgcccgtactaatttatattcccaccaagagtatataaaggttcccttttctccatatccttgccaacacttatctttcatctttttgatgaaagccattctgacaggtgtgagatgatacatcattgtggttttaatttgcatttctctgctaatttctgatgttgatttttttttcatgtatctgttgaccatttgtacgtcttcttttgagaaatgtctattcaggtcacttatccatttttttcaattgaattttttgttttcttgctattgaattgtttgtgctccttacatatttgggttattcattctttattggatggatggtttgcaaccattttctcccaatccatgggttgtctctctactccgttgttttctttgctatgcagaagctttttagtttgatgtaattcccatttgtctatttttgtttttgttgcctgcacctttgggatcaaattcaaaaagtcattgcccagaccaatgttgtttagtctttatcctgtgctttcttttagtagttttagagtttcaggcctatgtttaagtctttaatccatttttcactgatttttgtatatggtgtgagacaaggctctaatttccttctcccgtatgtgaaaatccagttttgacagcactatttattgaagacactgtccttttcccattgtgtatttgtggtacttttgtcaaaaatcagtggaagccatgtgtggtggcatgtgcctgtaatcccagctactcaggaggctgaggcaggaggattagttgaactcaggagttttttgagatcagcctgagggaatgtagtgagactcagtctcaaaaacaaaaattggttgattgtatatgaacctgctttagcctctggagtacttgggagtagtgcatcaccatgccaggctaattgttttatttttattttttagaaaataaaactggccttaagcgatcctcctactttagcctcccaagtagctgggaggctacttccgtgtgtgagccactctacctggtgatttttgcttttcatattcacagctatgattagcgttcctttgtttttggtttttcattaatccatcacatatttttacatttgaaaagtcaaaattagtatttgtcaaacatccgttaatctcaaaaagtgctgtactaaactagaccttggattcaatgttttacgccatctaactctttatggagtgttttcacgtatattaatacctgcattgaccactttcaggcaggttgatattaactgtgaccatcttacagacaaaatcaatgtgtagagagtttaaatgacctgcctaaggttgcccaagtagtaaacaattggaaatgagataactagacatctagttgcctaataggaaataaatatctgctaaatacaactatttttgtatttatatttataaattgcatgttaaattgacccactgaaatctttctataagatgatgcctacgtgattaaaggtattgtaagataatgattgaaatatattataataatactcctcacaccagtaatcccagcactctgggaagccgagacagggggatcacctgaagtcaggagttcaaggccagcctggccaacatggcgaaaccccgtctctactaaaaaatgcaaaaattagcctggcatggtggcgtgtgcctgtagtcccagctactcgggaggctgaggcacaagaatcgcttgaacctggcaggcgaaggttgcaatgagccgagatcgtgccactacactccagcctgggtgacaaagcaagactgtctcaaaaaaacaacaaacaaacaaacaaaacttttagtgtaacaaaaattgttacttcttttttaagagaaggagtctctgaatattgcccagtctggcctcttaactcctggactcaaaggatcctcctgcctcagcctcctgaatagctgggactataggcatgtgccactgtgcctagcttactgttattgttatttttattattaccaaacaatgtgtgtgcatagcagaacatagaaaataactaaagaagaaaatcacccagagattactgctgttatcacctcagcatacatccttacagatctttttgatttgcacacatatacacaaaaacacacacacaaaagtccaatccagaagtttgcatttattacatctaggttttatgtctcttaagtctcttgtctagcactgttcttaaaaacagtctcttgttaacttattatttttttgagacaaagtcttactttgttgcccaagctggagtgcagtggcacaatcttggctcactgcaacctccacctcctgggttcaagtgattctcctgcctcagcctcccgagtagccaggactacaggcacgcaccaccatgcctagctaattttcatatttttagtagacatggagtttcactatgttggccaggctgctcttgaactcctgaccttgagatctgcccgcttcagtctcccaaagtgctgggattacaggcgtgagccaccacacatagctgttaacttatttttaaacaaagacattgtagacagttatttccctctgtcactgacatagaatgaatgtttttagtattaatcatcttagatgtaataaaaactcaaaagaaagagacatttcaatcaagaatttactataggtaaatttacaaatgctgagaattagctctgaattcattatttttgacccttgttagtagttctttaggtacaaggaaatgaaaagcaatctctttagcagaggtcaaaagaaagttgtacacttcagtgctttcccatagaaacaaaggaagcttagctgaattggcagaatgctattagaatgagatatccttaaaaatgttggtgggaagagctgatgaaataaataagttgggaacaaaggattgaatttggtattcttcttctactggagaaggtaccgaaaaagaatttgatcctctgattgcctagggttttgagacatgagaaataatgtactttgatctggttttgagaaattattgcatattttattttaagtgcttgctgcctctgcctttccccttttgctcctcaaatatataaagtaagtagcctgacctacaggaggactgttaaaaatcatatcactagattaaatagaattaaaaaagaaacaggaagattgaagatgtagtttaatatatgtatcattaataatagaataaatacaagaacataatgggtgagaaatttatttcttaataaaaatttctgagactagacctttcaacatttagttatacatactttaataaaaatctatcatagtaaatttataatttttgtttgagtatgtgaataatccttctgcgcattattggcctgttataaatctttcaatgaattgtgggttggagttaaattcatattgtgctgaatttacaaaatttaacagtttgctttaaacgttttaaaaattttctaacttagcaccaaatccccccatacctttgtgtgtgtgtgtgtgtgtgtgtgtgtgtgtgtatgcctgtggagaaaagttccagagattcttatttctcatttaaaaaaagttagaaaaaatttagctcttatgtataaattacatgctgtattttactaattaagtctatagccttgcttaactttgtcttgacaacttctaaactgaatctttctatttttctaatgccataactgtgtggatttgcaacaacaaagatctgtgtttttcaactttagctgggcttaagtactacttagcaattctatgttctatttacttatgtgttcctatactctcacccctgtccttaagctagtgtcttcgtcattctcagaggtttattcttctaattcagagagggagagggaaggggaagagaaaaggggaaaatttacacagtgggagagggtcagggaaagggagaggaagagagtttagttatatttgcacctgctttcttttaacacagacaacagattgctatgtatgttcttaatattgtcttaaacaggaatctttctcagtcatagccattttccttcttgtatctgtaatttcttccaccttactgagcactgacttctacttagccagtaaaaacatgtttaaatatcttctctcctaaaaatatcctgttaccaattttctctcaactatgattctcattctagccacaagtcaatctccttctttacctttattgtcaaacttttcacatttacttatacaatttatatcttctcattcagtcctcaactatattctcatctgcactgctctattaaaattgtaaagtatttgacctattggacactgttgattacttctataatagttttttcaaaatgtaattaaatatttacatgtagtttaaaagtgaaattgtggctgggcgcggtggtgcacgcctgtaatcccagcactttgggaggccaaagcgggtggatcacctgagggtcaagagttagcgaccagcctgactaacatggtgaaacctgtctctactaaatacaaaaaaattagctgggcatggtggcacatgcctgtaatttgagctacttgggagggtgagacaggagaatcgcttgtacctgggaggtggaggttgcagtgagccgagtgcaccattgcactccagcctgggcaacaagagcgaaactctgtctcaaaaaaaaaaaaaaaaaaaagaaaaaaagtgaaatggtatgctgcaaaggttacagaaaacagtagtattcttttctactgcttctaacacatgaattccacaatgcagaggcaaccacttgcagtctttgccttatttcctctgttgcttcgttgtatctaaattaacttgcctacactgctattcttgttttggtttacacattactgacttcctactacagaagatgggaatttggttttctttacactctgtggtggtgtagggatgttcacagtatggtaatacataaattttgtttaaaatagtatttaatgtttaacatattctgttcaaactgtgtaacaattactcgtagctgagccattgtacaacttttcttgctaccttatgtttttttcatagttaataattgcctcactttttatttgcttagtttctttgtacctattactaactccctaactttgtgacataagattcctttcaatattttcaagaacacctagtaatttttcagttatatttttccctctgtggagctacatcatttgtttaagtttgttatcttgttccggtcttgtctgactgcttgagacttccgtttacctctgtaatttgttgaatcccagttgtctttttggatttactctgtattttactgcttgtggccgtaggtagatatttttagatctttagatcttgcaaatctggaaatatttttatattattttcataattaagagtttgattaatacagatttctatgtgagaaattccttaccttccaaattttaaggcattattttattgtcttctagttgcaagtattgctgttgagtagtcccgggttgttttgattcctgtttctttgtttaatgaaatttcaggatgtggtttaatgtgagtctctaaaaaatcactgtgctgagtatgagtacttagcaggctctttcactttgggaattcatatccttgtattgagaaatatcctagtgtaattttgtgtcctctactctatttctttgtttttctgtttgaattcctggaagagtttctcaacttttatttggaatttttttactaaaatttatagttttgctgttataatttcttagagtccttcagttctctaaagggttccttttcttataacatcctattcttgttttatggttgcagtggatgtgtttttgtgggtacttttcagaaatttcttttgatcttccatttaatttatttcttccacatttcttttttctgtttattttgctctgtctttcctgttaaaggaattccttaaatgcctattgattcttgtttgccttttatttaaaagttactttgaagcttatggaagctcactgtttttatttgtgggtcttttacctatttcaatgtgtaatttccaaaagttagcatctacctatttcaatatgtaatttccaaaagttaacatcttgtgggtcttttttcttgggctgcttttttttttcctagagagggatcctcttattacctatcacgagaatgggaaagtggttgggatataagcagagttccactgcttttggatcaatggaaagagatatagtaggtggtgaggtgggatggatggtggcctaacattcgctgtgtatggtttgacttaatatcccatcgttattagtatagtgtctcacttctgccctaattatcctacctctgttttttttcctttagggaatcttctcttagtatgagagggaggtgatcggtgtctaactgggtagacaagaagagaggagtctaactcctttttagactgctttgcagccaatccaccagttctcagtcttacctgcattctggctttctggtgcctttctattgatgctcctaattcctaaggttctgctgaacaaattagcatgtcttctgactcttcagagagtgaaattgtagctacctttgtactgttaagtcagttactctcttgttcatgctccaaagtttcattgatattttttgtgttctgtctgtcccttattgtgttctttttttctttgtggtttatactcttttatttccttctgtcatttttgtagtatttctggagggagtaacgttaagtctatatgttcactgtagtatatttaatgtaatggcttttcttcattttgaaattctttactcttgagaaattgtttactcttgacttctaggattttatttttctggaatgccttctgattctcaatgttactttattttttgagacggattttcactcttgacgcccaggctgggcttggctcactgcaacctccacctcctggttcaagcgattctccagcctcagccttccaagcagctgggattacaggcatgtgccaccatgcctggctgattttttgtatttttagtagagacgggtttcgccatgtcggtcaggctggtctccaactcctgacctcaggcgccccacccgcctcggcctcccaaggtgctgggattacaggcatgagccaccgcatccggcccttatgttatttttgagtcttccctgctgtatccttttcttttgcctcattttatatgttgttatttcctattattcttttcttctgtttaactttcttgatttgcctcatcaagttttctggttataatcaactctttatacactgatgacaccaaaatgatattgatagttcttacctatactctgaggtccggttccataatatctgttaggcatctttttttatgcatctcccacatatatcagtttccttacctcttctccagttctccacctcttgtacccttggattttatttgatgtatgtttagtttttaaatttaaaattccgtgatgtttctaagtttataaattcttaaaatttatatttagtagagcatccttcaaattacatatttttgattattaaaggttagaaatgcattcctattatgccaggctagaaaaataaaagcacatattgaacagaggaacatgcaccctattcttgtctcagccatcatgcactctcaaccatctcatgaagtctttttccttcagccccactggccatcttatttgtactcaaacatgccaagtatgatcctacctacaggctcttgtggtcttttgactagaaccttctttcctccagttttcaaattagttgatatattgacatcttgtagagggggttttggcaaatagtaggtatcgagttattgtcagcaagtattactgtcattatcgttgtaatatccatactggctattcactttctggtttcacttagtttccattcaaattatcttctcctaaaagaggccacccttgatttactctatttaaaatatcccttctacctcattgttattcatatgcttattatgcttaatttttttcattgcacatattcacatgcatatgacttatttatttctgtagttatttgcttccactttcccctagatgtaaactccttaaaaataagggcattgtcaaattgactctatcgctaattccttcaatttgccctttacagtgcttatgaaataattgttcgataaattctaaactaaccaatcaatatccttttctttctgtatattacagtgttctacactgtatcaatggattttccattaagtactctttagatacaatcctaaagaatgttttattagggtctaaatcctcagcagttgtaagatggggaagcattggaaataagaataactattttttttaattgtggtaaaatatatacaatgttaagtttactgttttggccatttttctgtgtacagttcactggcattaagtaaattcacattgttgtgcgttcactactactatccatctccagaactttgtcattaaactgaaactctatgtccatcatatagtgcctccccatttctcctctctcagcctctagtaaccactgttctactttctgtctcaatgaatttcactactctagatacttcatataagtgaatcattcagtatttgttgttttgcttcttgcttagttcacttagcataatatcttcagtgctcatccatgttgtatactatatcagaatttcattcttttctaagtctgaataatactccattgtatgtatataccgtattttgtttattcatttattcattgatggacacttgggttgcatctacatctaggctgttgtaaataatactactgtgaacatatgcagatatctctttgagagcctacattcagtagttatggatatatacccagaagcagggtggctgggttgtatgataattcgatgtgtaaattttaaagtaactgccttactgttttccacagtggctgtgccatttttcattcctatcagcagtgtacaagggttccaatttctccacatccttctcaacacttgatatcttctgtctttttgataatagccattctaatggatgggaagtggtatctcactgtggttttgatttgcatttccctaatgattagtgatgtggagcatcatttcatgtgcttattggctatttgtatatgttctttggataaatttcttcaagtcctttgcccagtttttaattgggttgtttagtttttgttgttgagtagtaggagttcctaatatactctggatattaactcctcatcagatatgcaatttgcaggtgttttctatttcatgagttgttttttaattttgttgatagagtcctttgatgcactaaagtttttaatttttggtgaaatccagttttatttatttatttatttatttatttagagactgagtttcactcttgttgcccaggctggaatgcagtggtgcgatcttggctcactgcaacctccgtctcccaagttcaagttattctcctgcctcagcctcccgggtagctgggagtacaggcatgtgccaccaagcccagctaatttatgtgtttttagtagagatggggtttcaccacgttggccaggctggtctcgaactcctgaactcaggttatccacccgcctcggcctctcaaactgttgggattacaggcgtgagccgccatgcccagactgtttttagttttgttgcttgtgctttcggtgtcatattcaagaaatcattgttaaatctaatgtcataaagctttccccttatgttttcttttaagatttttatagttttaggtcttaaatttatgtctttgatccattttgagttgatttttgtatatggtagaggtaaaggtctaacttcattcttttatatgtggatgtaactgtaagaggtccattgcccaatgtgtgcagcaagtcagtacaccaagacatcagattgtagcagagagagatgtttaagtttagggccactgactgaggagatgaaaggaaacctcaaatccatctccctgtggaatttggggctagagttttgaaggcttttggagtgtgccagagtttggagatggttggttggtccaagagtgcagggtgagatcatgggacagggagacaaaggaactgtattctcatgctgatttggttcctctttggggatctttaagttggttggtgtcagctgttttactggaattcaggatctgtttaagtattccatatcttgaataagcaaaagccttatgattctaacatcagagaccctatctgtcttaaaaaatgtcttacaaccttagtgtcagaaattctatctatagtaacaatggggattcaaatggacagtatgtactgtttctagactttttcttacaaggaagtgggtcaaagtgcagctgatttatgcttaattataactatatttctattcaaaattcttgttaagcctgtgaggacagtttcatggatttccagttttttaaagtacttttgaaaagattgtcctttgtgcactcaatagtcttattaccctggtcaaatatcatttgatcatatatgcaaggttttatttttgggttctctgttctattccattgtcttagatgtccatctttatgatagtaccacatatttttgattactgtaggtttgtagtaagttttaaatccgaaagtgagtccttcaactttcttcttcttttttcaagtttgttttgtttatttggggtcccttaacgttctatatgaatttcaggatggatttttctagttctgcaacatgtgccattgggattttaatagggattgcattgaatctgtcgatcactttgggttgtattgtcatcttaataataagtattccaaaccatgagcacaggatgtctttttatttatttgtgtcttcttcaatttctttcagcaatgttttgttgtcttcagattacaagtctttcacttccttgttttatttttccctaggagtttttttttatgctgttgtaaatggaattgttttcttaatttccttttctgattgttcattgttagtgtatagtgagcaataactattttggtgtgtcacctaatatatgacattactaaattactttatctcctgtctctatattagtagcagataagtgatttgaactaaattcaaatggaaactaaattcagaataaatgataacttccaagttgaatttaaatgctacatttgaacttaatttttgttcattaaactaaggtttaaacttgtctaagcaaactaattcgaaactatagtcctggaagaataccagattatcaaaataaccatttgaaacaattaagtttgagctcttaaaagattgtgattatgatatttctggggtacaatttataacttctagctcttattgtgccttgtagatggttctctagttgcgttgcatttcttttctttctttctttcttttgtttttttttttttttagacagggtctcactctgtcatctaggcagtggctcaatcatagctcactgtagccttgaactcctggactcaagtgatcctcttgcctgagtagctaggactataggcatatacaacttattgatcgttctctagaagttgctggatatataatagtattgaatgtttttcacatttagggtgtgggatatacaattgaggagagattgtagatcatatatttttgctgttttttttttttaatttacaggccacagaaacactattcagaatgggtgtagcaagaggaaccatcacaacattaagaaatggagaagtaagatgagaattttgatatagttattagttgttaatttatagtttgcgattttaaaatataaaatgtgatgaaatctatgatgctttgtctaagaaatagagagatatctgatgtatataatattgagtgtacctgatgaacaaatccattttaattcatagtcatgttggaaccagatcttagattgaaaacaaattactgtctttttacctttagttatcaaatatctttactcttaaaaaatgacattttattagtaacttctacaaatgtttgtaatgaaaaaaagaattccttagcttttgctttctttctattttgtgttatacagaactgatacttatttcttaagataaaataatcggaaatgttgaacatttactacacgtggagagaagggaaggaagagggagagggagagggagaaaaaagctggagaggattttgtctgcagatgctaagttttgactttttaaaatgctcctgtcaatcctttagaagatttttctatcacctcacatacattttcatgttaaaattattaccagcttgattaccactttgtctgctctttctttattttctcctttactaagacaaatttaggttgaggtcgaatgtaacaccaaattgttatgttcctttttctattctaatggcaaatacttaaggataaaatacagaaatccctatttttgaggagatggggtcttgctatgttgcttaggctggtcttgaactcctggcctcaagcgattatcctgcctttacctcacagagtgccggcattacaggcatgagccaccatgcctagcccttagaattccctattcttgaattaagtttgatgttatttaatgtaatatttataattcagaaacctaaatatttagtagtggaagtgagtatctaaggagttaaacagaattgtattacttcatgactataaatgtgttggttgatgtatttgctcattaggcagaaatgtgccaacatttgaaaagtatgtacactctaaatatttaattatatatttgcaaatcaccttggtataatttttttttttttttgagacagagtctcactctgtcacccaggctggagtgcagtgtcatgatcttggcttactacaagctctgcctcccaggtacatgccattctcctgcctcagcctcccaagtagctgggactacaggtgcccgccacaacgcccggctaattttttgtattttttttactacagacgaggtttcaccatgttagccaggatggtctcgatctcctgacctcgtactccgcccgtcttggcctcccaaagtgctgggattacaggcgtgagccaccgcgcccggcctaaccttggtataatttataaagtatattttgtctatacagaaagacttaattgatccctttgtattctcaaacattgaagtatgtggtgtcattttgaaaaaagaaaacttacagcaataaggtcagatgtagtaatctgcctatgatgtctaaaaatgaatttcagattttagtaattactatatatttttttcatagggtgggcaatgaactgttgaacttatcttcttttataggatggttagggaaatgtatgcagcacagctgtataagtaatcacctgagcatatcaacgcattggatatatacttattttacttaataggcaggaaatagttaaaatagctggcttttgatcaatttttctactaattattaggtgttgttccatgtggccaacctggttaacaagtattagtgtcagacaaagtgtttaagcactctctgaccttcagtttctataatgaggttaaaagtgtaagatgtacatatatttcttacattttaagagctctgaaaatggaatgtgtcttctaattaatggcacctcatagttaccatctgctattcttcacattttaatgtctctaaaattaggaaatttctttttttccccactgacttttttggttctcaggaaatttgtctgtggtatgtcagggttgataaaataatattttgtggtttaaaaagtatagagtgatgtgtagcatgcattcattaaatggtagttaggataggccactaattagttttaatttaatgatttgatttttggaagtagaggagacaaaacaaatcaaagatactactgaatacacacacgcgcacacacacacacacacacacacaccatagattttccgagacggttggctaaatgctatggaaatgggtgctatgattcctgactttagaggagcttactctctggtcggggaaacaattctatcaataattggaaaaaggaaaaagtctgggagagtgtggaaatagtttaagttgagtctggaactaaccagtgtccagattctacttggattgtgctaaatttaaactgtgttttagtataagaacaatggtagataatctgtttgagagtaggagtaaactaaaaggttaataatttaaaggattatttaaaatacaacctgaaatcattgtatttatcaatattggaaaatttataatatgctaagggaggagagcagcaagtggttaatttatttgtcctagggcatttaaaaaaatgtgctaggccagtactgcgaaaatatttgttaagcggggattcataggtagcctcatgacaagtgtatcaggtaagagaaaaaaagttggtatatccaaattacaaaaatatcagtctttcagtgaatttatccagatacatgatgacaataaactttgcatgtgtttcctcctccctgttctggctttaatgctgtattttgtgtacttactggacatttctgcttagatatttgaagaaattttgaaatgggagaagattttccgctctctgaaagtaagatagtctttgaaggtgtttgaaacttattttataggttatagtgtattataggaggtcttaagcagaggagtgatactttatcttttaaaaatcctccttttaactctccaagggagaaattacactggtcatcttatagatgaactgaggctcagagaagttaaacattttgcctgtggtcaaatagctaggaaattggagagctaggatttgaacccttgtctccaaagttcattgattctactatgcaatataattgccctgaatgtacagtaattcacttacttagactagagtttcctaatttttattagctgtaggtaattattattagtttgacagttgaaaaataacattgcagttaaagtttccaagataatcagcaatgacttttatgcattctaattattactattatcttttcatgttcacagaataatatatggcttaaaatgaataggaaaaaaatacccttcacaaatctattacctcattaaatgtttaactatggtgatgttctttataaagtcctgtataaggagtagctggacctttgtgcattaattgactcacataagctggaaaggagatcatttttctgtgttgaattttgtttttgagatggagtctcactctctcgcccagactggggtgcagtggtgcaatctaggctcactgcaacctctgcctcccaggttcaagtgattctcctgcctcagcctcctgagtagttgggaccacatgcatccactaccacacctgactaatttttgtttttttagtagagatggggtttcaccatgttggccagcatggtctccatctcttgacctcgtgatctgccctcttccgcctcccaaagtgttggaattacaggcatgagccgctgtgcctggcctgggttgaattttttaaatgggtttccctatttgaggggctaacttttaaaataatcattaaaattaatgaatgaactgcagattcaataatcagtagttattgaatgtgcttggttcaaaagtggtatttttctatttctgacagaaagatgtagttctgtcttctgccttctgggtgtttgtgtttagggtgaaacaagtactttgttagaagataaggttactctcttaaatttatatattttaaaaattatctcttttctcatataacttgagactaaagcagaaattggtgttttttcatttggtttttcttaatctcaatttttgaaagagaacaaagtttaacaattctttaccataggaaggcaggatttcaaaccctgcttcttaattaaatcatttagtttctttttatcagctgataccatatatctttcttacagcagtgacagagagtcactgagaacatgtaatgaacaagctaagtgacttctgtagccagtgagttgatttgtctattgtggctctattgtttgaatttttaaaatttttaaaataccagacatatctattttcatttactcaggcatttaaaattttcatatatttgtgtttagcattatatttggagttttagagagattcatgaatggaaagagaaatatacctgcctgttaattcagcaagaatttattgaacagttctatattcctgacattgttttagatgcctgtgatgcatcaatgaataaaactggccggtatctctagccttggggagcttataatctagcctattaatagctcatgttctaattatgaaagaaaataaaaaacatgcacaacaattaggtagtaattgcagttactaaacttcaaaagaataagcaagtatatggattaaaagctcaggtaatttaaataataaagaaataaatgactaattaaagtggggttcaattaattcagaagatgtcttaaaggaggtatatcttttatttttttttggagagtttattaaataatttttttttattatactttaagttctgggatacatgtgcagaacgtgcaggtttgttgcataggtatacacgtgccatggtagtttgatgcacccatcaacccgtcatctacattagttatttcttctaatgctatccctcccctagccctccaacgcccgacaggccccagtgtttgatgtttccctccctgtgtccatgtgttctcattgttcaactcccatttatgagtgagaacatttggtgtttggttttctgttcctgtgttagtttgctgagaatgatggtttccagcttcatctgtgtccctgcaaaggacatgaagtcatcccttttatggctgcatagtattccatggtgtgtatgtgccacattttctttatccagtctatcacttatgggcatttgggttgtttccaagtctttgctattgtgaacagtgctgcaattaacatacgtgtacatgtgtctttatagtagagtgatttataatccttcatgtatatgcccattaatgggattgctgggtcaaatggtatttctggttctagatccttaaggaatcgccacactgtcttccacaatggttgaactaatttacacttccaccaacagtgtaaaagcattcctatttctccacatcctctccagcatctgttgtttcctgactttttaatgatcgccattctaactggcgtaagatggtatcttattgtggttttgatttgcatttctctaatgaccagtgatgatgagctttttttcatgtttgctggccttataaatgtcttcttttttttttttaatttttttatttttattttattatacattaagttttagggtacatgtgcacattgtgcaggttagttacatatgtatacatgtgccatgctggtgcactgcacccactaactcctcatctagcattaggtatatctcccaatgctatccctcccccctcccccgaccccaccacagtccccggagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttctgaatccagtctatcattgttggacatttgggttggttccaagtctttgctattgtgaataatgctgcaataaacataagtgtgcatgtgtctttatagcagcatgatttatagtcctttgggtatgtacccagtaatgggatggctgggtcaaatggtatttccagttctagatccctgaggaattgccacactgacttccacaatggttgaactaatttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgttttttgcctgcataaatgtcttcttttgagaagtgtctgttcatgtccttcgcccactttttgatggggttgtttgtttttttcttgtaaatttgtttgaattcattgtagattctggatattagccctttgtcagatgagtaggttgcgaaaattttctcccattttgtaggatgcctgttcactctgatggtagtttcttttgctgtgcagaagctctttagtttaatcagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaagaaagggatccagtttcagctttctacatatggctagccagttttcccagcaccatttattaaatagggaatcctttccccattgcttgtttttctcaggtttgtcaaagatcagatagttgtagatatgcggcgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccgttttcacgatattgattcttcctgcccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagaggacatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatcgattgagataatcatgtggtttttgtctttggctctgtttatatgctggattacatttattgatttgcgtatattgaaccagccttgcatctcagggatgaagcccacttgatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttactagaaaagcaagagcaaatacattcaaaagctagcagaaggcaagaaataactaaaatcagagcagaactgaaggaaatagagacacaaaaaacccttcaaaaagtaaatgaatccaggagctgtttttttgaaaggatcaataaaattgatagaccgctagtaagactaataaagaaaaaagagagaagaatctaatagacgcaataaaaaatgataaaggggatatcaccaccgatcccacagaaatacaaactaccatcagagaatactacaaacacctctacgcgaatgaactagaaaatctagaagaaatggataaattccttgacacatacactctcccaagactaaaccaggaagaagttgaatctctgaatagaccaataacaggatctgaaattgtggcaataatcaatagcttaccaaccaaatgtcttcttttgagaagtgtctgttcatgtcctttggccactttttgatggggctgtttgtttttttcttgtaaatttatttaagtattagccccttgttagatggatagattgtagaaattttctcccattctgtaggttgcctgtttgctctgatgatagtttattttgctgtgcagaaactctttagtttaatttgatgctattttcaattttggcttttgttgccattgcttttggtggtttagccatgaagtctttgcccatggctatgtcctgaatggtattgcttaggttttcttctagggtttttatggttttaggtcttacgtttaagtctttaatccatctcgagttaatttttgtttaatgtataaggaaggggtccagtttcagttttctgcatatggctagccagttttcccaacaccatttattaaatagggaatccttttcccattgcttgcttttgtcaggttagtcaaagatcagatagttgtagatgtgtggcgttatttctgaggcctctgttctgttccattggcctatatatctgttttggtaccagtaccatgctgttttgattactgtggccttgtagtatagtttgaagtaaggtagtgtgatgcctccagttttgttctttttgcttaggattgtcttggctatatgggctattttttggttccatatgaaatttaaagtagttttttctaattctgtgaagaaagtcaatggtagcttgatggggatagcattgaatctgtaaattactttgggcaatatggccattttcacaatattacttcttcctatccatgagcatggaatattttttccattcgtttgtgtcatctcttatttccttgagcagtggtttctggatctctttgaagaggtccttcttatcccttgtaagttgtattcctaggtgttttattctctttgtagcaattgtgaatgggcatttgctcaagatttggcgttctctttgtctgttatcaatgtgtaggaatgcttgtgatttttgcaccttgattttgtatcctgagactttgctaagttgcctgtcagcttaaggagattttgggctgagacgatggggttttctaaatatacaattatgtcatctgcaaacagagataatttgacttcctctcttcctatttgagtacgctttatttctttctcttgccggattgccctggccagaacttccaatactatgttgaataggagtggtgagagagagggcatctttgtcttgtgcccattttcaaagagaatgcttccagcttttgcccagttagtatgatattgtctgtgggtttgtcataaatagctcttattattttgagatatgatccatcaatacctagtttcttgagtgcttttagcatgaagcggtgttgagttttatcaaaggccttttctgcatctattgggataatcatgtggtttttgccattggttctgtttatgtgatggagtacgtttattgatttgtgtatgttgaaccagccttgcatcccagggatgaagctgacttgatcatggtggataagctttttgatgtggtgctggatttggtctgccagtattttattgaggattttcgcatcgatgttcatcagggatattggcctgaaatttccttttttttgttgtgtctctgccacgttttggtatcaggatgatgctggcctcatacaatgagttgaggaggagtacctctttttgtattcatcagaatagtttcagaaggaatagtacgagctcctctttgtacctctggtagaattcaggtgtgaatctgtcaggtcctgggctttttttgggtggcaggctattaattactgcctcaatttcagaacttgttattggtctagtcagggattcaacttcttcctggtttagtcttgggagggtgtatgtgtccaggaatttatccatttcttctagattttctagtttatttgcatagaggtgtttctagtattctctgatggtagtttgtatttctgtgggatcaatggtgatatctcttttatctttttttattgtgtctattttattcttgtctctttcgttctttattagtctggctctggtctattttgttaatcttgtcaaaaaaccagctcctggattcattgatttttcgaagggttttttgtatctctatctccttcagttctgctctgatcttagttgtttcttgtcttctacttgcttttgaatttgttagcttttgcttttctagttcttttaattgtgatattagggtgttgattttagatctttcccacgtgcttctgtgggcatttggtgctataaatttccctctaaagactcctttagctgtgtcccagagattctggtacgttgtgtctttgttctcattggtttcaaagaacttatttatttctgccttactttcattatttaccgagtagtcatacaggagcaggttgttcagtttccacttagttgtgcggttttaagggagtttcttaatcctgagttctaatttgattgcattgtggtctcagagactgtttgttatgatttccattcttttgcatttgctgaggagtgttttacttctaattatctggtcaattttagaagaagttctatgtggtgctgagaagaatgtatgttctgttgatttgggttggagatttctgtagatgtctattaagtcacttggtccagagctgagttcaagtcctggatatccttgttaattttctgtctcgttgatctaatatggacgatgaggtgttaaactctcccactattattgtgtgggagtctaagtctctttgtaggtctctaaggacttgctttatgaatctgggtgctcctgtattgggtgcatatatatttaggatagttaactcatcttgttgcactgatccctttgccattatgtaatgcccttctttgtctcttttgatctttgttggtttaaagtctgttttatcagagactaggattgcaaaccttgcttttttttgctttccatttactctgtaaattcttcctccatccctttattttgagcctatgtgtgtctttgcacgtgagatgggactcctgaacacagcacactgatgggtcttgactctttatctagtttgccagtctgtgtcttttaattggggcatttagcccatttacatttaaggttaatattgttatgtgtgaatttgatcctgtcattatgatgctagctggttattttgcccattagttgatgcagtttcttcatagtgtcgatggtctttataatttggtatgtttttgcagtggctggtactggtttttcctttcgatatttagtgcttccttcaggagctcttgtgaggcaggcctggtggtgacaaaatctcttagcatttgcttgtctgtaaaggattttatttctttttcgcttatgaagcttagtttggttggatataaaattctgggttgaaaatcttttctttaagaatgttgaatattggccctcactctcttcttgcttgtagggtttctgtagagatacctgctgttagtctgatggacttcccgttgtgggtaacctgacctttctctctggctgcccttaacatattttccttcatttcaaccttggtgaatctgacaattatgtatcttggggttgctcttctcgaggagtatctttgtggtgttctctgtattgcttgaatttgaatgttggcctgtcttgctaagttgggaagttcttctgggtaatatcctgaagagtgttttcaaacctggttccattctccccatcattttcaggtacaccaatcaaacataggtttggtcttttcatatagtcccatatttcttggaggcttccttcgttcctttttagtcttttttttttctaatcttgtcttcgttgatcttcagtctctgatatcctttttccacttgatcagtttggctattgatatgtgtttatgcttcacaaagttctcatgctgtgtttttcagctccatcaggtcatttattttcttctctaaactggttattctagttagcaattcctctaaccttttttcatggtttttagcttccttgcattgggttagaacatgcttctttacctcagaggagtttgttattacccaccttctgaagcctatttctgtcattcctcaaacttattctctgtccagttttgtttccttctggccaggagttgtgatcctttggaggagaagaggcattctggtttttggaattttcagcctttttgcactggtttttccttatctttgtgaatgtatctacctttgttctttgatgttggtgaccttccgatggggtttctgtgtggacatcctttttgttgatgttgttgttactcctttctgtttgttaaattttctttctaacagtcaggcccctatgctgcaggtctgttggagtttgctggaagtctactccagaccctgtttgcatgggtattcaccagctgaggctgcagaacagcaaagattgctgcgtgttccttcctctggaagctttgtcccagagtggcatccatcagatgccagctggaggtctcctgtatgaggtgtctgttgacctgtgctgggaggtgtctcccagtcagaaggcatgggggtcaaggactcacttgaggaggcactttgtcccttagcagagctccagtgctgtgctgggcgatccactgctctcttcagagctggcaggcaggaacgtttaagtttgtggaagctgggcccacagcctcctcttccccaggttttctgtcccaggcagatgggagttctatctataagcccctgcctggggctgctggctttctttcagagatgccctggccagagagcaaagggggtacatcttcaaactgagctttgaagaaactaatgagcattaagcaaggagaagaggccaaaaggctttgccagttaggagaaacaatatgaaaaggggcatagttgaagattaaagtgaggtactagggacaggtaactttaattgcagaatctaaaaggaaagcagggtgggtggtgtcatgttgaagggaagtaacatttgttgaatgcctttatatgccctaggtgcattataattatccagctcattcatacatcaaaacaactttccatttttggtactcttatcactgtttttccaaaagaggtatttcaggttcaagacagtgtagtgttttttttttttttaatcacatttccctgagaatttgtgatatgagtgctgagggtattgataagcttgtggtagaatcaagaattagtattctgtctcccaactggagtagccagtgtcctatgctaagccagtactgcaaacatatatgttaagcagggattcataggtaacctcatgacaaaattatcagctaagggaaataatgaaaaaatactcgtctgcatgtcagtagactttactagctgagaccttggacagtttactgaactcctcacaacttcagctttatacttcagaaaatgagctgattagatgatctttaaggtcctatatggctttaacattttctgcttacaggcagctttgtataccctttctgcctaggtagtggtgtccgacctttttggcacgagggaccggcttcgtcgaagacaatttttccacggggggcttggttttgggatgaaactgttctacctcacatcatcattagattatcaaagggagcacacaacctagatccctcccatgtgcagttcaaaatagggttcacactcttatgaggatctgctgccacagctgatctgacaggaggccaagctcaggcagtaatgctcgcttgcttgctgctcacctcctgttgtgcggcctggttcctaacaagccagggaccagtacctgtacatctcccaggggttgggaacccctgtgcttaattaagcctttaaagttgtggttataaactttcaccgagcttgagaattgcccatagagctcttcaaaactataggtacctgggctccatcaccaaagactttgtctatgaggtccagtttggggctccagtatctatattttttaaaatgtccgctgattttaatacttagctactgttgtaaaccactgttttagaagtattttttaattctttcttctttgaactcaaggaaggtacactctgtatgagacaaaacaggttaagaaatagaaaagaaatttaaagtatatttaaagatttttgtatgtaaagtagaacagagtattaaggtttgttgctgttttagcaagaaagaaaagtaggttttttttttttacctacttttgttttgtattacgacacggtattaggtattctgaatgatttattagaatggattttttttaaaccttccaggagcatggtgtacataagtaatatagaatatttaattttagactgattgctagagtgagagtagggactctttgttagggatttctatttcttaaagtttaacacctggctggcacaaaataaagatctcaatatatgtctgatgaataagtaaaagatttattgagacagaactcaagtggcaaatactactttaattcaatcagctttcatttaagataagtatatctttatggatttgtatggataattataaatattggtgttattttaaaatcatgatatttataatacagtgataattatttttgacattaaattttttcatgaagaatattcgtgaattaaataattaaataatatttaaagaatacaatttacatatttgatatttcttatgcacaaagatacttgattattcagatattaagatatatttccaacattactaaaattattacacttaattttaatattatatttaaagaaaccaagcattttcttactgttgaatgtgaattctttatacaaggaaacctagaagtaaactctcaaatatatatttttaatgttgcatctattttttcttatatatttttgttattatttttgtctttactgcttcccttctagcactacctcaggaaaaaatgtaagtctttaataagcaaagtattagttcaagtagttcaagtagtgaaatctctgagactgatgcctagtagaatgccaggaactggtggcttgtaaaatctaatcaaataaacaaatattcattgatagcgtcctaaaggcaaatgtgatgcgtggcactggaatcagatctagtgttccttcttttttctttgttcccctgaataattattatgaggtagattagtagatactgggttttaattgtaaactaaaccaaaatggtttcagctttcaaaaagttttatagtctagtggctgagtcataacctgctacttaggaccttgccagtgttgtcttctgtaaacagaccagcagcaagctcatgcattgcttttgtgagaaataaattagataatgtctgtaaggcagctagcacaatgtctgccacatgtctgccacaaaataagcctattagaattagcctgttctaaatcttaacttatttttattttattacatatgttgtattattttctatattggggtgagtaaatggagatcttatgtttatttataacagtgtgtgaactggtagttgataataaaagacagagttttgatattttgatccacagctatactaatagcagtgttattggcacttctgagtgattatttccttcctgtgtgagtcatgatatttgggttggcatttgttgccagtgcgctctgctgtctagtgccagtatctcagtaatatacaaaacatgtttaatcacaaacttgatgtgtactactcaaccaaattctgctgatcatgtttttgtttctttgcataaagtaaatataacaagggaagtgcaataatagaaaaaactgacttgtacaaacaaacatgagaatactgttagccaaacagggtaaagttataacatggtgaaaacttagttttgataattgcaagtcttagttgagcagaagtcccactgagattgatgagacactggccttctagaaatgcagactaaggcttagttgatcctgtcaaagaaaattggattatcacttttgcaataagacctctgatttatctatcatattttaatgggaagaaaatattaagataccttacacatgtctattgccattgaaatatactttctattaacatgattcacttctgccaatatccccatatcatgtaggaaaaaaaagaattctgaccactctagaatgttcctgataactttttcaagtctattcttttattcttctgttgttggttttcaaagtgtatacttagtaagctctacataatctattagaatatagcctagaagagttagaatgatttttcctttttaagcagcaattcaaatatagcagtgttaaaaagcatgtggggagaatggatagcatctagagaagaagagaggaaataagtatggaaaagaatcttgagaaaaaggaaagagatatgatatggcctagggagtatttattataagcaaggtacagtaagtcctcacgtcatgtcatcgatagctccttggaaactgtgactttaagtgaaatggcttacagcaggtcctccaatcatatccctttgttcaatgcccttttgttataacattgatgaggggaaaaatagttttgtttgtcatacattgtttcacttaaaatagcagttgtcaagaacctatcaaggacattatgttcagatttactgtatatacagagacatcccaatcctatctctaatgtggtgggaagaaattagttttgaacacagaacagaaagtttgagataactgaagccactggtcatcactttcagggtgataaagcattaaaaaaggcttcaagaaggttgtggagttactattaatatcttgctcatgtagaagaaatgtatcttttaatagccataagtctggatggtatagatactgaaccacaagaggaagaagactggactaattataataatatcttgatatttatttcagttctccaattccatgaatcaaaacaacatattatattttggcaggttcttagaaaatttatacttcatgccagaatcacatcataaaacattaagcttcagaatttgtattttattctttctggaatattttatccttgtcactaaatctgctttaaatagcttactgtgttatatgcattattgcatactcctgatgaacaaacagtttattttgaaaagttggtgtagaccaagaaggccaaaggtcaaaccaagattttaaaaatatcagatcataatgtttaagtttgttggccttgtctgtaccaactctgtgtgtgcctttctacactgagatgattatcttttgaaattcacttattttcttcataatagtcactctgcttttgatttaaatacaaaaataaatgtgtcataattttgtccttaaacaaaacaaacaacatctgtttaagtatggaacaattaggttttatttttcaaaaattagaagggttcttaagatcatatcaatttgttttgattctaatgggaagagctttaggtcaagaaagcaattatttccacatgggtaaggctgtacctccgctacaccaaccacccactaaacttaaatttgtctactctggttgtatagctagatgtggttgaatgtattagaagacacaggctttatttaagaaacaaagattttagatatatagaaaatgtttctttgtagaaacataccaaaagaattttgcatataatattaggtgagttcagcggcaagtaacttaaacactttgaattagcaaataaatttaactttatacatatgtgtatggccaaatgtaatttttaccattttgtttgcacatcatttttatttttaattgacttttttgttctcagtaggtaagtgctgtagtttggatatttgaccctccaaacctcatgttgaaatttgatcaccagtgttggaggtggggcctaatgggaggtgtttgggtcatgggggcagattccttatcaatgacttggtgccttccttgtggtaatgagtgagtttctattctgttagttcccgtgagagctggttgttagaaagagcctggcacctccctgccccttcctgtctccccatgtgatgtcttcacatgccggctcccctttgccttctgtcatgaagagaagcagcttgaggcccttaccatatgcatatgctagccccatgtgtcttgtacaggctgcagaaccatgagccaaatgaatccctttttaaaaaaataaatcacccaatctcaggtattcctttttagtaacacaaatggactaagatagtgagtttgctatataatggcaagtattatttgagatggttcagtagggatgtggcaggtcagaacagagaagatttgtatttaatgataaagagatgtcattaatttcaaataggagattgtacaaatttccatatacctttgaattttagaggattgaagtccatgggaaagattgttaaggtaggttgaagagttgaaggaatttgataaaagtctggtttagtgattttcactgtagtggttttagcctaatggctgggattgaagtcaggttatagtgggttagggagtgagtgaatgagaggggaggatgaataagattttacacatgtatacctcttttttcaggaaggtggtttcaagaagagaattaaaggacagtatcaagagggaaagctcaagggttaaaaaacagtgcatcccatgcatataacaactttcttttcttattgtttaaagtgtcccattagccagtgctgagtgcaaatctggctttaatattaatataatatacatgctagcagtccttttgatataattttcagtaatggattgtaaaatcatcaagtgaaagaacatttaataggcagaatcacagttgaccgtaaaatctctgagactaatgagagcacatagggcattggctaactccagattgccccaattgaaagcactttaccattgcctcgccctttcattttaaaatattttccacaaaatgtggacctaatccatcctacctacatcctacatcctacttgtgagatttttaacctcatttatcattgctaattttgatagagttctgtatatctaatggaatgctcttaagacagttgaaacccttcatttcttgttattttttcactgactgttgcatttaataagtatttggtgttcattatgagaatacagaatgaagaaatacatgattattataactttgaatgccttctataatcttggaaacttattagattttaaaaaccagttttattgtggtataatagccataagttatactcactgaaagtgtgtaattcagtaatttttaaatatatttatggagttatatagccataatcaaatctagtttttgaatatttctatcactctaaaaaatatttgttgctatcacttcccattgctactcccaggcccaggtaaccactaatctttttgtctctttttttccatttccgccctctgtgggtatattgtaatacagttctgacactaactgcccatcaattagtatcagactccacaggtttaagagtttagccctccagaagactgctctcaattcagatgccagccacaaatgcagaacattcatgcttctgacgactgactataaaattggagattcccaaatgtataggttcagtaattctctggaatgactcacagagctcactaaaaatgttatatagttttattataaagggtacacataagacaaggtttggaagggacctggacctaaagcttccatgccctctccctgtagagtcagggtacattaccctctctgcatgtcagtgtgtccaccaagcctcagtgttcagagcttttattggggtttcagtatatgggtgtgattgattaaattattggccatgtgattgaactgtctccagctcccctcctgtccttggaggtgctgttggcctagagttccaaccctctaatcatgtgtttggtttttttggtgaccagtccctagctggaagctatcaccatgagcaacctcatcagcatagcaaagacagtactgtcaccttgaaattccaagggtttttgaagccctgtgccaggaactaggaacaaagtccagatatatttttattatgccacaatctaaactctctttttctgaaaattttatatacatgtaattatacaatatatgcccttttgagtctgccttcctttccttaacataatgcgttttgtttttttgagatggagtctcactgtcttccccaggctggagtgatttcagctccctgcagcctctgcctcccaggttcaagggattctcctgcctgagtctcctgagtagctgggactacaggggtgcaccattacacctggctaatttttgtatttttagtagagacgggatttcaccatgttggccaggtaagtcttgaactcctgacctcaagtgatctgcctgtctcggcctcccaaattgctgggattataggtgtgagccaccatgcctgtccaacataatgtttttgaggttcattcatatcagtactttttttttcccttttcatgactgaatagtattccattgtttggattacattttgtttatggacatattaattgaccatttggattatttccagttttcagttatgaaaattggagagaagtctttgggttgacatatgttttaatttctcttggcttgatacctaaatgtagaattgttaggtcataagaataatgcttaaaaaaaaagtagttccattttacattgccacttggcagtgtatgaggggtccagtttgtcagcatccttgccaacatttggtatgatcagactattttattatagccattctagaaatgtatggtaatttttatggtaattttcatttccctaatgactagtgatgttggacttcttttcatagtgcttattgggcatttgtatacattttgtgaaatgtctattaaattttcttgcccttttttcatggggtttattgtcttattactgaattgcaggaggtgactttgaaaagtttttcattttggatcaaatcttttattaaatataggatttgggaatatattttcccagatcgtggcctgtgttttcactttctaaatagtgctttttgaagacaaaatgttctaaattttgatgatgttccattcattaatttttttttctgttaggagctatacttttgctatcatatccaagaaatctttacctagttgggggtcacaaagattttctcctttgtttttcatttaggtctgtgatctgttttgagtttacttttaaatatggtgtgagatactctggtttctcttcagatcatataagtctttgtttcatcttttaaatacggtttgaggtgaaaatccaagttcatttttttttaattttttgcctgtgtgtattcagttgtaccagcagcattttttgaaaagtctgtctttgcccattgaattgctttggcatctttgttaaaaaacagttgaccataaatatcaggatttatgtctagaatttctgtggttctgattctactaatatggagcaagactctgtcccgtgcattccaactaaaaaccctggacagaatacacagcacagctgtttgaggtctctgaagagtaaataatagcaggaggttcaggatgcacttccaacctggagatatgactgatactggcaagttttctgtttttttctgttgttgttgttgttgttttctctgcccttttcccctttctttttctcccagcttggactccagggcatcttattcttggtctgcacaacagatgcagacagaagaatcctctttttctctgtttatggtcagaggactggaaagaagggcccctgtgcgaaggagtctgtgtggaacatcactgttttctttgtgttttgtattctggtttttgttttacttttctggtgggaccccaagtaagccttaatcatgaggccgttcccctgcaatggtagtggtggtggcaatggcaactatgcaggcatttaaaactctgaaagataatctttttctttgaccagataaacgggaaaaacgggcccctgtagcccaaagaatgaggggagaatatctgttagtttttgcttttttcccccctttcttgccacttctccccaaggcagatgcagttgcagaaagtatatgagtgtgtgtggaggcaaaaacaccagttttgtagccagagaattaagataaggggtctaggagacagatagtgttggggaaattatggagaggcagtaggtagagaaaaagatgacctaaatctgtgcatgaagacccagacatccctaagctgagcatgtgtggaactttttcaaggagatgaaataaaaagtttgataactgaactacattgtagaccaccatctttgtcctagattggcttttaggtgacacatatgaggatagagtaaatatcactaaaaagacttgggaaactgaattgactttgaagtcacagcccaccaggtaggttgggacttgtggtttgaagctaacagggttgattgtcaacaacaacaaaaatattaaaaacgaaaacaaaaacaaatccattctccagaggaccaaaagcctttagcatgaccaagagtgtcaaaatgcaatattcaaagtctccctcccctttctgggatacactccaacattattggacataaccacgactcagggaaatcatcaactgttgtaggaaaaacagcagctaacaaatgccattcctaagatgacctggatgctggaattatgacaaagttcttagagcagctattataactctgtcctgttgaagtcagagcaaacacttttgaagtgaacagaaagaatgaagttctcagcaaggaaagtagaaaaagaaccaacagaaacttttaggataggaagtagcaataatccaaatatattaaaatactaaaatacctaaaaatgttctagatgagttcaacagcagaatggaggggacagaaaaaagattaagtgaaattgaagaaagggcaatagaaattataatatctgaacaataaagataaaagacaataaaatgagcacagtgtagagatctatgggatgatagaaaaggtataacaattacgtcataagagacccagaggagaggacaaagaggttggtacagaaaaaatactgaagaaataatagctgaaaacgttcatctttggtgaaagacacatttacagattcataatattcagtaaattccaaaaatgccaaatatcgtgtgattcagtttatatgacattctgcaaaagcaaaaactgtagacatggagacccagatcagtgtttgtcagagattggaagcacagggaagggttgattacaaagacagaatgagggaattttctgagtgatgaaactgttcggcatagtgatactaataatggatacatgactccatgtatttgttaaaacctataaattataggttaaaacttataaagtaaattttattgtaattaaaatattaaaaagtaattcttaagataaaaaaagtattgagagcagtagtgctcagaacactttggttctaatgatttcacctggcatattgaagattaaggtgcacaattaaagaggctagttctacagattcttttataagaattgaatcattgtagtttgtgtttctgtatgatgataaactattcaatttccttttgaatgagggtggctttttttttttaaagagagaattgttttcatggagtgtatttgaaatgagagtaagccttaatattcttattaaagtgtaagaaaaagaacttgaaaagcatttgccaaaactaaaaatatagaataatatttttatatgtaatatctactagtattaaaatgaagtttctacttattgccttttcatgaaaacttgtttagtgtgtttgcatttcaaatgaaatgtacgttttttagtttttattaatattatgtgtgaacagtgtatattgtgtgacctacatgctattttaaacagattctgcactcaaattaagataagaaaaaggaacaaaagctctcttttgattgtgtttaagttatggtttcttgtccattgcccagacttgtaatactggatcttcttcatctattacaggttgttgaatataatctgtaataattgtatatacctagttaggataaaatgatttaaatggtagcaccttgactaaggtgctgtgagtggtagatgatgagaaatatgtgtttgtgagcagaaatttgaatctccttgcatcactaacatctaagtatatggcaaatgcaatttctgtttgcttttcttctttcacagtgtttgattattaaaacaattgaccttaatgttaatattatggagatgtctgaaggtactttcatttactactttttattttacttcatggaagatcagatttcctttatgaaatatttttttctctagaaaatttttgtgttttttaactgttttctagacacaggtgaatgtaataataaatgagctatggtttctgctttcatagatctcacttttaaaattgtttcatttgtgtttttaaatttttctcttgaatatttactgctaaatattttaaatgtgattttctttgtgtaatggcctacttttatatagaatataactagaattatatttatcttaggatcttagtatggtattagatagaatttttaatcatatgcatataatctgttaggatttgattacttttaattccaggagaacatgtttccaagagttgaggttaatggagggcaatgagagaaagctattgattgaagctgaaagctctactgtatctgaattgtagctgtctaaattactgattttttaaaattaacatgagttggtaatcactaatttttttttttttttttttttttttgagacagagtcttgctctgtcgcccaggctggagtgcagtggctcaatcttggctcactgcaacctctgcctcctgggttcaagcgattctcctgcctcagcctcctgagtagttgggattacaggtgtgtgccaccacgcctggttaatttttgtatttttagtagtgacggggtttcaccatgttggtcaggctgggctcgaactcctgaccttgtgatctgcctgcctcagcctccccaagtgtggggattacaggtgtgagccaccacacctggctatcactaaaatttttttgttatttgttttctctatactcaatagtaaagttaaaggtaagttaaatttagcttttaatgttttaattcctaaaacactattttcaaaaaggacattgcggttaaattgtctgataaaagtaaggtggatttcttaggataattgaaatgtatgcattgacactaaaacttgtgaatgggcttactttctatatgctatgtgtttaaaaattctggccaggtgcggtggctcacgcctgtaatcccagcactttgggaggctgaggtgggtggatcacctgaggtcaggagttcgagaccagcctggctaacacggtaaaacgccatctctactaaaaatacaaaaattagctgggcgtggtggcgggcgcctgtaatcccagctagttgggaggctgaggcagaagaatcgcttgaacctgggaggtggaggttgcagtgagctgagatcatgccatcacactccaacttgggcaacagagccagacttcgtcgcaaaaaaaaaaaaaaaaaaaaaaaatccgagagttaaacgaatatttaccttttttgttctaagagcacgttcagtgaacattttctacttagaaaaattttgcaatatatttttcaagtattttagaatgttttaacttcataaagtacttagtgtcatagttgttttgtttgttcttttagaatattatatgtgaaattaaaaccttgtctctgatttgttttgtgaattatctgtgatccaaagaagtcatcaaaaaattaaagaatgggtatatgaatatcacatatttattgcacaagaactgtttgattttcgatagcctttctatttaatattacctgaataattggattaattattttatttaacagttttcagccttcagtagtaatagagtatgacttttaatgttggtctgggaaaaatgcatcatgaggaattaatctgtaatttagactaagaaaatggcctttgggtaaaaaattcatagaatgaagggtctgacgattactttaggtctttaaaaacaaagacaatacatagtgaattttagaactgcttagctcatatagtaaatgaaggagtttctagtggcaaatatgtttgagaaactatagatatgacaaattgtgtggactttatgtgtatttcatagtgtgtgtaagatgcccccctctttttttcccttaaatagtattgtgttatataagagactctaaatataatgaaatcactgtctttattctgtatagattactttttgtattgaatgcctgtagcttctagcacaatgcctggaatgttgatgttgttacatactcttataagttaacaatgatttataagaatttaatgtacccaagatggaagtattaacacacgttggtttacctttgtgaaaacccagtatggcaaacatcctgtttgctaaataaaaacttagggtgccactttgtatattataaaatgatttttcagttaaaatttctttttattttagaaaattttaaacttatacaaaagtaaagaggataatcccccaatgtagccatcatccagttttaataattctcactgattgccagtcttctttatatccctaaccactactaccttccctcaataattttgaagcaaatttcagacatcatatcactctatgtaaatatttcagtatgtatccttagaagataaggactctccttttaaaaatataaacacaatgctattcatctcactgaaaaatttttccttattatcgtatttagtcagtgttcacattttcccagtcacctctctctcatttgttaaaatcagaatccagataagatctatatgttccagttagttaagatcttaaatttatttgaattggttggttcccccctcatccctctctctatggtttcctagaaatttattgaagaaaccagaccgtaaagcttctcacagtctgatttttgctgatccttgtggtattctttcttggttctctgtatttcctgcaaatcagtaatagatctagaggcttgattaaattcatatgtggtgtttttttttctcctctcagaaataaatcataattggttttgtgtacttccatgaagagacacataatatctggttggctttgtttgtatgtcttgttagcagtcattggtgacgattacctatcattacttgtgtttattaggcttgcaaaatggatatattcttttatcagttagaatacctgtgtaaagggaaacttgtattcttcaactatttggttgcctttcatatgggaaagataagataaagtcttgatttttctccctttatttaacattattcaaaatgatgcattagtttataaaaatcctcaaaagatgagtaatgatgttttataaatcattattaggaaatcatagatttaaacatattttgtgtgtttcaatctgttgtagttatccttcttttttttttgtgagacagaggttcattctgtcaccaggctagagttcagtggcgtgatcttggctcactgcaacatttgtctcccaggttcaagtgattctcctgcctcagcctcccgagtagctgggactacaggcatgtgccactacattcagctattttttgtatttttagtggagacggggtttcaccatgttggccaggatggtctcaatctcttgacttcatgatctgcccgccttggcctcccaaagtgctgggattaaaggcatgagccaccgtgcccagctgtagttatccttcttgaaggtaaagttgtcccttttttggccagtggaaacctctacaagttgccttctgaatcctttggctataaccctagtagtagtctggtaagataagaagttctaggttcatcttgtatagctcctggccccagctacaatcagccatttccccaagggactgttgttacttcacaaaaggatttttaacttatatagtgttttattatttaagagttactcataccccatgaattaaagttttcatctgatataattttggttgtataggatataggagtggatgattttaaaagatttgtccactatgaagttagtagtgtgggatttagttttccccttgagaaatctgttacttacaataaagttcatctttttttgttaataaagtttatctttaaagctgattaaaatttttctcacaggagatttgaataattcacattgtaatactcatttaacctcgtatatatttattaaaattatctccacttaatagtaggaaaatataaagatttataaaattatgattttgtttgtgaaacattttgaaactcagtaattagagtcacctgatttatggcctaatttttttactctgtgatatcccacattttgatttaaaattggtggaggaatgagcagaaagtgattttgtaaaacaagagaggggaaatattaaggataataaggataataaaacaatgtttataggggatacactagaaaatataattattgtgtagttaatactatgggtactttgattttatgatttataatcaggtgggtcttatctaacataatagtttgaccaaatgcttatgattagctaagaatattttactttatcctactgggttctcaaacttattttgactttgagattttaaatgtttagtgcttgctttgtgtctcatggggagctatgtcaagccaagttaagaattcattaataaaactcttacaatttatttcccacagagggttagcttgaacttatgtgccagaggttacatagcggtgcttcacagaaagtctccaaggtaaagagcaataagttagaggggccagcagggaaagtatgtgtactaagttgaccatgtggaatacctgaggccagattctgattaatgtgttcatgtgagatgaaaacagggaatggagaaatagttactatttgtcataaagtattgtggttgagttggaacactaactgccaaatctaatagatcctattgaactcgatataaccctcccatgggctttggggatcttgcagatcttgaccttaactgtcatggatcctcaaaccacactctctttgtgccctaacaaaatgtagtttgttgtaatgattgtatggtaagatgagctgaaacatgctgtgcgtgtatgtgtctgtatgcacttgtgtgtgaacgtagttgccattaaatttacttaatgcgtatagtactttgactattgataatcttttgatggtattttataacttcaaatcttaaagattggaacatttttcaaccaaattgtaaaattgcaaagaaaacatctagccaccatccaattacaacaacttcttgttgtttgtgggaaaataagcaaaatcagattcttttaccgttcattcatctagtacagaatattacttatgcctggctaggggctgtttatttgccagtctttcaaaattaaatcttcttagactatattatacttagagacccagttaatgttgtctttatctgtctttgtttagaaatagtgttttgtgtttatgctacaggatattttgctaaagattatttattcagaattcccacttacaagttcagtgttgaacaatgagagagagagctcccttacagaaccccctttgttgtgatggtgaagttcagcagatcgctatgtggtgttcttatgcttgattctttagagtgttgtagaggaagccagtgtagtttgtacagtcatatttttgttcatacgccacccctcaatctcatacagagggctttatgatgaagtcttggagtttctctaggttaattgaattgagccaatttgaattcaagtctgaaaaaaataagaagttatagcctagctttctgtattttgtctcgttttattcaccctctttttacccttatcttgtcttttaatgtttccagtgggtagctaaaaaataatagaagcggcctgggcgtggtagctcatgcctgtaatcccagcactttgggagactgaggtgggtggatcacctgaggttaggagttcgagaccagcctggccaacatgatgaaaccccccctctccactaaaaatacaaaaattagccaggtatggaggctggcgcctgtaatcccagatactcaggaggctgaggcaggagaatcgctagaagccagtaggtggaggttgcagtgggccaggatcgcgccattgcactccagcctgggtgacaagagtgaaactcagtctcaaaaaaaaaaaaattatagaagcaatatacactattaatacttgacaaaatttcaaaatatgtaaaaatgtataaagtaaaaaacgagtatccctgttttttcactcttttctattcttgccttctggattaaccactgttaatggtttgatgtatccttgactgttttgtattcatcttcacataaatgcatacatctatatgaacatttggtacatgtgccagttcaacttattcttcataactataattattccatagtatagttataccataatttatttactcattctgttgttaaacatttgggttgtgttcaatatttcatgtctgtaataatgctattccttacttttccttttttctttcctttcctttctttccttccttttccgtttcccttttccttttcctttccctttcccttttcctttccctttccctttcctttccctttccctttcctttctttgctttctttcttctcactctgcctcccaggctggagtacagtggtgtgatctcggctcactgcaacctctgcttcccgggttcaagcaattctcctgcctcagcctcccaagtagctgggatcacaggcatgtgccaccatgcctggctaatttttatatttttagtagagacggggttttaccatgttggccaggctggtctcaaactcctgacccaaggtgatccacctgcctcaggctcccagattgttgggattacaagcgtgagccaccgtgcccagcctgtcagacatttcttaattgatagaagcagttaaatttgtacggtgatgaggatggcagacagaatatcttctcatgggtggcatcccactgattacacatttgtttgacaaaaatatttatagaactgtgaagtatacattctgaaactactattaaatagatttaaaaaaattagggtaagtacagtgcctcacacctgtaatcctagcactttgggagaccaaagagggaggatgcttgagcccaagagtttgagactagcctgggctcaacatagtgagatcccgtctccacagaaaaaaaaaaaaaaaaattgaccgggcatgtgcctgtagtcccagctacttgggaggctgaggtgggaggatcatttgagcctgggaagtttaggtttcagtgagccttgatcatgctttgcattccaacctgggtgacagagcaagatcctgtctcataatgaatgaatgaatgaatgaataaataaataaataaaatacataaaataaaaaatcatttggaaaggccaaagacagaacagtagatacaaaatcagcacttttctttttaaatcagtcatgtagaaaaaggaactgctttatgatacttttgaatctgatttctaagagaactcttacaaaaatctcatatactttatttaataatcttgtgaaataggttctacttgtcaaattctttcttgcttctttatagattttcctccagacttcaaagctcttactactccctgataaacataatcagcatctctgtgaagtactgtcactgactacttccactttatttttggttgctgtctgtgaggattattgtagataatgccatggaaaacagaaaaccatctggttaaaagagaagtagtggtaatgatggtgttcggtgagagagagggagagagaaggagagagaattttaaacaagaatcaagcaaactttttcttagtttttttctttttcaatggtgttttaataattggaaaatttgaaacttctaaaatacttagaagtcttgaaatttctaagatatttttaaaaaggtaactctctgtaggtatttgttggcaatcactgtgagacaaagttgccttaaaaaaaaaactttaaagtgctaggtaaactatttgtcattaatgttaaggaagctagcattaatatgaaggagattcctgaaggctaccagtatcacagaatcagagcagaaggtccttggagagtgacctgaaagagaaagacagcagcagatatttgatgtcttcctgactttctattgtggtctaggttgtgtaaccaatgagtttattatttttgcaatagatatttctcgatcttactatttttttgtcttcatgtatacttaaattgtatattcacagacaatatactattttaaaattttctttgctggttaccagtttttggataatatgtatttgcatatcaacataaccactacttttattttacttggttcattaactacagttgttttattcttcattattccatactatagtttactaatttgcaacataggttcttatgaatcttccaaaatcgctcattcacatagccgttgacacaaaactctaattccttgccggctggttgcaaggaggccttagttcctcaccagcttgacctctccataagtttgcttcgtccttatgtcctctagagtgagtgtcctaagatagggcaaggaggaagccacaatgtctattatctcctgatatcagaagtcacacacccttactttggcagtatttttttttttttctgagacagagtcccgctctttcacccaggctggagtgcagtggcacgatctcggctcactgcaagctccgcctcctgggttcacaccattctcctgcctcagcctcctgagaagctgggactacaggtgcccgccaccacgcccggctaatatttttgtatttttagtagagacagagtttcacagtgttagccaggatggtttcgatctcttgacctcgtgatctgcctgcctcggcctcccaaagtgctgggattacaagtgtgagccaccattctattcattaggagcgattcactaagtacagtcaacactttggggcagggaagaattagattctactacctttggaaggaagaagtgaagaatttgtgggatatattttaaaaccacgatgatcatcatatatgatttctaagcatttcctgttagagtctattattcggaattgtttgcaacagtgttgacaattgatatgtgttgtgtagtttctttttgactgccttgtttttaggtttggggatcagtgttatatactcactttaaagacataacttagaagttttccttattatctatgtttttggaataattttaaagtagcattgggagtttatacttttaaaaagtatgctagcattctcctgagaagtcatctggacgtggggcatttttttgagagctctattactggtttttctatttcttttgtttcttttcttttcttttcttttttttttttttttttcgagatggagtcttgctccaggctggagtgcagtggcgcgatctgggcttactgcaacctccacctcctgggatcaagcgatccccctgcctcagcctcccgagtagctgggactacaggcatgtgccaccgtgcccagctaatttttttttttttttgtattttagtagagacggggttttaccatgttggccaggatggtgtcgatctcctaacttcgtgatccgcccaacttggcctcccaaagtgctgggattacaggcatgagccacttctatttcttttataattgatttatgtagatgtctgtctttcttaaggccatttctggtaccaatttcagtattttttaggttaaattttaaagacaaatttatattcagaagattgtttcttttttttgctgtaagtcaataggaataaaatgaattacgtatttatgtatgttatataaaggcaaacatcagaagtttatcagttctttaaagagaagtaaacttgttttacccatgtttgtgttttaacttgtttttgaaggcaattaggtaaatatgagtgaatgtaagagttttcaaaaaaccgcctatgttcttttgaaatgtgtgtgctacttgaagatatcagctattattttatttataaataagagaaataagctttattccatgtaatttgataaaacaatttgaatttttgtttctagatctattactgtttataaaggctggtacaaattcatttttaataaaaccagtttacatatttataagaatgtgattgtatgtgtgggtgagccgtgtatactgcttttaataaatattttggtttgccgggcatggtggctcacgcctgtaattccagcactttcagtggcaaaggtgggcagatcacttgagatcaggagttcaaggccagcctggccaacatgggaaaaccccgtctctactaaaaatataaaaaatacccaggcctggtggcacccacctgtagtccaagctacttgggaggctgaggcaggagaatcacttgaacctgggaggcaaaggttgcagtgagctgagattgcaccactgcactccagcctgggtgactccatctcaaaaaaaaaaattgtcattttttgtgtattcatttcttttttcatcatatataataggccatcattaagttaagactgagtgatacacagcagtggagtggagacaacaaggtacctgctcttgaggagcttgtgtctagcagattctaagtgggggtgtagtggtggtgagatctgattcaagaaatatttaggagatacttgaaaattataagacaaatttatcaaatcacttaatctagagttttcatatagattaagatacagattgttatttagtttagcctctgctaatttttatccattttccttgtaatctgcaaaattttcaggttcttctgttttattttcccatttatttttcccaagagctaaatattgatgagactccagatatgaaattactttaatttggtagtgagaattgaaaatcactgtttttggtggggggataactgttaatttcttctaagtacccagggaataattgttaagcttttgattttgtggcttatgtaattaagaatatctgacttctcttttcaatgtgtaatcagaaataaagaattaagaactcagttaggttttttaaattttttctttagttggttcagatttaagtcttgaattgttcacttaaagaccatatatattcttatatattatattatatattatataaacatatatatttgtatgtatatatgaagtcatacattatacttgttttgaattttttaataggcctatgatcatgctaggatacagtagatacacaatacatttatttaatttgtgtgcattgaagtattgctgtggactgtgataaagaatttttgtggtaagccataggcttgttatctttgcttttttcacttactagcagagaagattaatgtagtaatgttcatgacattcatgtttattctttaaaatcttcataaaatgttttgaatcagttaaacacatttaaaagagtttgttcctgtgtgaattttaagccttttaatggattttacttccatttcatttaatgaaaaagaaactgtggctccacacaaaagacaacatattttctgcacaagttaaaaaaaaattggtaaatgtagatctttgttgactgaagtgctgggaaagctgctgtttcttgcacgtattcttaaaatcaacaaaatacctccacaagacaactggcagctgtggttgaacttaaaaagcactcttacttatgctaaagtttgcagtattttagtccagctaactgtatactattctgcaaatgaaaaaatctcaaatcgtttagtgggcaaagacttttgaaattctcttgtactatcctgtgtcagatctttactactatttacttgtacagtatagtttattctacattttatagttccaccttcttaaagaataataatacctgtgtatgtgtgtgtgtgttgtgtatttgtatgtatgtgtatatacagtggaaaacttggttatcataaaatatacaaattaaagcacccataaaaactctggttaaaatttttgccttcttgttcctaatttattatattgaacaagattcctgttgctcttcatattctctgttcatcttccataattctctttgaagtcagtagttgctgtaagtatggaaatagagaagggaaaacctaactaaatccagtgtacttagagctctcgtgaaagtcaatgttgtggcatttttttaaaggaaattataggtatcttgctaatttcttgatactgtgtcatgaggttatcttttacataaactcataaatggatgaattatattttcttactaaaatgatgcatatatgttacttaatgaatgcttgtttctaactttttaaattttaaaaccatatcagcattatacattttactttttagaaacaaagcatgccttttatttaaagtgtgaaacatacattaaaaatttagtcttctttatgtgttatctgaaggaagcttattaaaatctgaattatgtttgttttaccaagaaacatgagtattctttgcaagacatcgaatgcaaatccaaccatccaaatttaggtaatttatttactgtcaaatgtctttctttccttctcccctgtcttctttttctttttttaaaatatgattctgacaagaatgatgaattttaatttgtataattgaaaaagtcattttctctttctttctctttccttccttccttccttccttccttccttccttccttccttccttccttccttccttccttccttccttccttccttctctctctctctctctctgtttctctctttctttctttctctcttgtttttgagacggagttttactcttgttgtccaggctggagtgcaatggcatgatctcagctcgccgcaatctccacctcccgggttcaagcggttctcctgcctcagccagtcgagtagctgggattacagctggctaattttgtatttttagtaaagacggggtttctccatgttggtcaggctgttctcgaactcccaacctcaggcaatctgccagcctccgcctcccaaagcgttgggattacaggcatgagccactgtgcccagacgaaaaagtcattttcttacttcacacgagtaaaaattgtttttgcatgcctgttattttcatcctacagttgcttagggtgtgcctgtcaatgttgatgttcgatgttattaataatgagtaaaatttgaagacatttaaagaaaagcatttgggtaatagtttatggtggttttttaaaaacagtatgtagtatctgttcgagactattttatggcagttataaacttgtatggaatgataccattaacttagtttgacacagatgctgaggaaatactattaaaaagtgatcaagttccaaaattttacatagtatctgtgcgagactattttatggcagttataaacttgtatggaatgataccattttgtttgctggaattattacccaagaaaacaaaccagtttttaaaatgttcctttataatttgagtgagagagtaaaattatgttggaacaatatttgtgacagattttgggggaaatattttaggattttgtgctaaaaagtgaattgtaacactcatcatcctttgcaatggtgaaatgtctgcaaattctgaacttaaatatttgattaaatattgcaggtatattcatattttaatttgatatgcttaaaataaaaatgaagattattaaggttacagtatcatttaacacattttaaaaaaaatttctaagaaattaacttagtttggcacagatgctgaggaaatactattaaaaagtgatcaagttccaaaaatttacatgtttattttaggatatgcaaatcttttggtcctaaaaattgttgtcatttttctacatcaggcttagatgcctggcagtagactgttttctttttctcttgtttatagtggggaatattatttttagggaatttgatggggggaacctgaaattgaggcttagttttacaggaagatctttttggagttgtcaggaagtagacttcaaatatacttatgtacattctagccacttattcagaatttcctgactttctgataagatagagaccagagccagtgaaattttcaatgaaaacatgaactttcagactttaacgcataatcttccaagtgggataatccactgtgtatgtttagtggcttgtaaaagtatttagaattttttaaaaagttactatccaaaattgaatttaaattactttaagaatggatacgtattttggatctcttaacctttgctgatgttaaatattggtgtttataaactagcaatttagagcattggtgagatactgatgaaacatagttacatttctcctaatgaaaaaaaattagcaaaacttatagtaccaaaataaaggaaattcagatgtaggctatttttgtctttagacaaacagcattaaaatttttactttttttctttagaaaaaaatacaagatgtctgtactaggtttccaattcagagtataacaaatattttctaaggctaagatgctcctttctgtaaatttccatggcattttgtacataattctattatgtttagaagtttcctgatataaacagaaggtgcaatagctggacgagtacatattcttttaatttaatgcaagaaattctaattcggcataaagggtaaaacgtatcagactctcatacagagttatgaagtagtataaatggaaaaacactaaattcctttgtgttgtcccataaaacaggaagcatcttaagctattggatgcctaaatatttgtatatcagaatctagaaaggagatggtaacctgtaatttgacattagatacagaattgtgtctgaagttactaagtgcaatttgctaaatttcttctattgatagatttctttatgatgggactttccaattctgttaaaattggtagtttttttattattgtcatggtttacttatggccagtgtggttttatgtgtagcttagcaaaaaaaaaatgtcacttgaggctatgcgttggcatgagtctaagtttaaatcctaatttcatatttaattatttgatgtatgttttgcaaattcacttattagggatatcatataaatgcaatgctacttagaatgaaaaagttactaaaaagttttttttatttgtatgttatcagagaagaaaatgtatattttatttattgggaaaacagttaaattaattccatctcaaaatccatttagaaaatatttatctatttttatttttagtttttggatacttttttatttttatttttttaggtacataatagttgtaaatctttatgggctacatgtgagtatttcttacacgtaatgatcaagtcagaatatttggggtatccatcaccttgagtgtttatcatttttatgtgttggtgtcatttcaagccctctcttcttgttatttttaaatatacataatactgttgctaaatatagtcacactagtctgttatcaaacatcctcccaaccatcctcctcagttctattctttatgtacatgagattaaagttttttagttcccatatttgagtaagaatgtatgtcaaaatccgttttacaatttattttactacacatttgtattaggatacctctttcagatctgttgtttttggatggagggttttggtattccaagagcaggatccttggaaacccttcaaaacccttagagtattctagggaaaaacaaaacagaacaaaacaaagtcagcaacaaaaaagttaataagggtacttcctgagctgaaaatgtctgttgtctgaggttgttttttgttagttggtttttccttccctctcctccccgctctgtttctcccccactcctcccttccctcctccctcccctctcccctcccctctccgctcccctctctctcattctccttgcttcctcttcctttccatctcctctttctctcctctccctctcttctcttttccctgtttcctccttccctctcttacttcctccaatttcttccctccctctcttttcttttttttttgcaatggatgagcaagtgatgattcaacatgtaccatgtaaaggcactataccaggtgttagagacaagtataaataatagaaacaacagtttaaaaagatgcttagaaatgaagaacgtttgactgagttcctagttttataaattcagcaaacaaatattgtcttctatgtctttttttattttgctaggcactagggattttcctgctctcaagaggcttatattttaaatctatgcagtgctataatagaattatgtacaaaatgccatggaaatttacagaaaggagcatcttagctttagaaaatatttgttatactctgaattggaaacctagtacagacaccttgtattatgagtagttatcgctgtggctcacatctgtaatctcagcacttcgggaggccgaggcagacagatcatgaggtcaggagttccagaccagcctggccaacatggtgaaaccctgtcgctactaaaaatacaaaaattagctgggcatggtggaactcctgacctccttgtgcaatgcttttacaagtggttaatgtttctgaagagggtaggttagagggagtgttaagaggatggaaacctccttgtattgacctctccaagacggtgcgttcatgtcaaaaactaatcaagtgcagctgcaagattaattgtgtgaggaagctgtaaacatagaaaactatggcctctacccagagctctgttttatagacaagcattcactttagaactactgtcaatgaacctgactgagcaataatttgctcacttgagcctacagtggtagtatttaaaaattactgagcttgtaggggatgaggtagatacatatagatttctagttgaggcatttgaggaaactagagtaggtctgagtaaaggagaagatggaataaaataacttgggtttgtggctaggagcggtggctcatgcctgtaatcccagcactttgggaggccgaggcaggcgtatcacctgaggtcaggagttcgagaccagcctggccaacaaggtgaaactgcatctctactaaaaatacaaaaattagccaggcgtggtggcacgcgcctgtaatcccagctactagggaggctgaggcaggagaattgcttgaccctgggagacagaggtggcagtgaatcgagatcatgccactgcactccagcctgagcgacagagcaagactccatctcataaataaataaatacataacttgggtttgtaaagccattagagaaatttgccattattaacctctgaatcttttagcactgtaaactaaatggaatttcaatttaatcttcaatatggtttgcttctttctgtaagtttcattaataattgttaaaaagctctcattgaaattataattattagtaattttcactcaataattatagtcttagataagtaaaataataatttaaaattatgggatgatagttaacttttaattttaataggaaatagcttactcacctaaatagttgtaattaacatgaaccttcacaggttttagactcttctaaatacacccaaaaatataataagaaaataacctaactgtataattgaattatcttgttatgattttggtaatcttggaattcaagatggtcaaagttataaaatgatttctctgtaaagtatataggtaattttgtgatttcctttaatttttcttcttcattacagaccttatttttagagaagttttaggtacacagcaaaattaggtggaaaatagagaaacttcccatgtagagttccaaatacagaaagggtactgttctccccagtgtgcacagactcctccatgatcaacatccactccagaatgatatactttggtacaatcaaagaccttacattgacacatcattatcattcaatgttcatagtttacattaggattcactcttggtattgtatcttctgtgagcttcaacaaatgtataatgacatgtatctaccattatagcatcatacagaatagtttcactgctgcaaaaatcccatgtcctgttatccattgagccttccctctgcccaaacccctgaaaaccattgatcttttcactgtcttcatatttttgccttttccaaagtaagttatagatgtaaatgtatggtatgtagacttttcagggtggcttctttcactttaatatgtatttaagacatttaaatatttaataataggcattcttccatgtcttatcttagttggattgctcatttctttttggtgctgaatattaatccatggtattcttttaacttttaggaagtgaagaaagcttatatatgttagcactcttttttattttttaatctcaatttccatttctgctaagtacagttattcctgtttgtacgtgaggaagatgaggtacagagaagttatataactttcccaagatcatattggtaggaattataaattcaggatttgaaactggaagatcttgctcctgatacatcatcctgtcttggagaaggaatatgtaaaacatacataaaatcttatgtattgtaattttaagtacaacttaattttcattagaaatactgtctttttacatccttcatgttccattttttctgtatggaaaataaataagtgggttttggaaaattcaaatataatgagtttgtatagtatatattcctgtttcactaaagttttaactaaggtctcgtagatgcagtttaaatttcactaactttaagttttcattcaatacaaagtaaccttggctttcatccttcagtaatcttgtgattatacagctctcttgaggcagtcagtgaataaagtatggtaatttttaaggccatttttaagacgcctgctggttggaggagttaattttatcatatgatggcagttaatgttagctgtacattataaaagcccctgctttgtgaaatgtgaggagtgaatttggtgtttaacatgccttttttctacttcatattcttagaaaactgacatgaaaaattacatctataataagtagaatgaaaaatctcacttagtttgctaacatatattaatacttactctgcactaagccatccaggaactttgttttaatgtccagtaaagatgtatttcatagatatcattttataatgaaatctgtcttatgataaagatttaaacacacacacatacacatatatgcattcacttttggtatttattttttatgttatgttatgttatgttatgttatgttatgttatgttatgttatgttatgttatgtaatgttatgttatgttttacgttatgttatgttatatgaagtctggctgcgttgcccaaactggagtgcaatggcgtggtctcagctcattgcaacctccacctccctgattcaagtgattctcctgcctcagccccccaagtatctgggactacaggagtgcaccaccactcctggctaatttttgtatttttagtagagatgaggttttgccatgttggccaggctggtctcaaactcctgacctcaagtgatccacccacctcgacctcccaaagttttgggattacaggcgtaagccgccatgcccagactgttttattttattttttgagacaaggtctggctccatcacccaggctggagtgcagtggtgcaatctcggcttactgcaacctctgcctcctgggctcaagttatcctcccacctcagcctcctgaacagctgggactacacacatgccctaccgtgtccggttaatgtatgtgttttttgtagagatgggattttgccagcttgcccaggctggtctttaactcatagtttgcatttttattaacctgtgcaactgttgagagacaaatggcaaatcatatgtgtgtatgtaaaatatatttttatattatgtaggtgtgtatgtttaacactgcatgtaaataacgattgacatttgttgtcaagcactgtgtctcccaagtgaatttttttaaaagactttaaaaaaaaaaaaaaaaagcagaccgggcacggtggctcaagcctctaatcccagcactttgggaggccgaggcgggcggatcatgaggtcaggagatctagaccatcctggctaacacggtgaaaccccgtctctactaaaaatacaaaaaaattagctgggcgtggtggctggcgcctgtagtcccagctactcgggaggctgaggcaggagaatggcgtgaacccgggaggcggagcttgcagtgagccgagatcatgccactgcactccagcctgggcgacagagtgagactccgtctcaaaaaaaaaaaaaaaaaaaaaaaaaagcagttttagtttatgagcaaaattgagaaggtccagagatttctcatatacccaatggccccacacacattcataccctcccccattattaacatcccgcaccagactggacacttgttacaattgataaacctatattgacacattatcattactcaaagtacatagtttacattagggttcactcttaatgttgtacattctatgggtttggatgaatgtataatgacatgtatccatcattatagtatcatacagagtatttttgctccctcaaaaatcctctgtgctccctctattcatcctttaaccccctgaaacccttgacaatcagtaatcttactgtctccctagttttaccttttccagagtgtcatatagttgaaaccatacaatatgcagccttttcagatgggcttcttttcacttggcaataggcatttcagcttcctccatgtcttttcatggcttgtttctttttatggctcaatttctttttagaaccaaatgatattccttctggatgtaccagtttatttactcacctactggagaacatctcggttgcttctaagttttgacaattaggaatagagctctaataaacatttgtgtgctggtttttgtgtagacataagttttcagctcctttgtataagtaccgaggagcacaattgctggattgtatggtaaaaatatgtttaattttgtaagaaaccaccaaactgtcttccaaagtggctgtaccatttagtatttccatcagcaatgaatgagagttcctgttgtttcacatctttaacagtatttggtgctgccagtgttctgaattatggccgttctaataagtgtgtattggtatcttatcgttcgttttccaagtgaaatatttttgcctttatcatttcttttcttttctccactactcagtttttactaggttcttgtcaatcgtgcacaataatttttagaattatcctttttttttcaacttgactgcccatacaccattctgtaccctgttcctcttttggctcgtttactttcagtaatctaggaagtcttttctgttgcattttctctgtcactcattgattttgtttgttttttttatctaaaatggttctctctgaaagtcccctatgaatctatcatggatttatgtagccactgtttgttgagggaatgaatgaaatgaatattcgtacaatttttttttaccaaactcaagctgctttgcctagtttgcaaggccatctgtaatttgatttttttcttatctattctgttgttcttcctacttcttccctagagagtaccttttgtcccattcaagcagttatgcaatacagttgacctttgaacaacacaaggattaggagtgttgaccccttgcacagttaaaaatttgagaataatttttgactcctcaataatttaactactaatagcctactgtggaccagaagccttactgtagcataaacagtcaattaatgcattttgtgtcatatgtattatatactgtattcttataataaagtaagctagagaaaagaaaatgttattaagaaactcataaggaagaggaaatatgtttactgttctttaagtggaagtggatcatcataagtggaagtggatcatcataaagatcttttttctcatcatctttacactgaggaggaggctgaggaggaggaagaggaggaggttggtcctgctttctcaagggtggcagaggtggaagaaaatcaacatacaaatggatctgcacagttcatactcatgttgttcaagggtcaacttatattacttgttttatgactattcttttctttaattatttcttctatcaaaaattccctttatattctttttctaaattctacattctgctttaccttctccatgaaaccctctcagataatacttaatgttcccattttgtaaactattgcacttttaaaattagtgctttattgtttaatactaattattctctaattgaaatcatttttgccattttacctctggcaaaagtctgactgtcatctatgttctttatctgctgctgaaagaagtgtttagcttcagaagaagaaacgagaagtgacatagatggaaaataatggaggtctgaagatggctctaaataagacatgggagcatgattgaaacatacggttgttttatggaatattctgagattagattagatagggatatgattatttgatagagtagtagctgtggatttttagtaggcaataaggagctactgtagatacttgagtaagcatgatgtggtgaaaacattagaaagacatatctctcattagtttataatagattggaagaattgaatactaagaaacccgctagaagttgcttgtagtaatccagatattgatggataatgtatatattctagagtcaaaactcatagttgagcaggatcagaggatggaatagggtagaagtttttccatttttgtagagagacataattataccagtttatgtgaaactttgatactctttgaaagtttgatgcagcaagctgtgttacagccagcttttaaaaattattaattagtcatttacatttgtgatgttaatgttgtaggtgctagaggcatatgaataagacagtgtctcgtaatattttttcaaacctaagactgggctgaatataatattttaagttaagtttcgttcttgatctgtatcctcttgttttgagtctgtgccacattctctgcctctcactgtttcccaacatgctactggtcagaggataaggaattggggacttgggagaaatagtgagtacctgagtgtctgttagttctccctcagttcacagagaacatctttttggcagatatccttgatagaatgagtatgaggactcactttcttactaattataataaatctttgtttttcttatatctgtaggtctcatctggtctatctgcgctagtggttgtgaactactgctctagtcattttcaaatgtgattcatttgcaatatgtttattgaaacccaactttgtaataacattttatgaagttaagaaatgatatgcattagtttgaaaggaccatactctgttttagactgttggcaaaacttcagaaacagcatctgagactaactaatatgcagtttgtgaaatgctgtgattaatgttcaataatagtagtaatacatgtatatatgtagttgatagaaattgaagattgctgtattgttatatttcatatataacatgttataattaaagattgttatatttcatctcaaattattccaggactacaggaaggcaaatgatggtacatgtaactcattcagaaatttttgaatgttgtttttttcctcctattacatggtacaaattacttccataattgttcagagttgaacatatattgaaaaaaacagtataaaaatgaatctcacagtgaaggcaaatttttatgaagtatccatgatataacctgtggcagtgttgctaagaggttaatcagaaacatctgtaaacaacacaaacacttaatgttagtttaagaatatttattatatacacatcattgagttacctaaaataaaaagtttagtctacacaagtttaatatttaaacgtattttgacaggatactaatagcttttaaactattatagtaggaactattaatgtgggcattttcagttttacttcatagtcttgtgcatacatttgataattgcattagatggttatttaaacttgaaattatctctgtgcctagaggctttatttttaacatgtattttaagtttagtatgtatgttagaacctgtattggtcagaatatcctgctcaagagtaagattaaaaaaaattatccccagccttctatgatgcctaaaatcattaagacgttcattttatctacttgtaacatgattaggcaggatagctaagctgccaaagtggtagctagctactactataatcagatatttttctgattaaactcattgatgattagtacagaacagaatgctaggagaataggacaaaagatgggagaagagaggtaggaaacattttggaacatgcaactcagatatattttacattggagctttgggctatttgctttaggactttgggttcttgggaagaattctcaaagtggcaacaaggataaactttccttacaaagttttcctaggagtggtaaaattaataattctgcttttttattgactttggaagttccgctgtgactctcttaccttatggctctttttctgttattccctgtgatctttgctgtatttgaaatcattttagtagagttttcagatgtcccttagatctccttttgggattcaagggctgcgtatttccagtttaacaatttgtcattaagcaacattgtttacttaattgaaagcataaaatttcccagatatgataataatcatcaccatttattgaacctcatcagtgtgccaagtaatgtgctaaatgcatgatattcatttactatttcattaagttctcaaaacagccgtacaaggtatgcattcttagtcccatttaataaatttaacactgtcattttctattgctataatagaatactgcagactgtgtgatttataaagagaagtttatactcccctactggagcacctcatacctgtggtgtccccactgcctctgctggagcacttatgcccatgcctcccctgccatccccatggtgtgctcttgccagtagtctgggagcacgttgactcctccagcccagctggggctcgaccttaaaggaccagaggacaaaactgtgaacctggtctcaggcttttaggtttagagtatgcagcccaggagtgtggagctcagccttgccccctaaaaacatcaataaacaaagccattcaactatacccaacttgtgccacagtcaaagccctcaagggtaataaagaccttagaataaaaaagccccatccaaaggatggcagcttcaaaggggaaaggaacatcagtgctcacagatgagaaagaaccagccaagaattctggaagctctaaaagcagagtgtctttttacctccaaacgatcgcaatagctccttagcaatggatccagattgaaatggctgaaatgtcagacatagaattcagaatctgtgtggcaaggaagctcatcaggttacaagagttgattgagacccactccaaggaaaacagtgaaatgatccaagatttgaagactacataaccattttaagaataaaacaaactgaacttctagaaatgaaaaattcactacaggaatttcaaaatacaattggaagcactgatggtagaatagaccaagctgaggaaagaattgaagagcttgaagaccactcctttaagcacgcatgcagataaaaataaagaaaagaaattttaaaaaacaacacctctaagaaatatgggattaggtaaagagaccaaacctacaactcattggcattccaaaaagagaagtagagagagagagcaagcaacttggaaaacatatttcaggatatatttcatgaaaaatttcccaatctcactagagaggttgacatgcaaattcaagaaattcagagaacccctgtgagatactatgtaagacaaccatctccaagacatatagtcatcagattctccaaggtaaacacaaaagaaaaaatcttaaaggctgctagagacaaggggcaggtcacttacaatgggaaccccatcaggctaacagtggacctttcaggaggaaccttacaagctaaatgagatagggggcttattttcaatatccttaaataaataaattccaacaataatttcatatccctccaatctaagcttcataaagcaaaggaggaatgaaatccttttcagacaagcaaacgctaaaggactttgttacgactagatctgcacgatctcctagagggagtactaaacatggaaaagaaagaaagataccaaaacatgtataaggacataaccccattggcactataaagcaactatataatcaagtctacataacaaccagctaacagcacaatgacaggatcaaatcctcacatatcaatattgacccttaatgtcaatgggctgaatgccccactaaaaggcatacaggggcaagttggataaagaagccaagacccacctgtctactttcttcaagagacccatatcacaagtaatgacagccataggcacaaaataaagagatggagaaaggcctattagccaaatggaaaacaagagctggggtagctattcttatatcagaaaaaaacagactttaaactagtaatgatcagaaaggacaaagaagggcattgcataatgataaagagctcaatctaacaagaaaacctaactatcttaaatatatatgcactcaacattggagtacccagattcataaaacaggttcttatagatctacaaagagatttatataaccatatattaatagtgggagacttcaacaccctactagacagatcattgaggcagaaaactaacaaagatattctggactttaactcaacacgaccagttgtaccccatagagatctacagaacatccaagaacaacatccaagaacaacacatgttacatactctaaaatgaccacatgcttggccataaagcaagtctttttgagcaaattcaaaaaaattgaaacaccaaccacattattggaccacagtgcaataaaagtagaaatcattaccaagaagatctgttaaaaccatacaattacatggaagttaaacagcctgctcttgaatgacttttggctaaagaacaaaaattaaggcagaaataaaaaaaattacctgaaactaatgaaaacagagacacaatataccagaatctttggacacagctaaagcagcgttaagaggaaagtttacagtgctaaacacttacaacaagaaagtagaaagatctctaacaacataatgttgcacctagaggaactaggaaaacaagagcacaccaaccccaaagctagcagaagaaaataacctaaattagagctgaactgaatgaaattgagttgtgaaaatccatacaaaagatcaatggaaccaaaagttcgttctttgaaagattaaacaggattgttgtggcactagctagattaataaagaaacaaaaagaagatccaaataaacacaatccgaagtgatgaaggtgatattaccactgactccacagaaatagaaaaaatattctcagactattacagatacctctaggcacacaaactaggaaacctagatgaaatgaataaattcttggaaacacaacgcctcccaagattgaaccaagaagaaattaaaatcctgaacatactgatgatgagttcccaaaattgaatcagtaataaaaagcttactgaccaacaaaagccctggaccagattgactcacaggtaaattctattagacatacaaagaaatgctactactaatgctactgaaattattcaagaaaatcaaggaggggggactcctacctaactcactctgtgaagccagcatcattctgagagagcaacaaaaaaggaaaacttaaggccaatatccctgatgaatatagatgcaaaaatcctcaagaaaatactagtaaaacgaatccagcagcacatcaaagaattaactcaccatgattaaataggctgctgcctgggatgcaaggctgatttaacatgcaaatcagtaatgcaattcaccatatgaatgggattaagaatgaaaacaatgtgatcatttttaatagatgcagaaaaggcctttgataaaatacaatatcacttcatgctaaaaacctcaacaaattaggcattgaaataatataccttaaagtgataagagctatattatgacaaacccatagccaatgtcatactgaaatggcaacagctgaagcattccccttgagaactggagcaagatagggatacctactcttaccgctcctattcaatgtacttcgattttataaatttaaaactgaggcctctgagagcaggtcatacacagtaagggcttgaacttcaaagacttagtactttatagaataacacactacatcttagaatatgaaattttaatgaagttggattttgttatttcatatgaatatcctcattaaaacccttatacaacttcatactttttatgcatccttagttcatagagtattttaatagcagagctgtcattgtgaacttgtatatccttggtcttatattgcatcctattgtcatggactcagggagatccacaggataaaaagtatattgaagagaatcagggaaagaacatagaaggtaaggagatactgtagaattgaggaggccacaggaaccattgcagaatttggtgactttggcccattcaccctcttgaattcgtgtacattgtctttctatgtcttttaaaggttatttagctgattgggaggaagaaagtagaaagagaacagcaaaacagatctgtttttcgactgctcttttctactgagcccttatttataaaaattgtcaataaaatatcattgaaattctcttgggacagaatagcaggatagtttactgtttaagaaaaggctcctggctaacacggtgaaaccccgtctctactaaaaatacaaaaaattagctgggcgtggtggcaggcgcctgtagtcccagctactcgggaggttgaggcaggagaatggcgtgaacccgggaggtggagcttgcagtgagccgagaccacgccacggcattccagcctgggtgacagagggagactccgtctcaaaaaaaaaaataagaaaaaagaaaaggctcattggccttgtagcttcaagatcttgggcatttttatcaacttttttcatatgtaaaacaagtgtaataataactactcatatgattatttagaggagatattgtacatctgtctatccatttgtaaatggtaagacttgatacatagcaaatgcccaatagctggtaatgaatgttaccaggtagtacaattaatctgcataaaagttttgtttttgaattaaaacatgtagatctcttttagttttctaccccaagtagctgttacgcattttttttttctagtgaatggtagtaactgtgaatacctctcgccccaattgtgagagtcacaaatggattaaacagaaacatgtagaatagttactctaaatgatcagaattgttcccaggtcaaaataaaacttggatgaaatacagttgaatatattaataattttaaaggagaactttgtaaattacagaaggtattggtcattcaagaaagggagaacaaagggttgcagatgaaaggttagcagtgcctgagaagagagataccaaggctcacgtatataaatattctggctgggtgtagtggctcatgcctataattccagcactttgggaggccgaggtgggtggatcacctgagctcaggagtttgagaccatcctgggcaacaccgcaaaaccctgtctgcaccaaaaatacaaaaaattagctggacatggtggcatgtgcttgtggtcccagctactcaagaggctgaagtgagagaatctcttgagcctgagaagcggaggttgtagtgagctgggatcataccactgcactgcaacatgggtgacagagtgagacctgattttggaaaaaaaaaaaaaaaaaagaatacaaatattgtctaagaatgggcatatttttactgatttaataaaaattaatatacaaatttatagaaattactatttatttacaaattagtaattactaatagaaatgattggttttcttagtttgacatcactacataatagtcatactttaactcatctttctctggtctcatgttcacaagtaaatcttgtgattataatctgggttcttatggagcttacattccaaagagagtattcattgataagattctgagaatgtacagccctttggcagttaaattttatagcgaaaatttatgaattacatttctgctggatctgtttctcattgcttagtgtaattaggtgtttataaaatggtctctgtgtgtgttaagaaatcaggtttctttgcctgctaagagccaaactgatgcttctctaccagtgtcctgtggaagatgtaccatgaaattttaataaatgtaacttctattactactgcaactatacgattttgttttggcagtgtataacagaatatcaagctgaatacgtcataaaaaatgaccgagggtacctagagtgtaatgagaagtcagcatcaaataaagatttctggaccatttgcttctagagtcagtgagggagcacagttagagcagcatctacttacactcagagatcatctgcagaagattaattttcaagcttccatattaataggtagtttaagtagttcttccgtattagtaggtggtttctgttttgttcttccatattagtaggtagtttctgttttgttcttccatattagtaggtagtttctgttttgttcttccaaattagtaggtagtttctgttttgttctctactgaatctccagaatggtagtaggtgttcagttaattcttatacagtgaatgagtgaataaaataaatattcaatcagcgttgaatagaaggtcatttgtggacacattagaacctagaacatacctcttaatgacctagtaaagatgcagaattttgtactaacatatccattatcttgttctcaatgtagactgaaaacaataataaccgttcagtgtagcagtagaaaatatgtatataagtgaaccataacttcagcctttgcttcctttaacattccacagtgatgtgatatatgaaaaagagttttaaatacttagactgtttgattaaaaatggatctttttatgggtactgtgagacattactctatggtggtgtggtagtagtagttgttataatcattgctgactttagtgtttttctgagtcttaattctttaattccaaagtgctctgagaccacaaaaggatgagatccctgttctaaaaaataataataaaaataagaagagatccctgttctagaatggggtgaatgctcaaggtaatgtaatacttctggggacttacaggaccagcaggtgatcctctcctggtaccttgccagtgcaaagcagccttttttcaaacttccatgtactcaatcagtctttactattacagcagtgcagtacagtttttctggtgaacaagagaagtgaatggcaggattagttgtaggcatgctaacattttattaacagaagacctgtattgggaagttacatctttttaggctgtggtttagattatcaggtgaatgagaatttcctttaaggaaaacaccttacctatgtagaccagactctgtaacacttttttttttttgtattttcttttggctacagcaccaggttatgaggcaaaatatgtataaactaataattacagtgtttgcttagttaagtggttttattctgagtatttaaagctttttccccctatattacatcactacagaatgttatgggaaggaaaaactgaagctatggttgacttatgtagagtttttgctataacgactgattagttacaagatctttttcagccaaagttcttaataaagtatagagttaagatgtgttagcagccaaagtatgcatattattaggtcattgtaaaatatattctagagtttatatatccataattgaccttctattttatttaacactgatggaatagttaatgaagtatgggtgctaaataattttattgattgtattgaatgtttaagatcaatagaatttgttatttggtaatgcagaaatccaagttttccatgagtttgggactctttaaaatatatttaattatattaaattgtttacagaaggtgtcacatatttctttttcttatttagaacatactaaacaacttgtatcatttattattaactattactaatatgaaatactttataatacaataatatttacacatttaggacctactgaattggatagggttctttgttctacctaagtgatttccaggtaactattaattttgagtttcagttacttattatctattaccatataatgaactaccccaaaacttactggctttaaaacagtgacagttttatttgctcatgattctgtgagtcagtaatttggtcagggcttagctggacagctcttctgctggtatctcttgggattagtcatgcagctatagttgtttgggaccttgactggggctgcctggtcttaacatggtgtcacctgttaagttggtcatcggcttctctgtcattgttgcctctcatcctcaagttggctagttcatatttatgtaatgccctcaaggttccaagagaggaaagtggggcactggacttggaagttacacagagctacttttgccatattctgttggtcaaagtgagtgataagggctaacccaggaaggatggggaacttacctctctatctctgtctctaggagtggaacagcaagtcaaatggcaagggaagtatgcatacagggatgggagaaattgttgtggccaactttgtaaacagtgtatcattcttattgatgctttacttttcctttgctttcaactataacttcattgttatttatatgtttccctctagtatctcctgttttccctctcccttctatgctgaatttcctgctatctaatagcctcctcttaaccatagtgtcaatagttttgcttttcctggttttagttacctgtggtacagtacaagaagatgagagagaaagagagagagaccattcatgtaacttttattatagtatattgtaactgttctattttttattattgtaatttcttactgttcctaatttataaattaaactttatcacaggtatgtatgtataggaagaaacatagtgtatatagggtttggcattataagtagtttcagacatccactgggggtcttggaatggatcccctgcggataaggggggactacagtctttttgaaaatcccttagcttgtattgccaacatgatatgtaaactaagaacagacttaccttgagagtagacctaagatattctactacaagttaagtgcatggtgggtgtgaatttctctctcctgcctctgaaccttttttttttcttttgagaagcaagtgcaggggagagggtacagtggcttactctaccctgttgtttgactatgtgttgacgtagtgttttccaagatattcttcatgtattcccagagttttgcagagcctaccaggaactactatgtaacacagtatgagaggcaaatcaggactttagggtaccttatcctacctcaggcagagcatttctgcattcatttgttttactaaaagttttgcaggtctggttttgtttgagcaaagagtttctttgcttaaaaaacaaaactttaaaactactatttagataattggacttgttggctgagttttggatatgtgatgttaattatacagttaaaccataagcactttaaggttttataaaaatatatttgccttaagccatttctaaaatatattttccaattgagggatttaaatgctttgatttgatcaattactttaaaatgatgctttaaaaacacattttagaacacagcaatccaaaatttagagcatcaattacacaagaagtaaaattgtacaaaattaagggcttatttacatctaagtaagtagtgtatgtaataaaatagcataataaaaaggctctgagtatattgatggaggcatatcatttggtccaacaatgagggaataggtctttttaaaaactaacaacttaatctttatcagaaattgcctgtttaaatgaaaggtaaataatttgaaaagaaaaatgtaataaataagagggtatgtttttgagaatataaaagtttaaatattaaagtgtttataaatattgctataaatgcatgtgtgatccagggctgagctcatctggaatcgggaggtagaccaatttctctatatcccatgaatggcttgggcaactccttgaccattgggtatacagaatgttaattgatgttgtttgtgtgtctcttgtagttctcttgacctacaaagaatcaaggtgtagaagttatatatttgaagggctgggtttgtggaaaaatgatcagtgttttataaatctaggaattatgaatataatttagagaaaggcaaatttcagtacaataatgagaactgaccaaaaatggatttcaaatagaactgttctaaaaagggatttggggccgggtgcggtggctcctgcctgtaatctcagcactttgggaggctgaggtgggcagatcacctgaggatgggagttcaagatcagcgttaccaacatagagaaaccccgtctctgctaaatatgcaaagttagttcggcgtggcggctcatgcctgtaatcccagctactcgggagcctgaggcaggagaatcgcttgaaccagggaggtggaggttgcgtgagtcgagatcgtgccattgcactccagcctgggcaacaagagtgaaactctgtctcaaaaaaaaaaaaagaaggttggggtggtgggtttggttgcctggtaaagttgagaatttcctattctaggagatgtttaaacaaaagctagacagtgatcttttaggatcattgcagaggggattcatgtcatggagaagaggatggattagatagttctcaggcctttttcagtgcttaagattgtatgagtgttccaagtctttaagcttcttctagggcagtaattccaactgggggcaattttgtacatcttcctaaagacatttggctatgtttggaggcatttttagttgtcgtcattggtggggatggcagaggggtgctgtctaggtaaaggccagcgatgctactaaacatcctataatacaagacagcccttcttccctgccatgagccccacccagacaacaaataatttatccacccccaaatctcactagtgtcagtgttaaaaaactctagggatttaacttagaagtgggccctttgatctttaaaacttatctgggcctgaagttattaggccagataatactggcctttggcaaaggtatgaagtaggaaacacttactttgaacagattcttgccatatttgtaacatcatcacttccattgccctcatgctctgtaccacccctctagacctatcctcactaatgattcttggtctcatcaggcttagctcccttgggctctatttctttaacatctactatctgttacctagataatctgaaaaatgaatataccagctgatattgctttagtagtttttccttatggtgataatgcctaaatccccttttctgtcacagtgattcatggtaatcctgttggagccattcatgattccaagccgtcaactcacagggctataaaaatgtgctgtaggctgggcgcggtggctcatgcctgtaatcccagcactttagaaggccgaggcaggtggatcacttggggtcaggagttcgagatcagcccggccaatatggtgaaaccccgtctctactaaaaatacaaaaattagccaggcatggtggtgcacacctgtgatcccagctattcgggaggctaaggcaggagaatcgcttgaacccaggaggcagaggttgcagtgagctctgatcacgccactgcactccagcctgggtgacagagtgagactctgtctcaaaaaactgtgccgtaaaatttacaagttgtcattcacataaaacatatatgcatactttattaaagcaagacaatatgattcttgtctaatatctattcaaaattatttaaataaaattaaaacattagaaatatttacatgcatttatatgtagctaattagagctaacaactcagaggtagattagaatttcaatagaagcagtttgagtactggaaattatcaatactgagaatggtctacaatcatctgggtagaaatcacctaaattttggaggtcgtattattaatctaccaaggctaccgtaacaaaatactacagactagatggcttattcaatagaaatttgttttctcaaagttctggaggctacaagtctaagatcaaggtgctgtcagggttggtttctggtgagacctctttttttggcttatggacagcagccttcttggtatttccttacatgggctttcctctgtgcatgtggtcagggggtggtggcggggctggggggagagagccagggagagtgagagagtgagagcgaaagagcgagcaaggagcaagcatgtgagtaagtgagagctctctctggtgttgcttccacttcttatacagacaccaatcttactggattagggcctaacccttaagacctcatttaacctgagttactttcctaacagccatctcttcaaatacaggtgcattggggattagggctttaacatatgaatttttgggggacacaatcagttttataacatgaggtaactgaccataagttttacatgaaataatcagacaatagttttctgttgaaacttagttggcataagtaaactgctctgatgtgttttgtggtttagtgtcataacaatccaaagtgaaattcatgtcactatattattatagataatatgcaaacttttcttctagtcattcatgctgtagtcactactaagtattgagtgtataaaattggataatttatttttgctcagataggtctcaataaaaaagcatgtaaatgtctaggttctcatgaaatttttgaagcagagtaattagcaatactttaatgtttagttttcattaacaactggtcattttacccactttcctttatataaaaatgaaatcatgctccacaaatgccggtttataatttggctcctaacttgattaagatgaaggaatgtatgcttaggatagctcagacactgagatattgtataccaggaaccacctgctttccttagggcattttctgttaaaatattaatcaaactatttgttattaaagacagaatttccatgtgaagattttggctgacatatataaacatacctcatttttgccaagtcctatatttaacacactaaaaagagtacatttagaaatactcttcaggatttgtagcttccatcctaaattagtctggcttattgttactaattaaattttgaagactgagaaggccaggtcatatcactttcaaagtgctttggatattgcgagaacttagtttttgaggttattaccctgtttcactccagatcttcctggcatgacaatatggagttgttctactctgctaagatactgcttgttcatctcatttctaactttgtgggtggagacagcaatggtatttagacatcgtgttttagaaatatcccagagagaatgttctacatgttttggtgtgtagaattttatttcgagaagactctagcttgctttctaacctgtaagatatttttaaaagtagacacttaaaaaatctgagagttggataagaggtatgcctataacttatatgagtgattaaaaagaatttttaaaaatcttaaccatgaaatctatgtccaatatgtctatatgtttaataacctacattttcaaggtagttcgttggaataaaacctagaataaatatacatccatgttactgctattttaaaataaaaattaatgcggatgtattcacaaaataaaacaggagaagtaagctaaacctcgttgctatgctattgctactaaaaaaaagactggaaacattaagaatgctgttgtcataaagtttaaggtaatttgttcaattcttcccatgccttttaatgacatcttctggagaaaaaagattgagaagaaaaaccaaaactagtttttctttttgtgacaatttctactggaattgatgattatcaggttgtgaacataattgaggggctaaaataccatatgaggattgcattcttcattctgaaacctgttagtcttcttagatgcaggcattatgaaaaaaccagctaaagtggagactagactcagatttttatagtatattattttgggtttatttagaaagttcagtgaatacttcctttggtaagaggattccaaaggggaattgtgcacgtaaacctatttatttatacatacatgctaaatattgacaccatcgttgttagagtaatgttattttaggggttaaagtttgtataaacatttccagattttaattcctaaaattatggttttgcctgtagacagacactgattgcctgttgtgttttaggttatatggactagattcattcttgatgctctctgtacacaaattttgtgtaagatcttaaccacatgcaactagaatacaaaataaaagagagatttccatgatagaggtaacgtctggtctataaatttctttcttctatcactttggaattcataactaagagctgatcctggataaatgtgattttacagtttcactagattttcatccctatgtttattatcaaaatcatttttactgttgaaacaaagctagctcagcatttaagtttttactaattgctctagactcactggatattgaacaaagttggctgaatttttaaaaatattaaaatttcagccaatattaaaattgggctggggcccggcaccgtggtacacacctgtaatcccagaactttgggaggccgaggtgggcggattgtgaggtcaggagatcgagaccatcgaaaccccgtctctactaaaaatacaaaaaaattagccaggcggtggtgggcgcctgtaatcccagctactcaggaggctgaggcaggagaatggcgtgaacccggggggcggagcttgcagtgagccgagatagcgccactgcagtccggcctgggcgaaagagcgagactctgtctcaaaaaaaaaaaaaaaaaaaaaaaattattgctggtccgggcatggtggctcacgcctgtaatcccagcactttgggtggctgaggcaggcagatcacgaggtcaggagatcgagaccatcctggctaacacggtgaaaccccgtctctactaaaaatgcaaaaaaaattcgctgggcgtggtggcgggcgcctgtagtcccagctactcgggaggctgaggcaggagaatggcgtgaaccctggggggctgagcttgcagtgagccgagatcgcaccactgcactccagcctgtgtgacagagcaagactccgtctccaaaaaaaaaaaaataattactgggccgagcgtggtggcccacgcctcttatcccagcactttgggaggctgaggcgggcggatcacctgaggtcaggagttcgagaccagcctgactaacatagtgaaaccccgtctctattaaaaatacaaaaaatagctgggtgtggtggcgggcacctctagtcccagctactcgggaggctgaggcaggagaatggcgtgaacccaggaggtggaaggttgcagtgagctgagatcatgccattgcactccagcctgggcaataagagcgaaactgtctcaaaaaaaaagaaagaaagaaagaaaaaaaaatcactgttgattattgttatatcactctctaatctataaactgttaaaatacttttgtaagtattttgcaaaactctattcaacatcgttacatcttgtagtgatagactggattgctgagtttgtcatgctaattggagagggggacaaaagcacagaaaatgaagtttcttaaggttacacaacacaattgataggttatggtcagttgtttccttgctataataagcataggaagcttgaaaggaaaaaatcttgtgtgtagattaatttggaaagacataatcgagaagtctatattctgcagtaaatggagttgaaaagcactttttttttttttttttttctgagatggagtctcgcactttcgcccaggctggagcgcagtggcgcgatctcggctcactgcaagctctgcctcccgggttcatgctattctcctgcctcagcctcccgagtagctgtgactacaggcgccagccaccatgcccagctaattttttttttttgtatttttaatagagccggggtttcaccgtgttagccaggatggtctccatctcctgaccttgtgatctgcctgccttggtctcccaaagtgttgggattacacgcgtgagccaccgtggcccggcctgaaaagcacttctacagttcatctgattcagaatttaagtgcatacactcattgcgctttaagtcttcatttaactgcattagaaaaaaaaccccaaaaagtctgggcatggggggatcacctgaggtcaggagttccagaccagcctcgccaacatggtgaaacactgtctctactaaaaatacgcacatgcacgcacacacacacacacacacacacacacacaaaattagctgggtgtggttgtgtatgcctgtgattccagccactctggaggctgaagcaggagaatcgcttgaacttgggaggcagaggttgcagtgagccgagatcacaccactgcactccagcctgggtaagagagcaagactgtctaaaaaagaaagaaagaaagaaagaaaaaacccccaaaacattattagttcaggaccttttctgactgaagaaatgataacgggaactgagtatgaaaagaggaatttgcagctggataggtccaaaccaaaccagatatgagcaataccatgcctaattaaggaaagattttctcaaatgaattttggaatgaccatatgcccagggaactggtagatggcttgaggttgggcaacagggcagactatttgggagaactaagtgttactctgttatactaatatgtgagtaacgtactcatgtgctgtaattaaaacaagtaaagagattatatgtcctacttgttgttgatgggtgctttttcttgaattatgtattgggattaaactggctatcaatatacacttaaaaaaatgtggaactcagttagagggccactgttggccttttgtccacaaaaccttgtagtttagtgaagtagtgagtgagtgctatcttattggccaccttagtgaacaataatcttcattctagtgatctttcttagcttttgtcaaatgacagaaatctgaattgccatattggtatgtgctgtttgttatgtggccttgctgtgacctttctaaagtaatctagaagctcttatttatttatttttttaatgtctcaggaggaaaaacataatatcaccttaagcctggttcttattcttacttgaggttaatgggaataccaccctttggatgaaaatactgaacttactacaaattgttcatttataacaagcagacttcacatagatgacctgtctactttgccctactgaaaacataatattttttcagctgtaactttgccctgagttcatatagcacctttcttctccttctccgtatgctgaatgacatgtgagtttttttttttttttttctgaatttgaaaaagtaacatgtttggcagcattaggataaagaatgatctcttgtaagtttatataaacacattgaaaagcttactcatgcagtttatcctctcatcttactatatatgtaaacaagtgaggttttagtttttgttcataatatttagattatttattttggaaatttaaaaattatgcttcttacattgctgttcttcactagaataaataaggattatggaattttcctgtcaccttttcttaaatcttgttcattgtataggtaacgagcttcttaacacagactatattttaacttactgtttcatctactatacatgaaaatagtatgaaaatttcataatgaaattgaatgaaatttgtaaatgctataaatctttaatgggatttttaaaagtacttgagagaaatccatgacagctcatgggctttggaatcttacctggtttcaaaacctggctcaatcgcctaactatctatgtctctctaaatctcatctctaaagtaggggtaatgatccctacatcgcaggggtgttttgagcattacatgaaacagtgtatgttaaggacttcatataacatgtaacatatggtgaccattcaataacatctgcaatttatgaagttattactctataattattattattatgctgaactctgagattctcctcactcccttttttacaaggacagacacatcttgtaaaaaaaaaagtcattatcattaaaaatgcaattcaaaataaacaagaaaagaattaatgtggacaggaagagtgaggaactaaaaggagccatgggagagtttaaagatggatagttagtgaaggcaaatttctttttacctttggaagcattagggggattactcctactttggaagctcagtagtcactaaaccaacattattaagaataaagtactttttagaggcagaggggtataattgaaagcttcagtttgaagtcagacagtcctggctttgagtcttgcttcagctacttaaatattctgtgattttaggtgagtaccctaacttttgagtccaattgccttatctttaaagtaggaatggtaaaaacttgtctagtgcctggcaccattaataatttattattatgaatattgttttattcctcctcttttctttttctccatgttcattggttactttaaaaagaaatttgcctttattaactatccatctttaaactctcccatggctccttttagttcctcactcttcctgtccacagtaattcttttcttgtttattttgaattgcatttttaattataatgacttacaatgaccaattaattgaccataaaatagaggaaccatgggaaagaaaagatgcagctgaatgtcttggtaaattgtaaacctaaatcattagctaacctttacttccaataaactgcatttcctttacatggtaaatagagatgtgaataaaatgttttgggtgtttaatgatgatgtctaattagcttttatagtcccagctctgagagtatacttgaattagtattctgtttcatgaatgatttcttgtcttgattgttatttgaccattgaattttcttttatattttaaataaaggctggatttttccatatgtaaatctctatctgtaatctttcaagtagcaagttattttaaactgtttatttttaaaaatctgtcagcggaattagaattttgttgtaataaggactctaacttccaggatatagttaatattacttactgagtattgaaaactttactttaaattgtcctgtttttacagaagacaagatgcaactacaaataatgtacttactataaaaggacaggatagcatataggctgtacttcacccagccactctaacatatctgcttctacaaatggaatatttaaaggttaatgtgttgccagactctgtttagtggccttgaaggtataaatcaagaatggttgcctgggtgtggtagttcatgcctgtaatcccagcacttttagagtccgaggcaggtggatcacctgatatcaggggtttgagaccagcctgcctggccaacatggtgaaaccccgtgtctgctaaaaatacaaaaattagctgggtgtggtggcaaatgcctataatcccagctgctagagaggctgaggcatgagaatcacttgaacctgggaggtggaggttgcagtgagctgagattgccccagtgtactccagcctgggcaatagagtgagactccatttcaaaaaaagaaaaacaaaaacaaaaaaacacaatggccaatagtgcaagtaagagtctaggcctaagtttctggcatatttactgtgagtttccacactcaattcagtgaaagtaattttattttcttggtgtatacataaattctgagacttggcttattctatattattataatattatatattagttacaatatgcattgaaatgtttcttctacactgaaaaaaattgacttatggaatgatagaactttgaagttctgaagtatcttagggattaatgtaacttctttttatgggtgaaaaattaaggtttaaagaattacagtgatttcatcaagtttacagtcttaacctggagacccaggacttctttcttacttctagtctggcatttttggctctaaatgctctttaagatttttatactttccctgtatttgttttatcaaggaatagaaacataaaaaaaaattaggtaaagctgctaatccaacacaaatgaactaattaaaaaaatggactgtatattatgggagattttaattaaacaatgatttaaaaaatttgttatatgacaatacatagctatttaactttaggatagtgttgcttaaaattacatataagacaagtaaatattatgataatgatatgttgcatatattttgactttgaacacacattgtaaattataataatacttacttgttcagtaagagctgtattcacaaagagaccatgcaatagtctgttttcagaaaagttgaagatgcttagcagagtctaaagtttagtcttttaaaaaagtatatgaatgggagtactgtttagtttctttgacagatggtttctttaaatagaaactaacattataaaaactcttattatcaataacgtatctacgtatgtggttctaaaagactctgccctctgggactttgtgttctaagtaagtaagagttataaagaaagtatacaaacaacaccaaaaccattgcttaaatgtattaaataattaaaataacaatataatcagatgttttggtgagtgccacctataggatgaagtgtaaatacttctatcctattgtgttctattggaatatgcctgcatttccaccaaactatgttcttcagggcaacaagaatcaagtattaggtagttattttcccctagtgtgctgggactatagcagatatggaataaataaatgaaggagggtgagaatttgtggttccttgtcttttctgttttattcaagatcatgaaggctcctgaatccggagcttacctttctacatctgtctcctttcaagttgcagagttataaaatattagaaacacatgacaccagattaatttttgttgaatggataggtagaaacatgtctaaaatatgaatgaagtacagacggcgcaagaggaagcgtattgctcttcttgagaagagcaatgagtgtcagtatttatctgagtcatggaaggaagaggatcttaatgaatacggggggagatgagtttggtgaatagtgaaggctagctaggttcactactcactaagcaccaatgtctttggagatactcaagaaggaatggccacaggcactgtgatcaggtgcaaaaatcaaataatcaaatacactaatgaaaagcagaagagttctgtggtgggaaatagttaaatgtaccatgtgttcagttctctagtagaatttaaaatggatatatgttttaaccacttgcaggcttaaatagtaaaaacagctttctttaacaggctgtgtttaccttcagtcatgttcacatttttgatatttctgattattttaaggacttcctatattgtgattttgtttctttgctactgcttgtgaggcatagttttcgtgtaattctacatgacatagtgatgacagaatagtacagtttttcttgaaagttttgtaagacctataacaggaaacaatatattgtaaatctgtcatttcctacaaagtctttgcagagagaaaacactattttccagctgaatgaactttatttgcacattatttgttatactttctgtaccctcatgttatattggcttaatacattttgacgtttcttttatgtgtttgcttttatttaaccatccatatttttgttgataataaaattccatgttttcatataaatatattcagtttcaaaaaaacaaaatggtttctaaaaggccattaacccaactaaaaataaagcatacgaaaaagtagtttaaccaaccaaccagccaaccaaaaaaacaaacaaaaggattataaacctgggaggctcagcttcactaataagagagatgtaactataatatgaaataatatttctttcacccatcagactggcaaggataaaacagtttgataaaacacagtttttatgggtataggaaaataactagtgtaagggaatagctactttcatatgctgttgtggggagtatatattggtatagttttctttggaggtcaatttggcaatatttgtcaaaattaaaaatgtacttgtcctttgacaagaattcacctccagagatgtttacaaagtatgctttggtatttagaaatgtttattgcatccactctgattcataggagactttaaataaacttcagcatatccatatgtgtatgctttgtgtatgtaaaattgaaaagtatatgtctttaagacaatgtctttatttgatgtgtatctatgtacaaaggtatgtacatactcatacaacattctataaaagtccaaaagtcttagaagggaactttctttttgttgttattctgtttgaatttttgtttttatcatgtacatgcattactttttttgtatcagtttaacagcttttttgaggtgtagtttatatgctataagatttaccagtttaatatatcagtttcgtgggtttttcaaatatttactgagttgtgtggcatccaaccctgcaatctaattttaaaaccttttcatttcccccaaagaattcttgtacctattagcagtccttcctcatcatcccttagtagttcctctccatcaccccttactcctccaactctaggccaccactgttctactttctataggtggacttgcctgttctggaattttatattaagaatatcatacataattggtctttgtaattggcctctttcacttagcataatgtattaatgtatttgaggttcatccatgttttagtatgactgatattaatttttgaatttaaaactttttttaaaaaaagtgaaaacagcaatttcagaattactcatccttctgaagtatattgccccatggctgtgaagtggtaatgaattatagagaaattttttcaagttaaaaattaccatgtattgagcatctatgatggtgctagtcacactattaggctttatgtatgttacattatatataaatccttatggcatatgtaataggtagtattatattgtttctacaagtgaacaaattaaatgatatgatcattgattttttgtgtcaatttacacatgaaagtgtaaagtatatatatgtgcagatgtatactttgcagctaaagttaaaatatgtaaagtgctaaaacattgctgtaatacacagtgaaaatgtcattcactgtctagagatgtccagtagaactttttgcagtgatgagaatgatctatatctgtcctgtctgttatggtatccactaccacatatggcttttgattacttgagatatggctagggtgaatgaggaaacaaattttaatattatttaatttaattaaaattaaattaatttaaatttaaataaccacactctgattccagtcatgatttgatacccgtgatagatttgctcttccagttggagagtggaagcaacttgatcaaaaacatgaacaaagtctatgaaaaaatggtatgcaagatcctggatattaagtattgaaggacagtgttccctgagatataggaaacaaatgtgctctacagttacccaagcttactgtctagagagaatttccaggcatggatcaaagaggcgtcactcagacaaaacctagaggactttctgagttgaggaaataaagctcaaagtgtaggcggaccatgctggatagagttcacagaacaggggactagagaggaaagtactcagctgattactgagtagggcttacatgtgaggaaactgctccaggccaaagaaggaacaatctgaagaattagaggtttttaattgagtagttagcactcaaacaggaataggaatactgttttattagccagactggaaaatctcaaagattcacatggcattgggtaaagtacacataatgttttaccttagtaatggggaataattagccctggatttcatttcttgttaaaatatcttaaaagcaagtctttaaaagatcaaaccatttccaagtaactgtgtctcacgacaaagctcaagaaaacttatgggaatacaaacatagacaacatccattaaggtaaaatttagaatggctgacagccagtaaaaaattaccaccatgcaataagaaataggaaaatttgagccataatgaagagataaatcagcaaattaatgccaaatgagaacttataaatatgttaaattagcaggcaaagacattaaaaagagttatcataactgaattttatagtttcaaaaagttagagatatggaaatagggggaaaaaggaaaaatgaaacttctagagatgaaaattaaaatatgtgagatgaaaagcttactggattgtatcaatggcagattatacattgcagaataaaatattagtgaacctgaagacataagaatagagaccatctaaaatgaaacatagagagaaaagagactttttttttttttttgagacagagtctcattccatcacccaggctggagtgcagtggtgcaatctcactcactgcaacctctgtttcctgggttcaagcaattgtcatgtctcagtctcccaagtagctggaattacagatatgcaccattatgactgactaatttttgtatttttagtggagacagggttttgccatgttggacagactggtcatgaactcctgacctcaagtgatctgacaaccttggcctcccaaagtgctggggttacagggatgagccatcgcgcctggccaaggttttgttttttcttttttaatcaccaaataaagataacatctgtgagttgtgggtaacctattcatgtagttggagttcttgaagcagaggagaaaggagaagaaaaaataatgatgaaataatgactgaaaattactcaaatttaatagaaactgtaaacccacagatccaagtagcctaataattcctactacaggaaatattttgaagactaccccaggcacatcataacaaattgtgaaaagacaatggagtgacatttgtaaaccactgaaacagaatgatccatcaacccagaattctatacccagcaaaagtatctttcaaaacaaaatgaaaaaactttttgcagacctacatttttaagtcaaagtgattaaaatatgatgaatttagatgtatctgtacatacatgcactatggatgacaataatagcacaaaggtcgagggcagaaatggaaatacattattggaagatttgtattctatgtgttaagtagtataatgtcatttgaatatagacaatttagagatgtgtactataaaccataaaaccaacactaaaataaaccaacaaagggaataaaatggaattattgaaaaatactcagttactgggggcagtagcttatacctgtaatcccagcactttcagaggccaaggtgggcagatcacctgaggtcaggagtttgagaccagcctggctgacatggtgaaaccccatctctactaaaaatacaaaaattagctgggtgtggtgacacatgtctgtaatcccagctactggggaggctgaagcaggataattgcttgaacctgggaggtggaggttgcagtgagccgagattgcaccactgcactttagcctggtgacagagtgagagtccgtctcaaaaaacaaagcaaaacagaacaaaaactcagttaatctaaaaggggcaaaaaggaggggaaaaaacagtaagagacaagtagagaaataaatagcaagatgatagatttaaacataaggataccaataatcacattaaatgtaaatagtctaaatatctcaattaagacacaaagattttctgatagaataaaaaagcaggaaactattatatgctgcctacaagcaatgcacttcaaatataaagaccccaatcagttaaaactacaagagagctaacatcaagccaaagaaaggtggaattaccatccaacaaataatgggagaatgctataagcagctttttgggtgaatatgtttattattttgcttatgatgattattttacaggtatatagctatgttgaaacttatgaaattgtacactttaaatatgtacaatttatattaattatacctcaataaagctattaaatcatttagatagccacacgtgtccagtaactacagtattggactacagtatcctgtaatgtccttgagggtcagaattatatttaaatatcctatctagcaggtacagagtaaccacttggccaatatttgtttaatgaaggaatgtaagatacagctagctcagtgagtatgggcatatcacttaccttttcaggatctgagtttcctgatgaaaaaatatgatggtttgtttcaaaatttatctcagctctaaaattctgtaatttcaaacacagaggaaatattcttcattatttaactgtggatttagatttatttggaaaaatactttgtgaaagtcacaacgataaactagcacagttttaaaaactttttaaaaacttagctaaaaatgaaatgttgtttttagcatctttaactaaaataataacaaacatattttgcattaagttcccatctttcttgataaaatccaaaatccttccaggggctctatgcatatggtcctctggcttttctcttatagtgtctctgctaacaagtctcttcttctttgaccactttgtataaaataacaatccccagtcttctgtatttcttttttcttattctactttatttatctccaaaactcctactactgtctaacatacatctttttaaaaatatattctctcacctggctagaagataagttccatgagggcaaagacttttgtccattttgtgcattgttctaagttttagaacagtgcctggcacgtggtaggaattcagtaaatatttgtttaatgaatcagtcaattgcactgtaatatccttttgatttattctcctaattattggtgatattagagatttcaaaagggctgcctgattaaaaataatttctttccagatttatgtctctgggttaggtttttctatctagatcacttatgtcagttacaaaacaagataaaaacaatctgctgatgcctccacttttatatgcatcatctcactaattcttctaaataattcgaagtatgatattattctcagtttatagataaggggtctaaggtttagggaaattatataaagtatctagagttacccagaactaagattcaaacccagatctatcttactctaaagcttgagttcttaaacattgtactttttctcagtttcaagtgtattatttgtaaagataattatcagtttagtacgaacacagataggttagcatattaggatagaacctggcaacattttgagggaaggcagactttggatatttagagaagatgaagagtgtgtgaaagatttgtgggatacttctagagaggtttttagtgtgatctgcaagggggacactgattagtgcaggaaaagtctgaagcattgaacatctgggaaggatgacattgtccaacggggattgaatgatagagaaatttaaaaaaattgagtgtcatgactgggttttgttaggcaaattataaccagtaaataaacccacttagacttcaatttataatcaattagaataactgaaagttattttacatgctttaagttatgtttctaaaaacagtgaaatggtaaaatgaaccttatgcatcatggatagggtgttttaagtcagtggagaagagagatggagagaggaaggaaggagggaaagagggaggggaggagagtatgtgtgtttagcacagaaagattttatagatataaaatgttacataaatatatataatatttacttcatattaattgataacaatcctctttttcattggtatatttatatatttctaagtcattcaggctgtatgtataatgcttatcttaggctaagacagcaaacttgtcaagcttgatttgtaatggcaaaactaccatgctttcatcaggttgactagaaattatttgtgttagaaatagcaaaacattttttgcagtgttttcatttctgttcttgtggtcaccctttcacaatagaaagaaggttcatttcttatttgtctgtgatgtgaggccattgacgattcttaggcttaatttgtactgttgttttttaacataagaatgcattctacaattttaatttttgtgatttaaaacaacttttctaatctgtttttttggtataactaagacgttagtcaggactggagttctgggttccttcaacataccatcttaatatgttgtgtttactgtgatgtttttgagatcatcatttcagatgttcttgtgcctgcttctagaggaattacttttatagctagtctgtattccacaaaggaatattgtatttttatgagcttttcttattgattagaattggttgacaactggactatattttacattagaagatctggtcatcttcatatcatagttaataacctttctgatttattcactgaactgattatacaaaagctgttgtccttgtttttaagttaagcttgcatgtttaggctttctaacagacagttaaaaattagctgttcccttttttgtgaaccctgttacccttctatcccgtctatatatgtatgtattatatataattatatacatgatgatagttacatataagtattgcaatttattctcctaatatgggctatattaggggtgtccaatcttttagcttttctgggccacattggaagaagaaaaattgtcttgggccatacttgaaatacactaacactaatgatagttgatgaactaaaaaaaaattgcaaaaaaatcacaatgtttaaagaaagtttacaaattttgttggaccacattcaaagctgtcttggggctcatgcagcctgcaggctgcaggttgaacaagcttcgtttatatgaaaggttgaggaatatgaaatgtgtgtgactggtttgtatatccttttattgtttcaggcacaagatttaatagtattttgcttttatgagtcactcaaatggtgatgtcagtgttcttttgcaagtaatatattttctctttgttacaggtccttttgttttgcatcacagctgccatgtacatgttctttttcaggtatgttctgttatacttatttactttaataccccaaacagtatctctttgtaatttcatcaaccacgaaactaaagtattctccaaataattatcccttacaagcagcatactccccccgcacccccgcccagagtggacagaggtaaatcattgctcctttgtgagttaagaaaagagaaagagagggaaggaagacttattctccccaccccccattctatttataagttcatcctagaaagttgaatatgtcaattaataggactcaaatcctgataagtgaatttttatcttttatggacctgattgtatgtaaatacctaagtgtttttcactctgcttgtaaaacaatcaacattttacatttggataagaaaaaatgacagtagatctctatctaagccttctgcaaggataacctagcacattaatgatagtctgtaaaatattgtttgttataatgtcaaagttgtacttttcattgacactggtctcaggtttgttgggggctaaggggaagagtgttaggatggcccaagatttaaatgccagtaagagggatttctgccatcttcgtataatcccagcagtgtgcgaatgatttttgattagggagagtcccctcctttataatctttatttctttatttttagtgataccaattaatttccatttattttactcttattgccctcatttggatagatctttttatatatttatggatctagcaaaattcagtcttagcagacaggaccaggcttttcaaattaaaatctgtgcttaattagcaaagacagttgcggatttttagtaggatatatttggtagatatatttctttaagaataaaacaatccaaccataccagaatttttaaaaaaatttttatttttaatttttgtggggacatagtagttgtacatgagatgttttgatacagggatatgatgaataataaccagatgctattatcctttgtgttacaaacaatccaatttacactcttagttatttaaaaatgtacaatttattattgactatagtcaccctgttgtgctatcaaatagtaggtctcattctttcttttcctgtacccgttaatcacccccacctccccctgctccccactactcttaccaccctctggtaaccatcattctactctctatgtccatgagttcaattgttttgatttttagatcccacaaataagtgagaacatgtgacattttcctttctgtgcctggcttaattcacttaacataatgatctccagttccatctgtgttgcaaatgacaggatctcattcttttttatggctgaataatactccattgtatattatgtaccatattttatttatttattcatctgtcagtggacacttagcctgcttccaaattttgctattgtgaccagtgctgcaacaaacatgggagtacagatatctcttcgatatattgatttgctttattttgagtatatacccagcagtgggattgctggatcacataatagagatcataaatctctattatgtgatttttaaaccaccaatttcctgctagtatgtcctaataaacattttataaagcacaattatataattttaaattgttttgagttttaaaaatgtcatatgcaaataaaaaatgatgatgttactgtaattattcttgtaaagagacagccaggcttttagaaggggaaacatagatgacgagtcaaggtagggaggacttgaactgcaaaagattttgtatcagtcattgggatgcataggattttgtatcagtcattaatgactgaagaattattggagctgtctggttgtctttgtgaaattgtttgatctatttattacttttactgtatctgcatatgcaatacacttttcctgtggcctctttcctatattttaataatttagaagtgggttgtgggagttaggaacaatgactcattgatttctaaaaacttcttaattgtattcagacacattattaagacaatattccaaaaagttcacatagtttgtcttcatatttttatgttctatctagcctgaagatatagcatacccagtagggaaaatgcaatcgtaaaaagcttaaaaactagaaacataacttgttgacatacacaagaagaaagtccaatctcaagtaaattttctttttcgtgaaaattcctaacagaacaggtatttaaaatctttcccattgtggcacttaaagacatatgtgattaacgtgtagcatttcttagtcatcagaagtttttgaggtttaaaaataaatcatttgttaaatacaccaataaagacccaatttatagcatgggtctaggaaattatgttttgaaaactgctgccatcaacccagtatttttggtgtagaaagaaaatcaaccctataaatatgtgttttggtgcagagctacggaaccttttcctgtttcagtcacaagtctaggttaaaaacaacagtttaaaatactttccagaaggctcaatacaaggtttaagtgccaaaataaacacttttaattttctgaggaaaggggttgtttttctcctaaaagaagtactatcaccaaattcgctgttcttggcagaagtttgtttgaatagctcaacagaggtttggtaaatggtaaaatcaaacaatttataaagtattacaaccaaacaaaacaatattagatttgtctgtatgctagcttgtgttgggaatgaacaaacactattgtacataacacttggcaggtccaattgcatttgaatattttattttaaaattaaattttattataaatacatatatttgaggacacatttatttcatttattaacaattatgttaaatctaattgcatgaagttggatagtcaaatgatattgttcccaggactccatttatggtaacctcctttgagaagaggatagggaagaattttatatttgaaataagtcaacttgtgtttttatcctaatctgtgaatgggcaaaggggaaatggggaaatgaggcctgctttcaataaaaagaaaatatgccagttttttttttttcaaagaaagaacttgagaagtagtttcataaatattttccaaagatgtcacaagatgtgatgactatactatgaatttacttaaaagcaacacgtttttgatattgaaaactatgtgaaaactataatgtgtaatgaaataacttccttttacatagctcttaatagttttttaatagttattttacatatattatctcatatgttataatcagattttcatattatgcaccagaagtaaggcttacgttcaaatggaatcatccacttacttctggtgtgtaatgtgaaatgcttcaaggcttgggctggcaaaaggtactgtgcgaggagagggctctacttctgttctggtcagctggcctgccagccatgtagctagctatcacaagtgtctcttgatacccatacatgctatggattctgttaggaactggattacaagggaaggtgaaatatatcctgaggatgttttgaaagagctttttgtataatcttagtgggcattcttcataatagttttacatcctttgttcaatcaccttattattattatgtatgctattatcattgctgtaccttagggcattgtttgtttctatcgattttggccaagcagaagtcatatttaaaaactttttagaaaatttggtctcatgcaccccttgaaataatttctttacttccaaatatgtatttatgggcaaagcagtttgcattcatcataatttttcattcaggattgattggggtcttcccaacagtcatgtagaaaagagatcagtttcttttgattactaaatcttttaattaagaagcaaaagaaagaatcaacaataaacatcaaaactattgcacttaaccctactcacacataaaaaagaaaaatgcaacatttaaaaatattaattcattgattttatacccaccattaggtatctgtctatggggaatatttgagagaaaagaagtagttttgcataatttttatagataaatttaaaatagtactgtaaagtgtattataactccttcaatcccaacctagtaagtaccagctagaaattctttccacatccctttgcaaaagcaacaacaaatccaagtttattttaacatatagattgaattgtcatagcagttaatctatagactatatgggactgattcacagtagaaatatcttaaataatctgatgtcaacattgtgcagcatggcagtttcagttagaaatcagtgtaagtcagagtttattgttatactttaaacttttagaaacatttctttttgccatttgagaattctaatcaattctctgtgaaggcataaataaatgattttattagtctcaaggtgtagatttagtttatctatttaagaaaaccagactatttattggctggacaacctgcaagtcttgagtgaaagacttgtgattattcttgaacatctttatataaacataccttagtatattagagataactttagaagcatataaaaaacttttgatcttggcgtttaaaccatttactgatttttaagtgaaaggtctttaatgttaattcggttctatgtttatttttaatttttaaaatttttaatttttataggtatatagtaggtgtatatacttacagggtccatgagatgttttgatacaggcatacagtgcatacctaactgtcacatcaggataaatgattcattgcctcaagcatttatcatgtctctgtgttacaaacattctaattatattcttagttatttttaaatatacaataaattattgttgactgtagtcaccctgttgtgctatcaaatagtagttcttattctttgtatctaactatatttttgtactcattaacaaactccactaccctccaccctgccccaccactattttttccagcctctggtaacccgtattctactgtctatctccatgagttcaattgtcttaatttttagctttcataaatgagggagagaacatgtgatttttctctttgttttcctggcttattttacttaaagtccttgagtcccatccatgttgctgcaaatgacagcctttttttttaaaaaaaaatttattattattacactttaagttttagggtacatgtgcacaatgtgcaggttagttacatatgtatacatgtgccatgctgatgtgctgcacccattaacttgtcgtatagcattaggagatatacctaatgctctctccctgccccccaccccacaacagtccccagagtgtaatgttccccttcctgtgtccatgtgttctcattgttcagttcccacctatgagtgagaacatgcggtgtttggttttttgtccttgcgatagtttactgagaatgatgatttccaatttcatccatgtccctacaaaggacatgaactcatcattttttatggctgcatagtattccatggtgtatatatgccacattttcttaatccagtctatcattgtcggacatttgggttggttctaagtctttgctattgtgaatagtgccgcaataaacatacacgtgcatgtgtctttatagcagcatgttttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgggtcttttggctgcataaatgtcttcttttgagaagtgtctgttgatatcctttgcccactttttgatggggttgtttgtttttttcttgtaaatttgtttgagttcattgtagattctggatattagccctttgtcagatgagtaggttgcaaaaattttctcccattttgtaggatgcctgttcactctgatggtagtttcttttggtgtgcagaagctctttagtttaatgagatcccatttgtcaattttggcttttgttgccattgcttttggtgttttagacatgaagtccttgcccatgcctatgtcctgaatggtaatgcctaggttttcttctagggttttcatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccatcgatctatatctctgttttggtaccagtaccatgctgttttggttactgtagccttgtagtatagtttgaagtgaggtagcatgatgcctccagctttgttcttttggcttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctctttaatttccttgagcagtggtttgtagttctccttgaagaggtccttcatgtcccttgtaagttggattcctaggtattttattctctttgaagcaattgtgaatgggagttcactcatgatttggctctctgtttgtctgttatttgtgtataagaatgcttgtgatttttgtacattgattttgtatcctgagactttgctgaagttgcttatcagcttgagattttgggctgagacaatggggttttctagatatacaatcatgtcatctcaaaacagggacaatttgacttcctcttttcctaattgaataccctttatttcattctcctgcctaattgccctggccagaacttccaacactatgttgaataggagtggtgagagagggcatccctgtcttgtgccagttttcaaaggtaatgcttccagcttttgcccattcagtatgatattggctgtgggtttgtcatagatagctcttattattttgagatacgtcccatcaatacctagtttattgagagtttttagcatgaagagttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctatttattggaatagtttcagaaggaatggtaccagttcctccttgtacctctggtagaattcggctgtgaatccatctgtcctggactctttttggttggtaagctattgattattgccacaatttcagagcctgttattggtctattcagatattcaacttcttcctggtttagtcttgggaggatgtatgtgtcgaggaattcatccatttcttccacattttctagtttatttgcgtagaggtgtttgtagtattctctgatggtagtttgtatttctgtgggatcagtggtgatatcccctttatcattttttattgcatctatttgattcttctctcttttcttctttattagtcttgctagcggtctatcaatttttttgatcctttcaaagaaccagctcctggattcattaattttttgaagggttttttgtgtctctgtttccttcagttctgctctgattttagttatttcttgccttctgctagcttttgaatgtgtttgctcttgcttttctagttcttttaattgcgatgttcgggtgtcaattttggatctttcctgttttctcttgtgggcatttagtgctataaatttccctctgcgcagtgctttgaatgtgtcccagagattgtggtatgttgtatctttgttctccttggtttcaaagaacatctttatttctgccttcatttcgttatgtactcagtagtcattcaggagcaggttgttcagtttccatgtagttgagcggttttgagtgagtttcttaatcctgagttctaatttgattgcactgtggtctgagagacagttggttataatttctgttcttttacatttgctgaggagagctttacttccacgtatgtggtcaattttggaataggtgtggtgtggtgctgaaaaaaatatatattctgttgatttggggtggagggttctgtagatgtctgttaggtccgcttggtgcagagctgagttcaattgctaggtatccttgttaactttctgactcgctgatctgtctaatgttgacagtggggtgttaaagtctcccattattattgtgtgggagtctaagtctctttgtaggtcactcaggacttgctttatgaatctgggtgctcctgtattgggtgcatatgtatttaggatagttagctcttcttgttgaattgatccctttaccattacgtaatggccttctttgtctcttttgatttttgttggtttaaagtctgttttatcagagactaggattgcaacccctgcctttttttgttttccatttgcttggtagatcttcctccatccttttattttgagcctgtgtgtgtctgtgcacttgagatgggtttcctgagtacagcacactgatgggtcttgactctttatccaatttgccagtctgtgtcttttaattggagcatttagtccatttacattttaagttaatattgttatgtgtgaatttgatcctgtcattatgatgttagctggttattttgctcgttagttgttgcaatttcttcctagcctcaatggtctttacaatttggcatgattttgcagcggctggtaccggttgtgcctttccatgtttagtgcttccttcaggaactcttttagggcaggcctggtggtgacaaaatctctcggcatttgcttgtctgtaaagtattttatttctccttcacttatgaaggttagtttggctggatatgaaattctgggttgaaaattcttttctttaagaatgttgaatattggcccccactgtcttctggcttgtagagtttctgccaagagatccgctgttagtccaatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttgcattctccctgtcactttcaggtacaccagtcagacgtagatttggtgttttcacatagtcccatatttcttggaggctttgttcgtttctttgtgttcttttttctctaaacttcccttcttgcttcatttcattcatttgatcttccatcactgatacccttttttccagttgattgtgtcggctcctgaggcttctgcattcttcacgtagttctcgagccttggctttcagctccatcagctcctttaagcacttctctgtattggttatgctagttatacattcgtctaaatttttttcaaagttttcaacttctttgcctttggtttgaatttcctcctgtagctcagagtagtttgattgtctgaaggcttcttctctcaactcgtcaaagtcattctccgtccaacgttgttccattgctggtgaggagctgcgttcctttggaggaggagcggcactctgctttttagagtttccagtttttctgttctgttttttccccatctttgtggttttatctacttttggtctttgatgatggtgatgaacagatgggtttttggtgtggatgtcctttctgtttgttagttttccttctaacagacaggacgctcagctgcaggtctgttggagtttgctagaggtccactccagaccctgtttgcctgggtaccagcagccgtggctgcagaagagcggatttttgtgaaccatgaatgctgatgtctgatcgttcctctggaagttttgtctcagaggagtacctggccgtgtgaggtgtcggtctgcccctactgggggatgtttcccagttaggctgctcgggggtcaggggtcagggacccacttaaggaggcagtctgcccgttctcagatctccagctgtgtgctgggagaaccactactgtcttcaaaactgtcagacagggatatttaagtctgcacaggttactgctgtctttttgtttgtctgtgccattcccccagaggtggagcctacagaggcaggcaggcctccttgagctgtggtgggctccacccagttcgagcttcccagctgctttgtttacctaagcaagcctgggcaatggcaggcacccctcccccagcctcgctgccaccttgcagtttgatcacagactgctgtgctagcagtcagtcagactccgtgggcgtaggaccctccgagccaggtgtgggatataatctcctggtgcgccgttttttaagcctgtcggaaaagcgcagtattagggtgggagtgacccgattttccaggtgccgtctgtcacccctttctttgactaggaaagggaactccctgatcccttgtgcttcccaagtgaggcaatgcctcgccctgcttcggcttgcgtatgttgccctgcacccactgtactgcacccactctctggcactccctagtgagataaacccggtacctcagatggaaatgcagaaatcacccgtcttctgcgtcgctcacactgggggctttagactggagctgttcctattcagccatcttggctgccagcttgatagcctttttaaaaaaaaaaaaaaaaagaaaatagctgaatagcattccatcgtgagtgtgtactatattttgtttatccattcatgtgttgatgggaacttatattgcttgcaaatcttggctgttgtgaataatgctgcaataaatgtgagagtgcttgatatctctttgatatactgatttgctttcttttgggagtacacctagcagtgagattgctgtttcatattgtagttctatttttagttctttgagaaacctctaaactgttctccatagtggttgtactaatttacattgccaccaacagtgtacaagggttccttttcttcacatcttctcacagcatttgttattgcttgtcttttggataaaagccattttaactagggtgagatgatatctcattgtatttttgatttgcatttctctgatgatcagtgatgttgagcaccttcttatatacctgcttgccatttgtatgtcttcttttgaagaagtagtgtaattgtagtgtaatttgaagtcaggtaatatgattcttccaattttgttcttcttgcttatgatagctttggctatttttggtcatttgtggttccatataaattatatgatttttttttctatttctatgaagactgtcattgacattttgatcagattgtactgaatctgtagattgctttgggtagtgtggacattttgacaatactgattcttataatctatgaacatggaaatctttttattttttggtgtcctctttaatttcttgcatcagtgttttatagttttcattgtagagatcttccatttctttcgttaattcctaggtatttaattgtatttgtagctattgtaaatgggattactttcttgatttatttttcagaatgttcattgttgggatatagaaatgctactgattttagtatgttgatttggatcctgcaactttactgaatttgtttattctaatagtttttggtagagtctttaggtttttccatgtctatcatctgcaaagaaggataatttaacttctttgtttccaatttgaatttcatttctgtctcttgtctgattgctctagctaggacttccagtactacgttgaataacagtcatgaaagtgggcatccctgttgtgttccagatcttagaagaaaggctttcagttttttctcattcactatgatactatctgtgggtctgttgtgtgtgactgctattatgtggaagtatattcctttgatacccaggtttttgagggtttttatcatgaaaagatgttgaattttgttaagtgcttttccagcatcaattgaaatgagcatatgttttttgtttttcatagtttatatgatgtatcacattgattgatttatcttttcaaaaaaaccaactttttgtcttgttgatcttttgtattttttgtgtgtatttcatttatttctacattgatgttattttcttctgctaattttgggcttgctttgctcttttctagttctctaagatgcattgttaggttgtttaaaggttttctgtttttttgatgtgcttattgttataacttttctcttagtactgctttcacttagtactgatttgcttatgttgaaacatccttgtatccctgggataaatcccagtttttcatgatgaattatctttttactgtgctgtggaatttggtttgctagtattttgttgaggatttttgtatcagtgttcatcagatatattgacctgtagttttcttttattgctatgtgtttggttttgatatcagggtactattgtcctcatagaatgagtttggaagtattcttttctcctttatttttagaatagtttgagtaggattggtattagttcttatagtaaaattctgcagtgaaactatcaggttctggacttttctttgctgggaggctttttattacagcttcaatctcatcctttgtctttgatctattcaggttttggaattcttcatggttcaattttggtagattgtatgtgtctaggaatgtattcatttcttgaaggtattccaatttattggcatatagttgatcattatagtctcttaggagcatttgcatttctgctgtaattcagttgaattacatgaatcgcactgtctcctttttcatctctgatgtatttgtgcattttgtttagttattctggctaaagttttgtcgatctatttatcttttcaaaaaaccaacttttcatttttttgatcttttgtatttttgtatgtattttattctattttgatattattttcttctgctaattttgggcttggtttgctcttgcttttctagttctttaagatgcattgttatgttgtttgcttaaagtttttctgctttttgatgtaggtgcttattataaacttttctcttagtattgctttcactgtatttcatagattttggtttgttgtgtttccattttcatttgtttcaagaaatttttaaattttcttcttaattttttcattggtcactcaggagtgtattgtttaatgtctatgtgtagtttccaaagtttcctttgttattgacttctaatttttttccgttctggtcagagaagagacttgatatgatttcaagtttttgaattttttaagacttgttttgtggccaaatatatggtcttaggttctttttaaaaaaatattgcttaaaaatacataagaacctagcctaaataaatcaaattatatacagaatttagaggttaaaagttgtatttcagagttaggagatgtgccttaaataattagattttattgtaaagggattacttgcagcaatgcagagagtgaatttgggatttggagggagtatatcacaggtaataggggatgctcttgcagttatccagcagagaaatggtgaggacttgaccaaaacttatggcaatgatacggtggagagtaggtttatctgagatatgaggattgctgcttggatgaggaagatgaaaaacgctggaaggtaagcaaattataaaataggaaaaatgtgtgaaaattgaatacaagctttgcaaatactgaggctgaggttcttttatgacattcagctagagaaataatgggtaacagttgggtattcagagctcaggtgataaatctgggtcagggatagaaatttaggagttatcagcatgtagatattagtttaaaccatgcaggttgatagtgttctgtagtgagaatatggagagtaagaaaaagtgttccaagtatggactggagaatcttgatgtttgaagcataggcagtaggaaaggagtcagtaaagcagaggccagagtagtggcaagaggcattataaataccttgttaaatttaggtgctactgttagctgtcacactagctgtctgactttagacgaattacataactttgctacacctcattttcttcattatgaaaagtgtaaattaacatgtgggcctcataggtagggctttgaggattgaatacgacacattgtctttcaaatgtttttgatgtgacaacccaaaataagaacgatattttatatattatgattatgttaccatatatacatgtatatatatgtatataaatttcccagaaaaatactgaaccttcctacatgtgatatatttggatatttcctattctaatttatgtaattaaaaagctgctgtgactcactgatggctaacagccagtagtgagaaaaaacactgaactaaaacgcgtgagcacctagaacagtgactgatcacttagcaaacgcagagttaagagtagtgattgtttttaaaccaagagagaaagttgactaaatacacaatttcagtaaggacagcattatctttattgttattgctctagatgtatccagtaagtgagaggtaaaaagtcttcatctgcaatctgatggtcagtggtaagctgctagagaaatttctgtaggtgggttggggtagtggattaagaaataaatgtgaaataaggaagtaagagtgagtttagtaaactcaagaagcttgagagaaaaagatagggccatttgctagaggattaagggtttttcttttctttcttgtccccttcctaccctccttctctctctttcttagactggagagactagactctgggaaagtttaagtgaataagagaagattgaagaagcagacgagattgataaattggggaatgggaaagagaatagagtctaaactctggtccataatgtcaacatttaggggtagattattaaaattgtctgggaaaaattattataaatgattaggaagaaataaaatggtttggaagccttgcacatgtgttttaagtgaaagaggactgaaaaaaagtagaaaatagaaaaatctaatgctcgtggctttctaaatacatggtctttcttaaaagataatttaatttcttataaaaatagacatggagccgggcacagtggctcatgcctgtaatcccagcactttgggaggctgaggcaggtagatcacctgaggtcaggagtttgagaccagcctgaccaacatggagaaaccccgtcactactaaaaatacaaaattagccaggcatggggcacatgcctgtaatcccagctacttgggtggctgaggcaggagaatcgcctggacctgggaggtggaggctgtggtgagccaagatcacaccattgcactccagcctgggcaacaagagcagaactaaatctcaaaaaaaaaaaaaaattaaaatatatatgtgtgtgtgtgtgtgtgtgtgtgtgtgtgtgtattatatatagacaaggacaaacatgaagccattattcctcagaagatatatacagatgaaatgaggcacttctattattggcagccaaacctgtgagtttaccaaaaatgcaaaatttgttcaatgagaagaagtattgagattgttaggagtgttactttcctcaaaacaaatggaaaacatgagaaaacataggttcataaatgctgtgaatcatttcctgtgagaatacaaagcttattacaccaagtcacatgactgtgatctgactttctttattggtagaaaaaaattagcctgctcatttgttgagtgtactctaagaatgagaaacttgtggcaaatctgttgtcatttttttacctgtcagtctttgaggtagttgtgcccagatagttactctaacattttataatgaatataaattgttttagtagaaggcaaagagaaatattgtatggagaaacagcatgaacctaaaatgcgacccctaaggtaaggacttaatgggacacaatcatgtcaaaaatggccagttgcctttcagacacttgcaataaaaatgacattcttaggtggttttaaaaatgtgaatattttgtttgtgatttttcactgatgtcaaagttcaaaagtggatgacattcacatgtttttaaatcagtggaaaactcacaccactaatatgttattcattgctgatggtcttattctagttctacagtagttcccagaggttccactggatacagtagcctctttgtcaatcaagattgttgtttgaacttaaaggatgagccatatatatatatatatatatatatatatatatatatatatatatatatatatatatatatatatatcctggtgtacacttctaacctgatggaattttaacctgttagcattgttaaggtacatcaaattggcactgtgtaatcttatttctaagttacaatttacctagaatttaatagtaacaatcgttgtctcatgaaaaagtaaatttgtttcatgttttacaaattctttttatattattgacaaaaaattgataattcttataaattcagtttactctttagaagttatgagaaatgaaaataaattattcttgttttgaaaatgacagtccacagattttaaaaaaacattttttcaataaagcatttctgttttgagcaagaagggtgtcttatatataacaatctgttacctttgcagaagtctcagcacatcaaacattcataggtaaaagaaataattatgataaatttctaatatcagtggtgagtttttaaaataatttgagtatttttttcattgacaatgtcagtaatagtttattagtattggtgattactagagggagttttaggtaaaacagtacccagtaaatgtttgaatgaatgatactcagttaaaaaaatttaaggattagaagtaaaatttttagcctttcagagttttcattgacttaattaaaaaacatacatgtgttttaggagattccatggtagaatagaaattgtacagtcttcaatgccatatataacagacccctctttaggttttggctctaccacttacaaactctgtggccttcaataagatacttggcttctttcattttaaatttgtcatggataaaatgatctctgtggctatgaaaagttagaacacataatcctacaagaacataatatttttaaacattatttatgtttccaagcccatctttaaaagttattcaacctataaatgaatctataaaatatagttgaagtgcagtgccaatgctactatagaaacaaataatatttatgataatatttctttgggaaaatacattgatgtccagcatgttagcactaaagcaaaaggactgggaattatccagatgtgagctactccacaatcccatatttggagctagagttcagtgtgtgggtggatggcgagtgatgggacagaaggacagaactggagatcttagggagagaatggttaaaaacaaaataagggcctggtgtggcagctcattcctgtaattccagcattttaagagccaaggcaggaggattgtttgagcccaggggttcgataccagcttggacaacatagggagaccccatccctacaaaatataaaataacaaaactaaataggttaatactacaaattgaggagccaaaggattgggataatgatttaaagtggggcttttcctttccttcctctttttttccctttcttctccatttctcccccactctgacaccattctgactagaggaatttgggacagcacagtaaatgggactggacaaaaagggatcttggagtatagagtggagattggcacttcagagcaggtaggggtcggaagaagagggcagggcaaagaaacaaatgtgttggccctgaatttgcagaggagcaaaattctgccatccttctctctattgccagccttactctgaactagttgttagtgtatccattgaaaactggatttaaaaagctagaaagattaaaatgagtgatgaatgaagccaaacaaggtatccaatttttcttcattatttatatctttctggacatgttttatcataactaaataaagccacaggtgactcttaaagtatctgcaagagctgggcatggtggcacatgcctacagtcccagttacacaggaggctgagaaaggaagattgcttgagcccaggaattcagggctgtagtgcgctacgattgtgcctgtgagtagacactgtactccagcctgggcaacataaggagaatcttgtctcttgaaagaaaaaaaaaaaagtatctacaagcaatttaaaaaattatcatagccaaagagctgccatgcagttggccttctttctttatagttgactgtttctctccctgcctgtaagagaggaagtgaaggtgaagagaagggagggttaagaggaaatggttgctagaagcagtgaggtaagaggaggtcttcagtatttatctagagtagccttttatatttaaaggatatatattcattttgtgtgtatcttcaatgtagctataagacattattttcccagaatttgctagtatatcatctggttggtaagttacaaaactgggaataactttttaactttataatgaaatacattgatgtttcagggatctattaaaaacattgacctcaagacctgcctattaccctaaggggtagattactccctgtctccatgttaggacaaccttttaatggatgtcttttaaaatgaggttttgaagttataaacttatttgaatttacttttaaactaaatgtcgctttatgtttaaatattattagaggatccattatattagccaaaataagtgattccaactatataaacttacatacctttatacctcagttttaattacaactaattccacctcatttaggcttgagatataaatataatctgattttgaaaatatgagattaaagttatttggaataagatataatttgcaaattataaattcagaagttggaagcggttcgctatgaaaagatgaaaaaatgcagataccttaaagaattaacttttgggtttgtttacttaaattatgttgtaatatgtagtatgattcctcaaaatattttttaatttgggaatttatgatgaatataaaaagattcattgagaatgaggaagcttcatatagagacatgatgccctgtgaattaaagtcaataactggagttctgtagagtattttagaggacaatggcctcaaattaagattatattaaagtgattttttgggggcaaaaacatgtcttttgctcattgtggaaaaatgagcaaatatgattgaacaaaataataataattatcacccataatctcttctttcaaagacaagtaactaccagctttgtttgtatacttttagtctgttggctatgcctctatctgtctgttggtcctgcttgccctcactcttcctcttttcctccctcctttgcccctttctttcctcctgccttcacttctttcctctctccttccacacatttgtgtgtgtgtatgtgtatgtgtatatgtgtatatatgtctttcagcttctcaaatgagattatattatgtaggctatatgattatatgcctttgtatttccatataaaccctagaaatggattcttatactaatcttcagttcttcactaagaaactggtgataactcttagcaatgttgagtgtgactaaacatccaaacattatatcctttcgagttctggaatcctcttttgcatgctgtctgcttcttgtttaaggagcattattactaatcacagaaagttcttagatgagactttactgatacagatgctcaaatttgaagcagttaaatttaactgtttgctttactgcttgtgaggtgctataactcattgggctatgctataactcactgtgtctttctcaagcctgattctttctttctgttattttcttttgtttaagttctgtgtcggaggtaatcaaaagacactatagtgtagttgagagggaactctggggttcagctgtgttggttcaaatccttctccatcttacttgttttgtgactttgggtaagttatgtagcctctttgtgcctcacatttctcgtcttcagtggggataataatagtacttacctcatggggttattgtattgaatatctactgcatagtaagcactcaataaatgttagttgtttttattatttaaatctaagctgtaaacgtcatatttatatgattctatttatcaaaaatgtccagaatagaaaaatctgtagagataaaaattagattggtggcctaggggagttgggagtgtagggaatgactattaatgggtaagggttttttttagggttgatgaaaatgttctaaaagtaattgtggtgatggctgcacaagtctgaatataccagaaaccactgactgatacagtttagatagtgaattgtataatatttcaatggtatctcaataaaactgtgaatgtatttttaaatataaatctggcacattcttgatcaaaattaagtcacagattgccagatacaaactgaccacaagcacgtacttcctataccatatgtacgtctaagtccctttctaagaatacattccaatttagtatgaatagaaattacatttatagtctttagaaatataatcagttaataacttgattatattttctgcatatattatatatatttgattatatattgatattgattatattttacacaataattattttactgtattctgtgtttattttggggaaaagcctttttttttttcagttggaatcacttttaatatttaaatacaaaaaatgagcactggcttctctttttttaaacacacacacaaatctaacagccaaaatgtgcagaggaaatgagctcctgctctgtcttccccagtccccatcctgtggctaaagctgcagccagcctctttcctcttatacatagggattcatagtggccacattacaccacagttgtaatgcattttgtctgttttacattgtgtgcatgtccctccccaacagctccattctttaaggaaaaaaaagaaagcagtcattaatggtcaggggcacatccctcccactggtgtcagttcctaccccacaggagaaagtgagatcttccagttaggagcaattttgtgaaaagagtgtgtggccagagctggaataaccatttgcatggctgcactgtggtatcagagtgaagactgaagtaagtcaggatagtgtggagggcacagttgcaattaagtctcttcatgagacaatgtggggagatttcttcccaccaggtttagatggatcaatgtgccaaagttaaaaaaaaatccaaataatcagcagttcaaacacaattgaatttctgacttctcccacggagacagctcatatacggcagtaacaatctagatctttccaggaagtgaaggaagagccccttgcattcttcctgagagccctgtgttaggccctagaagtatctgctgctgctgcagttgctgctgttgctcggtttgcatcttctcagtctcaaagacaacgggaagaaccaggatcataaaggaagtggtcccaatccacacggctgccctgggaaacctgtacattttgtgagccacaaagagggagagaaagaagaggttctggccgcagaccggaccctcttcggaaacatctccatcaggccccatagtctctccgaccaggtctcatctagcttctcctcgtcgtcctcctccaactcctccttagtcttctccacgtcgccttttgggagcaattcctccggggataggggttcccctgcgacagcggccatggctgtaggggacaccagaagtggaaaaaaaggatagggaaaagatatttccaaaccactgtacttgccatggataatttttgaaatgaatgacaacacccagaaggaaattttatgtgtgtgtgtatatgtgtatgtgtgtacgcgtgtagagcgggaatacacacacacactacatatatatatcatgttacatttttttcctcttccatgggtctatttcagacatttttaagaattagcatagatagcacaaatggaaattttttggccttattccagtctacatccttaaaacttcaaataaaacatccatatttggaggcttatttttcatgttgtatagtttcagtgaatgggatcattgggagagaaagtacaccatcgatatacaagttcatctaaaattcacagcaaaacagaatattttcccaccattatcaattttcagcacattttgtttcagatgtgtgattgagtcactgagccaggaaaatgtttacctgcaaagtgagctaatagaaatgggagaagcttttaagttctaaaatttcagtcatctctgtctagcgtcttccctagaggaaggaaaaagtgggtctcttcccttttttattttcccttgttaatcacaaagcctctttgtactggtagggccttgatggtggctgagtgctggctgtttatcatgttcctgtcatcctcaaatgcaaaatgtaaagaggaggagaacacagctttgggttttcaagctttgtgacagcttaggacctctgaatctcagctgctctcaaatgctttctaaagtgatttgatcactgaaatggattatgcaatttttatggttttgagctctttgggcatgttcagaacaagaataatattaaaaatcagacagtggaaaacaattgagcttatcaggttagatttcttttattatcacaaaagcatccagttctattattggaaacacaattgttaacttctgtttcttccttgaatgttaaaaaatgtttgttgtatttgataattccaaattctaatattgtggatgaaccttccttgcagggtgtcattgtaagatattttcagggattcttatgaaagataaggctttccttatctcacttttgaaaaccaccagcaacttctactgatatgaaacacgtagagacatttattatagcaagcctaacttgttgaaattacttgaatgctaagaagtctataatcattaaaattccggtcactttcctgaatttattatctatttttttttggatttgtattacatcccttttaattttctgttacattataatatttaacaaaaactgtgtgagtaaatgcgagttagactgatggagcttttaccttcttaaaagaaataggcctaataaaatagggcattaattttttattgttctttgggaaaacagaaatagtactgataaggatgaaaaagaaaggtttttttttttaatcaaatgaggtatttctctttattgattcctaatgtgcagttgttgttaataaactgttacaaatttaaatgtctgatgtaagggctataaagcagttcccaaactttaacattgaatcttttaaaaatgcagattaagattcagtaggtctggggtgggatgtgagcttcagtagttccaacactctcccaggcgatgctagttctggtcctcgtgtcacactctgaatagcagagccataagtcacatcaggaaataacttctgtaattgtctttagaatctgtaattttaagaaattccagagaatttaattccactgcttctcttggcaacctattctagtacctcacaacaagtagagtcaagacgtttttctcaacatcttgaatttctgtaatgggaattttctcagttaaaacagaaaatagctattcatataattactttagaaggtcaaagattatcaggtctctttcccctccctcttcctttcttctcagcgccaacctcctttaatatttccttatgtatattttgccaaaatacatattctgccttgatttattacccagttttaactacaaatcttctatgtgggttagaaatcatgagtctgttaattatttagtagatgaattgataaaatagagacttttcttatccaaaatttctcgttaattaatgtgtgaaacaaaaaaattagaagtctccgtttctttttaaaattttgttaattgtataaataatacagtttcatttaaaaattcaaacaatgcaaaagtataaataataaaaatggaaaattctcacccctttatatacctccctctttgtacttctctctttttagttcaaaccatcttaacagtttgcatatatccttctagaattctttttttttgagactcgctttcatttaccctggagtgcagtggcacagtcatgactcactgcagcctcaaacgtctggccttaagcagtcctcccacctcagcctcctgggtggctgggaccacatgtgtgcaccaccactcctgtctaattttttagttttgttttttagaggcgggatccccttacgttgctcagggtggtctagaactcttgggttcaaggaatcggcctgccttggcctgccaaagtgttgagattgtggacatgagccatcaggttcaacacagaattatttctatacatacctttgtacctatgtttatatttttaaaaatgagatcacaaattatatattgttctgtagtgtttttctatttaataatgcatcttcggattctatccaaatgtcagtacatatcctcattgtttttaggggctgcaaaaaaaatctataaataagtatttaaaccttctcaacagacatttacactatttgcaggttttcgttgttgcaaactgtacaaccatgaacattgtttttaaaatatctttgtgctcctgttccagtatttctaaatttatgttactgtttatatattattgataggttagatacttagctacaaatggattcgctggttcaaatgtactagacatatttaatgttaatagatattgccagattgtcctccaaaaaaggcagtatccatgtattttcgctccaagagtgcttattgattcctacatcctagtttatgttggtaatttttatctttttgtcagtcaaatcatctaaaatgtaggtaatacctcatttttgctgtactttgaggtggaacaccttttcattggtttattagccatttcgatttcctacctctacctattttttatttttaaatttattgctctgatttgtaggagctctttacatgctattaatgtttgttccttcctgttatattgttgtatcaatcagctactgtaaacacaaccataaaatctgagtggcatataacagcaagccaattatctggccagctctgtttcatgctgcaggtctgtgggggcagttggggaagttcagctccccatatcttcattttgagccgtgagcggaggggacaaaaatctatgcaaggaaggctgtcttcatagcagtagcatgagatttgtttctattaacattgtctacaaaatattggatacatgtatacattaagtactttatttcaatttagcacatacatatctgctcatttaccaaggcgttttttgtgagtatgagttgcctaggtggagttctgagttgtttttgttataagatattgtcttttcaaagcattcaactcagttttcatggaaaaaaaaaacctttcttcctttttgttttatgtaatatgtaagccagttacgtaattacattaagaagtacaactgacatgaacacatttggggacaaatacagctgagtcttgacaagcatgtaacaactaatatgaagagaggtgtatgtggtcctatttggagtagtgttttatttttgagcaatcaatgtgcatattagaatatttacagagaaaataaggaaactaagataaatttgtcctatttaatctcttaaatggagattggatacaagaactgttactgtgaagagcacattttgaaaatatttgctaaattctgattcttcatattttgttactgcaatatcatcatcactgtcctcttctccattcctttagaattttttccatgtcttaaagctgtcaagatttggctcctaccatttttgctttggctcattatttatcctagtagagccagacttcactcatacttttactctaggaactggttgacatatttgacatatgtcttgattcttacgtattaaaagtaactgaagttcaaaaattcataaactgtaagctgatttagtgttctttttagtccagtatgttgcaacatttcataaataaaagtgttattctctaaagtgaataataccaatacttaagtttcacagaatcatagggttttagagtatgaagcaaagtagagattatgtaataagcattgtctattttctggtgaagaaaatgaacgtgaaaaatttttgtagcttttcttagatcacacagcagttagtggcagagacagaagtggaatttttgcataatttactttcaaataccattaattattttaaaacaattgaatattttgaaatttatgtgagggacatggcaaatagacccagtattatttttgtactcgtaaataccacattgtgatggcaagccttttagaaaggaaatatgaaattaaatgaaaaacctagaaattaaggaagatagaagtttggtaaaaaaattcttaatgtatattttggattttacatatgacatagtttaaactgtagtggaaatatcataccatgtcatggaatgctttatctttctatttgaaatagtaaatatttctaattagtgctgttaaaaatttttgaaattcctttattgtgactaggttttaaactagaaaagaggataaaagctactttgtagtcagatgtctatgatctctgtctatgtttcagtctctctctctctttttttctcctctcctccccaatctcacttttcttttctgttctttttcttttctttttttttgttgtttgttttctgcttttactttaatttataatgtctaggaagtaactagtaatccactatggcacctaacattattagtcatgtcattttaagtttgacaagtatgtagataaatggtattttagatccaaattaaatttatgttactgtttatatattattgatagtttctttttagtaggaaggaactatactttgcattagcatatgtttataatcgctcctgatcttttatcatgaattgatcactttttcttatgaaatgtattcagatatgtattgaagacttatttgaatgcagtctgtacattttaagaatttcagctgtttaatctctacaatgtagttccagccttaagctcactgtatatagtcagttgtcatttaaattcagtcttccagatctatggtaggttaattttatcaataaagtcaaaaaaatcttaaactttattctttgtttattagctttaagggcattatcttgcttatagtattaaagttcattttgttgagaaataattgactagattttcaaagagacataaaaagagattgtgtgttattttaaagctgtgaactacttgaaatgtcatgagatgggtctgaaattagttgtagaatatagttatattataggttatacattcttattttctagagtaaattggccacagtaataataagctacaattaaaacatgaaactttgacataaagaagaaattggaatgttactcacagctgttgtcataaaagagattgactagaaatttattgtctattcacacttagatcagctcttttggaaggaagaaatttagagctagaacaaataatatttaatgctcattttataaactgatagtgagaaatatagctagaagccaagatttttagtcctacacatctggttgtgatgattttggaatctttacactctgataatatgtctttgttatgattttagaatattttctggcccattcattaagcagatatggaagcaagtactgagtcagaccaagttcctgtcatccatgaagaatactggactcttttcattctgaaagagaacaattctttggattgtttcagggaaccattttaccatattacatataaattgagtctattactcctcaatgttttctcttctcttctttttcctctcttcctccaaatttgtttcttttgtttgactactatgtcagatcaaattttaataagcatctaaacacttctggaaaataattggtatgcaccttttatgaaatatttgaacgttctcttaaagatgaatttaacccaatcagccaccatttgatagcatatttaaagaaaataaaagaaacacttaactttaaaatagtgtttaggtggcttgtataggatgccaaattatctctgagataaaaacaggagcacatggtattttgtatttcatttcatcccttaggtcatagcttattattaaacattgtatagaaaatatcagtgatcattgtatgcactgagtcaatttcttattgagaatcttcctagttttctcattgttccttgagattctgagaaagtaatttaagatctctttacgtgcatataatttgtagtagtatactgagctattgatctattagccttacagctaaaaggttttcttgaaatcctttctgtttttgaacaaagattaaatgttattcatgactcacagtaatgaaaaaggaaatatttattttgaggataagccaatttatatattattggacattgcacagaccacccaggcctgaagcctactgtttatagttaaggattttaaatctacatatgctcttgaggagccagagttatctatattacaactggaaagttttgtgtctgcaaagggtaataatttcatgttctccacccctaagtccctcacccttggctggtaaaattcctgtcaagattattttatttccacaagagaaaaggctctttggacctcagtaataataacattgtgaaatttcatctatcaaaggactgatgttttaatattgttggaaaacactagagtcgtatttgtcttcaaaatcagtttgtttgaatatatatgtatgtatatatagcagaatgtagctgacttgtttttagtgcaaatttctagtttctttgaaggtttattttcctggccatcaaactttagaattcttcaaggattggttctagtctcccttattgtctctctttttttcattgtaaataatttatcccatgcttatagctttaactactatctaatgtaataggaggggagaaaagagaaaatggtgcaaaacaaaagctatcagacatgaatgaacctcctcagcttcccattagaaggtcatatctgttagcttctatggttctcactaaagcaggaggcagggtctttgctgaaagaaaggatagagggtcaaaggcctgaagagaatttatgtggtttgacgtacttgttttgtatagatcagactaaaatgacaggtttacctgggctgtattcaggatccctttgagtgtggtgattatgttttgttgtgtggttttctctagcagtacatagttgcctcattataggcatggagaaggtgattagtttcatctccggttggagttttgccaggtggaggtgatgtaagaactgaggagaaaggagcttaaggtggtagagtgtttcctagggtcatagaatttaagctggataaggaggatagtgagaagaaagtattggaaatggaaagaactatggagctaatgaattggaagtgtcttaagagtccaaagaactctgccatgagtggtaagtgaggtctagttatacattcatataaaatgtgtgttatattattaacaagttaacaaaaagcaatattagaattttagttccttcatggagagggaatggatgaaaaaaattatcatctatttatttcatttatttagatatataggaaaagatagattttgagctgagaaagtcctaaatgataagtaggaagtcactttctaatttccttcttttacacaagataagcattctagccaaccttctctaaagaatggaaaacttgctgtatctgatttcacatgattgtgggggctttattatatagcaaaagaaaaacaaaagtgtttttgtgaaaaaaaccatttcactggaaaggtatttttgtccacggaagttaatagtaagcatcaaatagttatgtaagtttatttctttttttatttggatttcgtgattgttttttgtgatacactatataaaaacttcatgaaagtatagaattatatacgtgatatacatttcaaaaactaatgcatgaaactaaatgtcatgatcagtattctttttttttgaaatggagtcagtctgttgcccaggctggagtgcagtggcatggtctccactcacagcaacctccacctcccgggttcaagtgattctcctgcctcagccttccgagtagctgggattacaggtgccaccacgacgcctggagaatttttgtatttttagtagagacggggtttcaccatgttgaccagaatggtctcgaactcctgacctcaggcaatcagcccaccttggcttcctaaagtgttgggattacaggtgtgagccaccacgcccggccatgatcagtgttcttatttccctgtaatacagtgtgccctagagtacaggataactaaacaaagtcctgttcacatgttcactttcaggggagattaagtacctactcttttttgcccggccctccccttccccctctcttcccttccctctcctttcctttatttcctttcctttcctttcttttcttttctttcttcttttctgtttttttgagactgggtcttactctgtctctcaggcaggcaccctcaccacacctagatatttatttatttatttatttatttatttatttatttatttgtaaagacggggtctccctatgttttccaggctgatctggaactcttgggctcatgcaatccccccaccttggcctcccaaagtgttgggattacaggtgtgaaccaccatgccaggcccctgctcctttctaaagatggtctgaatatgaatatttacatgtcttactgattatataccctttgtctatcaatgattgcattttagatgacttaaatttctaacaaatgatttaagaatttaaactggaatgagataaccttcttaatctttgttttaagagtgtattaagaccaaaatgtaaatctttagggtcaagaacattgaatggatgctcatagatttaacaaagaattctattttgtctcctatttgctattttttttttggctgcacaattagtaaacccaatttactaatgttgttgatattctttatttgttttgtatgttttgttgcttgtggaaacctgattagagcttttgagagtgtatttcggtcagaagtgatttattttgtgtatttaagctggatttcagctgtttgaggtttttctcttagaagcctaagtttcagatagcatctagattgaaaagacagttctgcttaagatgcctatcctagtctttcttaaatagtttaaattatttgtttttctaagtttcttataagtttatttagatttttaccttaaaaataacaatttatgcttaaacttgttgtagaggtaggattatagattttcaaaatcgcttttaaaaatggctagttttttttttttgaaatacgcaatgcacattttatttctcatttttcaaagcctggatttcctaattctttttttattatagtcttttaattaataacagctacagatataagcttagagtttcccccctactacacattgtccccgaggggacagaaaagcataatctactaagaatcttgtaatagatttcagagaggaagtttgctttagggtttttttttttttttttatgaggaagcttttttttttgtgcaagtgtggatttcttttcttttttttttaaattattatcatactttaagttttagggtacatgtgcacaatgtgcaggttagttacatatgtatacatgtgccatgctggtgtgctgcacccattaacttgtcatttagcattaggtatatctcctaatgctatccctcccccctcctcccaccccacaacagtccccagagtgtaatgttccccttcctgtgtccatgtgttctcattgttcaattcccacctatgagtgagaacatgtggtgtttggttttttgtccttgcgatagtttatgagaaggatgatttccaatttcatccatgtccctacaaaggacatgaactcatcgttttttatggctgcatagtattccatggtgtatatgtgccacattttcttaatccagtctatcattgatggacatttgggttggttctaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgatggccattctaactggtgtgagatggtatctcattgtggttttgatttgcatttctctgatggccagtgatggtgagcattttttcatgcatcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggatgcctgttcactctgatggtagtttcttttggtgtgcagaagctctttagtttaatgagatcccatttgtcaattttggcttttgttgccattgcttttggtgttttagacatgaagtccttgtccataaaaatggctagttttaaagaaggggaatgtgttaaaaaattacttctactttaagaattttaattagctaaattaatagcattcagtaggttgtctgtaaaaagtcctacaatatataactaaagaacatttccttagtgtttctaattcagaggttacatcctcttttaatatgaagaggaattaaatcattcccaccatatgatttgtcatatttactttttcctctgaaactaagtaagactttttgtagctctcctgtactccagagcacactgttcttgtggagaaataagaatattgatcatgacatcaagtttctataaactattgcttttttattttagtcaccaaaatataagcaattttatatgtaattttggcttataggacttatcaaacttttcctctattattaaagttgagttttacaaaaatcataatgcataaatttaaaaaatgttaacaatattttctagtcagacatgagctgtcattattctttggctacagattgctgtgtattttctctcacaagcttttttttttagaaactttttcagattcagataataaatacctgaaggaacacccgaataaatcataattcattttgtcttcatgtgactcacagtgataaaatacttttcatgaagcttgctatatcaggttacctatcagtttacttttaggaaggtcattgtgattgctgccttcttgactataatctttagaagaaagacctccttgaaaattatataccaccaccaaaaaaatatctgtaatcattgtcttacttagtttaggagctgttcaatttgatcaataaccagcccccaagagctacagtatggtcacattaatgtactatgaatttttttatgatttcaatatgaatgaagagaaaaaagttgtgccatgcattttattaccaccctatgaactttaatctttagaaagtcacttgatgtctgcaggctgcagttactttcgtgattatgtaaaacagcattgtccaatatggtagccactagcacatacggctattgagcccttgaaatgtggctagtcaaatgtagattgccgtaagtataaagcatacatcagatttcaaagacttggtatggataaagaatgcaaatattaataatattttatattgattatttgtttacatgataatatcttggatatattgggttaagtgaaatatattattaaaattaaagcctgggtgcagtggctcatgcctgtaatcctagcactttgggaggccaaggtaggcagattgcttgagcccaggagttcaagattagcctggtcaacatggtgaaatcccctctctataaaaaatacaaaaaaaatacctgagcttggcagcatgcgcttattgtcccagctactttggaggctgaggtgggaaaatcacctgagctcaggaagtcgaggctgcattgagcagagatcatgccactgcgctttagtctgggtgatgtcagagtgagacccccatctcaaagaacaattaaattaattttatatatttctttttacttttaaaaatatggctactagaaaatttcaaattacacatatagcctgcattatatttctttctttttcttttcttttttttttttttttttttaagacagagtttctctctgtcacccaggctggagtgcagaggtgagatatctgctcactgcaacctccccctccctggttccagcaattcccctccctcagcctcctgagtagctgagattacaggcacccgccaccacacccagctgattttcttgtatttttagtagagacggggtttcaccaggttggtcagactggtctcaaactcctgacctcaggcaatcctcccgcctcagtctcccaaagtgttgggattacagactggagccaccgcacctagccagcttgcattatatttctattggatgactctgctctagaagatgtaagatgacctctgtgaacctttctagtctcagcactgtgatgattcttaaaaaagtttttttttaatttctattttttgtgatgggatctcactctgtcacccaggctgaagtatagtggtgtgatcacagctcaatgcaaccttgacctcccaggctcaagtgagcttcccacctcagtctcctgagtagctgggactataggtgtgtgccaccatgcctggctaacttaaaaaatttttttgtagagatgaggtcttgctctgttgctgggctggtcttgaactcctgggctcaagcaattctcctgtttcagcctcccaaagttctggaactacagatgtgagccatcatacccagcatccagcactgtaatgattctgattgatactctgattaattctggaactatcattttatttttaattgttacaatgtctcttttgaggatttttacagtatgttattttggtatgtagagctctcggaaagttctttttttaaaatgtcttagtacattaaccatactctgaaagaatttagcctgtaagcttttaggctatagccgataagcctaggtcttctcatttttgaagctggaccattctgcctcgttatagcaattatcctgtctttcttccatcttattattgtttaaaaacctcttatatttattattctcagtgattttatttattccatccaaagctttggacctctttcttcactagggctaggatactgtagtagaaatagaatgtaggatttagattaaagacttagattctaaatctggtttctttttttattagctgagcaattctggacaagacactttgctaagcctccttttcatctgtaaatctgatgttgtgaggattaaataaaataccatacagatattgttattacctacccgtgtttatcagagatcttttcttttcagacttcttgacaatatttgacttcaaggatattatacttgtctagtatcctttattatttgccatttattctttttatcattttgatcttttctttcctttatccattgatattcttggttctaccaatctttagtccatcagactatggttataaagaaaaatagaagaaacatattgtattgctcacaaaatgaaaatcatcacttggaacctgcacctagatttgtaaaaactgaactaataaattcagaaaagaatctcaaacaccaagctggagaagggagaataagacaaattgttggaaaccagacccaagggaaagagagaaaggaactgaactacactgaatatatgtcatgttcctggcattgcttttgttagataattgatatattactttatattatgcacagcaaaatctttataataaatcttttaagggaaggtctcacctattttatagaggaggaaattgagtaacaggcatattaaataacattctcctaggctatttgggtccttattgtttatttgcatttttccccccaagatcattgttttggtaaacattgtttactttggacagttgagttatatgctaattatgtaggtagagttggtctcaagtatgctagcaaaaataaatgaaacttgagtgtttttaaacaaggataccagatatgagatttatgaaatatattttgcactgtttcggaaatgtatttctcctgaccatcctttagagtgggttgagtgggtagagtgggtagtagtaataattcaggaagccattccttcctaatctaggtatgtcgacaaaactttcaggtctgaaggctgctgaacactaaataattctaaataaatgaaataactaaataactctagctattctgccatctattccctttactggtaggcaaagctaaattggtaacttaaatctgtgaattatgccatgactttcaaggcgaaatccagacgtatttgaaatgtcttcacaaatgtggcttataacagtctctgccctcttccctcaaatgttttctctctgtctatacttttctgcttataagctccttactgccctattctcatacatgtctttcttgcgttctactagtacattcctcctttctgagattctttttcagaaagactaaaatatgctaaatatcttcttgtgctttaggagtcttacggcaaaaattctgtactgactcaaggatacaatacttagtaggagtgaatgaactcttgaaaaatatattttcaactccatgtcctcatattctcatattaaagaagattaaacaagataaatatcatttgagccaggtgtggtggctgatgcctgtaattccagcagctcaggagactgaggcagaaggactgcttgaggctaggagttcaaaaccagcctgggcaacatagcaagactgtgtgtgtgtgtgtgtgtgtgtgtgtgtgtgtgtgtgtgtgtttatatatttatatatgtgtgtatatatatgcatatatatttatatatatgtattatatatagataagatgattattaagttaactggtttctgaagaactcttttttccccctaaggagttctaagagacatcttttgtatttctagagcaaataaattttaacttctttttttgttttattattaaattaatattttgttgtaatattaaatgaatgaatatttgagatgcccttgtgtttatgttcagacccctgcaatttttctgttaaaataaaaaagcatgtgaagtgttactatgacatttggcaattttatttcaaagaactaaatataaaaatgttattttcttctcttctgcggcatggttgtcttttgtgttttcactttattttcctctttatcctcttggaatttagactctgaagcttgaatttccttcctttttttcaacaaagtgagatgcagaaaaaggcatggcatgaagtcaaaagtaaattcctatacttaagtgctagcaaccattacagacttcttgagaccaaagcctgcctatcagatgcttattggttgggtgaccatatgttctaaggcaagggctcttgactaactttaaagaggttgaattttgataccctgttgccaaaaattaaaaaaaaaataaccaaatatatcaccctgtgtattaagtatttgtctggcaggatactgaaaacctaaaatatagcccacacatgcaaacttgttggaagacaaagtacattttttagcaagttagagtctcagaataagaaaagccaaactagtctggattttattatttattatttattatttttatttttttgagatggagtttcactcttgttgcccaggctggagtacagtggcgcgatctcagctcactgcaaactcctcatcctgggttcaagcaattctcctgcctcagctcctcagtagctgggattacaggctcccaccaccacgcccagctaattttttgtattttttagtagagacggggtttcaccattttggccaggctggtcttgaactcctgacctcaggtgatccgcccgtctaggcctcccaaagtgctggaattacaggcatgagccaccgcgcctggccgctagtgtggattttaacattgtccttctgccttcctctactgccaagctccagaaggaccccaaccatgtagcatggaagagaaaattattttttgcattttaaaatcagagtattgcttttgactcagcaggatttcaagttacatatgcaaaggaaaatataaaattataaagactggacactaacgcacataaatcctatgttgagtgagtagttttgagatttttataactcttttattataaacatttaatcctcaatacattgttcttgatcattttctctgtttcagactgtataatattctttagttttcataacagtcttatatagtaagtaatagtatctgattttacatttgaggaaactgaagttctgtgatgtcaagtacttaaccaaaactggccaatttttagaacttgagttgtaactgcatcagaatttgatttctgagagcatcaaagctctgatcaggtcttcttactttaatcttagacttttagccaattttgttactctagtacattactatcaaaagtttatatatatatatatatacacacacatatatacttaagtttatataagagtgtttgtgtgtgtgtgtgtgtgtgtattcactgggagagatttcattgaatgtaacgcatagaattttatattcataagttatacaaaacttcttttagtgtgtttgtgaatttttttttttttttttttttgagatggagtctagctttgtcacccaggctgtatcgcggtagcgtgatctcgactcactgcaacctctgcctcccgggttccagtgattctcctgcctcagcctcccaagtagtggggattactggcatgcgaggccaccatgcctggctaatttttgtatttttagtagtgacagggtttcaccatgttggccaggctggtcttgaactcttgacctcagttggtccgcctgcctcggcctcccaaagtgctgggattacaggcgtgagccactttacctggcttttttttaaaaaataatttaatatttatggaactttggagtaggagaataaaactgcagaatttatattatgaatttttaggattaataaaattttgaaggtttcaatatatgtattttttacccaacatttcttacccagaagtattgctaacattatgtaaaaacaagatttttttgagaccgagtctcgctttgttgcccaggctggagtgcagtggtgtgatctcagctcactacaacctgcacctcccgggttcaagcgattcttgttcctcagccacctgagtagctgggattacagatttgtgccaccatgcctggctaatttttgtatttttgtagagatgaggtttcaccatgttagccaggctggtcttgaattcttggccttaagtgatccacctgccttggcctcccaaagtgctgagattacaggtgtgagccactgtgcctggcccaaaaacaagatttttaaaaacgtgaaactgccgtattggatcacatttgctgtactctgagaataagcagtagtaaacaactctgtttttgttttttgtttttttttgagacagagttttgcttttgtcccccatgctggagttcagtggcacaatcttggcttactacaacttccacttcctgggttcaatcaattctcctgcctcagcctccctagtaattgggattacaggcgcccaccaccacgcctggctaatttttgtatttttaatagagacagggtttcaccatattggccaggctggtctcgaactcctaaccttaggtgatctgccctcctcagcctgccaaagtgttgtgattacaggcgtgagccaccatgcccggccaactcttaacataaaatgttacttttataaattagaaagactttaattgtctaccctgtgacctaaacttgcttcttaatgatactctggagtcagtcactttctaatagatctatagatgatttaaaacattttatctatttttcccttgtaatgcatagctatgattatgtcattctgttcagaaatcctctgtgatttcctattgccttcaggacagtctaaattcttggaccaagtccttccattgtctagccttgctctacctgtatagaattctcttcactcaactcaagctatggtgatgttcctcaggcttttaccttgtatcctttgctagcctttgcatccttactgttacctctatactaaaaaattcagtctgcacaaatgatatcttttccctaaaaccatctttgattctttagttttgagcaatttctttattctttgaatttcataaagtgtaatgtgtttcataacacatatacatttgtaatctctaaaatatataattttttacctctagttctgttactgattcaggcaaattttcgttctttttttttttttgagacagagtctcactctgtcacccaggctgcacgatttttgctcactgcaacctccatctcccgggttcaagtgattctcctgcctcaacctccctattagctgggattacaggtgcctgccaccacgcccagataatttttgtatttttagtagagacaaggtttcaccacattgccacattgcccaggctggtctcgaactcctgacctcaagtgatctgcccgattcggtctcccagagtgctgggattacaggcatgaaccacataattttcattctttgaaaattaactttgagttataatttatatacaataaaaatatacacatttgaagagtatactctatgagttctatgagttttgacaaatgtaaccacccccaaggtcaaattcagaatattttcatcattctttaaaatttcttttgtgcatttttttgtagtcggtttctatctctcctctcatccctgatagcaggaacagatggatctgctctctgtcactttagattatgaaacttttttctagaatttcacaccagtggaatcatacagtatgcacctttgtgtctggctgcttctcagcatttttttttttttgaaattcatctattttgttgagtgtattagtagtttgttcttctttatagctgagcagtattttattatatggatatgccacaatttgtttatgcattcacatgttgatggactcatttctagttcaggtcatttttttttcatttggcaatttatatcacatgtaccattatcctcaattagtaaatgattgtgtactagtatgattatatcagtttgtatctttggaggaaggcctgtagtgatacatcttttagatcatggtgttaatttcaggggagatggtgtgtctacttctttttttctgtctgtggctcactgtttcaccttagagtttaagcctatgagcttgctatgggtaggaactgttaaatttttcttgtagtctcagtgtgtaagacagcaactgctataccctcatctttgtagttgtgtttgttttagtaatagcagcagcagtagtaataataaataacatttcttgagtgcttagtacaataatcacatgatgtaggtcctattatttgcattttacaggtggagaaacaggctcagaatgtaaacaacttgcttctctgaatctatagccctcgcttttaactctactgcctcagtgcttaataattgcttgttgaacagatatatgattgtgtaaatgaataatatttgcttcatagatctgtggacatagtggtaattacaaaaaagtatattgcttactccacctcatgtaacttattggtatagtcttggctttcatcattcttccctgtccccacaatacattaatgatgtgactttattattcacatacacacagaacaatatctagaacgacattatagctgactgaaatgaggttactctttgtgtcagagacagcctggatgaatgcctgagtgaatagtgataaataagcagacctttattatgtggaggcatcaagattttgtgattagtttgttaaaacaactagtattaattacctgaattttatagtttaattaagtttgatattttatgtaggcatctttacttagttgtaattttgaaggttattatttttaaactaatttgttaatctatcaaaaagttattaaaatatgtcttaaagttaatgtgtggtttaatcttttaaaataaagaacaaagtatatgtttagatggcattaatatcagttgctttcaaaaattcagcgtgtaggctgtcatttaaaaagtttaaacaaatagtaccaaatgagattataatttaaaaataaacaatggagtgagatttggtaataggtcatgaacatcaaacctggagtatctttgttaaacataggtctggttatgtcattcctctgagtagcaggaccttttgctttagaagtaaagttcaaattcgtttttggcatggtgtgacatgtgccagtctttctccatttggtttccatgtctctgtgttacagtcatattaaacctctcagttctcagaatatccagtgttttcttttttctaagtcttatatgtatttttcctccctgctttcttcctctacttcttttttatagcaccttaaatgtctttttctgaacagccttcatgacaccaaaatcaatgtcagacacacttgctttgtgctcctaaagcactgtgtactttatattaaagtactttctataatgtaatatcattatttgattgtacctataccttctggattgtgaattcctgaagccatcggcaatggctgtcctcagcacttgcaacctgcctggcacattgtcaactctttataaatacttatgaaatacttaactgtgtgaaggagtgaataaatgatgtaaaggtgaacaacactccaacctatagactttatggtctcacctcttttgctggatttcagttcctggtagcgtgatgaacatgcctatcagccgtatccgccttcctgccttttggatttgataaattcatactataatcactgttccatttcatttgtggtattaagaaatagctcctaattaagaaaagactggaagcccctatttagagtatgtatgtttatgtctaaatgtaaattcatagcacattatcaatataaagaaactaatggaactttatattaaggatgatctctgggagttgttaatgagtatagaggtacttgatgtaaaataaacaaatttctttagaaatggaaaatcaaaacaaaacaaaaaaccctacaattgctgtcaaagaaacaactacaagaaacttggcacccaaatagaaatagttaatataaaaatgcagtttttttcagtgattacatggacaaaaatttctttcaacatatatttcttgagttactcatgtactatgcactgtactaggcactggggacacatgcagacaaacacgtttatgtattcacatatagtgtaaaatactaattgatgtgttgtagactatcctatttctgaaaccagtaccagaaagattttaaatattatcacacttaaagtgaaaaaagttattgtgaaaaagactattgatagtattttatgaagaaaaagaaattgtgctttgaattttcttaaatataaacaaatacagttgatcttcaacaattatatacttggcgtgtatggtagactgtgttattgttcaaaaacctttgctgcccctccctggagaaactttatacttcccttccctattgacatcatgcctggagttacgacatgttttggctaaagaaatatgagtggaaatgatttatgtatacttatgagcaaaatctttaagtcagaacacagtttcctatgtttgttctttttctctgctgtgacaatcagcatttgcagataaagtttctctgttaccctaaggtacaaaatgaagatttcacgtagttgagccatagctaactcttgtttgacatgtagcgtgagcagaaaataaactttttttgttaaaaggcattgacattttgttactgcaacataacttagctcagtggttttcaagctttagcatttttaagaatcctgtggagattttgttaaaacacaagttgcagagattgttgggccccacacttagaatttctgaattcaggaggtctggagtggggaccaagaattatatttctaaagtgaaaagcttttatgaaggggaggtggataagagaagccagcatgaagtcttgaccaatggtacacactcaggcaaatcatgtttagataggagaacatgtggaagtgagcaactggacattggttcatttttttttttgccttttctttttgagttggagttttgctcttgttgcccagcctggagtgcaatgatgcaatctcggctcactgcaacctccgcctcccgggttcaagcgattctcctgtcccagcctcccaagtagctgagattacaggcacgagccaccatggccggctaatttttgtatttttagtagagaagggatttcaccatcttggccaggctggtctcgaactcctgactctcaggtgatccactcgcctcgacctcccaaagtgctgggattacaggcgtgagccaccgcatccggccaacactggtttctttaaaactatccatgcctgttgtcccttgtaaagtctttgcataaaaccagttggaagaccattgttctctacttcatttaggtgatttgtgttttcttttatattgtccaagatccctttacttgtctgtaatatttcatcttcactgttgagacttcagcaggtacagacagttaggtgattgggatgtatttacaatttgatcacttaacctccttgggccttggtttcttaatctatataatataattctctcatgttacttttgttccaatattttatttttctaataccattctatgggctagcaagattccattatgtgttgactctcccaatttctattattcataccacagattaagttcaaaatctttgagaggatgtaagctggagtatttgaaattaaatgtttctctttcttgggggtcaggatactctataagtcttcagctaatcagaaaatagtagcttctggccagatgcagtggctgcctgtaatcccagcactttgggaggctgaggcaggtggatcacctgaggtcgggagttcgagaccagcctggccaacatggtgaaaccctgtctctactgaaaatacaaaattagccaggtgtggtaccaggtgcctgtaatcccagctacttgggaggctgacacaggagaattgtttgaacccggaggtggaggttgcagtgagccgagaccgtgccattgcactccagcctgggcaacaagagtgaaattccatctcaaaaaaaaaaaaagaaaagaaaaagagaatagtagtttggaaaagcttacaaaatgttgtttttgctccattactaggagatgcatattttatttaactttggtatcaaataagcataaatttatgaaaaattttagcctgttatagttttgaatagctgctcattttgttcaatatgaaaacagattgctatattattttactgacatatatgccaatatgcatttgaaaataaattaatggggctgggtgcggtggctcacgccttgtaatgccagcactttgggaggccaaggcaggtggatcatgcagccaggagttcaagaccagccaggccaagatggtgaaaccctgtttctgctaaaaatacaaaaattagctgggcgtggtggcgggcgcctgtaatcccagctacttgggaggctgaggcagagaactggcttgaacttgggtggtggaggttgcagtgagccgagatcgcgtcattgcactccagcctgggtgacagagcgagactccatctcaaaaaataaaaaaagaaaagaaattaatgttgattcgaagattctgtttaattgaaaacatttgttttcatatttttcactatgtttgtagaagggaaaaaactgaaagtatttgtttgtcttgaggtctttaaaaaatagattggttcagaattgtgattataattttgtttaatgtaaataattttggttcgtagcaatgccataattttaagacacttgctaaatttttccttggatttacatgaaacattatttgatatttttttggttgttgcctatagttaatttgttaagtctgcactcatgccatttccttgggaactgcaaacaggcctttcagtttaggtccaatgaaaccacaatctgctccttttacaactattttaaagtttgactagtgttactattaccagttcattttcagaaggaaatttattctgattaacatttcttttagaaacagtctgaaggtgattcttggtttcttagcaatttaaggctgctttggaacatgaccttcctagtttggactttaaagcagaaacagttccagcttctccaagtttaaggagaaatctgattctattggagttgttgctgtaagttttagtccaactgtttccaatttatagttaggacacaccagaaaaaagtgcacaattatcgtctggggacttagaatctcacttgattacccataactgcggcctgcttcagcagctttgcttgggctcttgaagacaaagccaagtatcagtgttccattctgtatgaaataaatgtactgtgaaatatttatcagaatagaaaataatatttttaatacactggggaatttcactatttaaaggaattctattggaagttattgaagatataatgtgttcataaaggaaacaaaataatcttccccaaatttcttaatttcttgctatttcaagttcagatatttgtatgtgagttttcttaaaatagggatacaacattagtagttgagttttctcatactaagtgccatatgaaggctgaaactgaactctcttagtccattttattattcaaacaaaatttaacatgaaaaccttttgtatgtatataagccatgtaatctattaaccacacactacaagttttgcatagtaaattgaaataatcaatttaacctattggaatatacttatgtgattagaatattgaacatttttcaaaacaaaacaaaaataaaagtctgaaagtaatttcatgttaatattttcttggtaatcgtatgataagcaagcatcaatcaaaatgtacaattgttgatcatgtgtcaaatactaaattataagttagtactaaggtaagctctatacttgaaaatgggttggaaaattaattacaaaatctagtgtattcttttacgtgggtttttaaaaacagaataagaaaaatttaattaaaactatgtctgaaattggtgggttcttggtctcactgacttcaagaatgaagctgcagaccctcgcggtgagtgttacagttcttaaagatggtgtgtctggagtttattccttctgatgttcggatgtgttcagagtttcttccttttggtgggttcatggactcactggcttcaggagtgtagctgcagaccttcatggtaagtgttacagctcttaaggtggcacgtctggagttgttcgttcctcccacccagagttgttcattccacctgttgggttcatggtctcgctggcctcaggagtgaagctgcagacctttgcagtaagtgtcacagctcataaaagaagtgcggacctaaagagtgagcagcagcaagaggtattgcaaagagcgaaagaacaaagctttcacagcgtggaaggggacccgagcaggttggcactgctgactctggcagcttgcttttttccccttatctggccccaccctcatcctgctgattggtccattttacagacagctgattggtccattttatagagagctgattggtccgttttacagagagctgattggtccgttttgacagggtgctgattggtgcgtttataatccctgagctagacacagagtgctgattggtgcatttacaatcctctagctagacataaaagttctccaagtcctcaccagattagctagttacagagtgctgattggtgcatttacaaaccttgaggtagacacagggtgctgattggtgcgtttacaaaccttgagctagacgcagaatgctgattggtgtatttacgatcctttagctagacataaaagttctccaagtccccactagattagctagacacagagcactgattggtgcatttacaaaccttgagctagacacagggtgctgagtggtgtgtttacaaaccttgagctagacacagagtgcttattggtgtatttacgatcctttagctagacatattctccaagtccccaccagattagctagctacagagtgctgattggtgcatccatgaaccccgagctagacacagagtactgattggtgcatatacaatcctctggctagacataaaagttctccaagtccccacccgactcaggagcccagctggcttcgcctagtggaccctgcgccagggccacgggcggagctgcctgccagtcccgtgctgcgcgcctgcactactcagcccttaggcggtcgatgggaccgggggccacagagcagggggcggcgcccgtcagagaggctggggctgtgtgggagcacaccacggggtgggggtggggctcgggcatggtgggctgcaagactacataaaattgcatgaattttctttagaataaagagaattgggagtcacaaattagaggcatttaaataggcatcctggttcctttttgactttcaaattaaacttttcaattgtattcactctgattaaatttatgcttacggtaacaagactaatcagaattttgaagttccagctattgtctgtaactgttatatgtcattcttttcataactccaacataaatgtttacacttgaactttcagcattttctgttttaattaattttgttcacataaaataatgtaacttttaattttgatactgagtgacttagatggctgatataatcagaatagaatagaatattttaagaattatcaatgtgcactattttaaatccaatttttctttattttttgctaactgaatcttttcacatatttaattgtgctttagcatgtatgtaacactttactccaattgaataatttgaggtagatgatgtaaaatgctgaataaaagaaatttagagctgaactcatgaagtacaaatagagtagctcttaaaaagctacctttgcattcttcaagtgatcagcaacacaatgtcttctgtatattagatgctcaattaatgttgagtgaataaagatatatcatgtaatatttaatgaatatttgagtttccttctagtttaatgagtaaaagaaggactctgaagtgccccaattgatacttaataaatgtttgttttttggccgggcgcagtggctcaagcctgtaatcccagcactttgggaggctgaggcgggcagatcatgaggtcaagagatcaagaccatcctggtcaacatggtgaaaccccgtctctactaaaaatacaaaaattagccgggcctagtggcaggtgcctataatcccagctagtcgggaagctgaggcaggagaatcgcttgaacccaggaggcggagattgcagtgagctgagatcacaccactgcactccagcctggcgacagagtgagactgcgtctcataaattaataaataataaataaatgtatgtatgtatgtatgtattttttatcattatagttacctaattatccatgttcattgggatcatagtttcaaaaaatttcagcctaaatcatttatttcagatagttgttttgtgcctctttctagcaaaacttttacaaccctgttaattagtaaagttgactagtttgagttttatattctttgccatttgttggtggaataaagatgaataacttttgccctgttcaatctgttcctaaatgatcaagaattgatttttaagattaaactgtacaaataatatataaatttatgcttattgtaaaaatttaaagtgatgtagccccatagaaagtaaaaagttatattttcctgcatgcctcttaactcatccaacttcaataggtagtccactacccacagtttggttttatacgtatcctattagaggactttctgtaacaatgccatatgtaaataataaacagcattttatattttactattaatattttagcaccaatgctaaatatagcaataatattttatcattaatcagattatgtatatcgaattgcttcttttacttaacagtgtttcatacaggtctttctatagcagtgtatatctatcccagtagttggtcttgaaagaccaagtttgaaacttgaaaagtttctctttgaacctttgcatgaagaagttccacctcaataagttttataaaatgataagcaagtataatactcttagtagcaactagtaatcttaacacaaattcagagttttgtttgtatgtttggttttattcttggggctagtgagatcatttctctttttacatcataagtgattgagaagaattcattctgtttttccattgtgatttttaataataaagctaccattaactaaaatgatgaaatttcagaattataaatcatttaatcagccagttatttatggtagtcatttacttttagtttttttatatacaaggatattgagccctaaagttaagtgatttactcaagattgtagagaagttatgagtagcatctgtatcctttctcatatcaagatttttttcactacaccatgcgttgcctctgaagaaatactttttttcattttttaggtgtttatttaaaatgcgtaatataagcacagtggcacatgcctgtgatcccagctacttgggaggccgaggtgggaggattgtttgagtccaggagtttaagaccagcttggacaacatagggagatcccatcttggggggtgaggaggaagaagtaataaataagtaaataaaacaagtaatattgttttagatgcttatatttttcttatgtaaaaattgacacattaactttattgtgaaaacgtgattacaatcacagacatgcaatggaaaaaaattccatattgtctgcaccttcttctgagaccacattttgtgtgtatgtaatgtattttatcttttaaaaaattgagaaataattgtacatattcatgggagtatacagtgatgttttaatacatatatagttattagatctgggtaattggcatatctgtaatctcaaatatttatcacgtctttgtattgggaatattcaatattctccttctagctatttgaaactatgtattactgttaactatagtcatcctacagtgatatagaaccactagaacgtatttctcctacatagctgtgattttgtatcctttaacaaatatctccatatctttttttttttttttttttttttttttttgagatgtagttttgctctgtcacccaggctggagtgcagtggtgcagtggtgcgatctcagctcactgcaacctccatctcccaggttcaaccgattctcctgcctcagcctcccgagtagctggaattacagatgcccgccaccatgcctggctaatttttttatttttgttagagacgggtttcaccatgttggccaggctggtcttgaaatcctgacctcaggtaatccgcccgccttggcttcccaaagtgctgggattacaggtgtgagccaccgcgtgcagccatctcttcatatctttaccttccccctactgtttccagccttgagtattttctgttctactttctacttttcacttctatgaggtaaactgtttttagcttccacatatgagtgagaacatgcagcgtttaacttttctgttcatggcttatttcactgagtataatgtcttccagtccatccatgttgctgcaaataacagaatttaatcctttttgtggctgtatagtattccatggatatattctggatattaatcccccctaggatgtatagtttgtaaatattttctcccattctgtagattgcgaagaaatattttaaagatttataaagtacatcttttacatcttttatatttaccaaatgagtgaaaactgagtagacaataaaaaaatcttagaaatcaaaatagtttgttctcattcttttcagctcattagagagcacataatgaagcagcacatttacgttatccaattttgtgttggtgccaaacaatggggtttatataaaatataaacattttatattgaatggattataggaacatcacccatcattaaaagtctaatatcgagatatttacttgagagaacttaatgtactttaattaagattagtaacatttttgcatccctataaatgtgtttttagaggaaaacctacagtaaagtgtttgctatagaagtcacaccaatgaactacaaattcttccaaaaacagttttctagcgacatctgctggtacaatgtaataaagatgactatctcatgaaagtaatttcatagaaaatatctttgtgggtagaattgtttattttactatcatttacacttctaattgaaaatttgaacatttgaccaagagtattatcctgataatgataacattgagcttctttatactttcctgtacatagtatgcgattccaacctgaacctctacagttatttgtgtatttactaagttctttgatattattatgcaacatatttcttttcctccatgtcttttttggctcagttttatatcataatttgccttagtgcagaaccttgcaagtagagattcagtaaatatagactgacttacagtatttattttgtcatttgcatagattaagttgaaaagtctacatatatgagttaaatgcattatttttatgtgcacttgaaaataaaaatgagactttatattagaaaagaatgtgattaggataaatggatttttatttttcttcctttgaagagattttctgcattataagttgtggagaagcaaaatatattcagtccttggacattttctttacaattatttcctgtatgattgtatctagtctcatgcatttaaatactacatataaacaaatcagacctctcccttaatcctcagacttgtacagccagttacttgcttcctcaacattaccgtttaattagttaacacacattttaaacttaacatgtccaaaacaaaagttttgattttctccttgaaactgtttgtgcttagtattccctactttaatgagtggccgtattatccttccgtttgatcaaaccaaaaattatttcagtaatttgtaaattccctctcttttactccacgtttaaaccattgagaatttcagtcagctctacttctctccaccttctacaactatgatctagatgaccacaatcatcgttcccctcctaacttgcttccttgcttctaaccttgccctcctgtaagtctatccagcagccaagtgattttttttttttttttttttttttttttttttttgagacagagtctcactctgtcacccaggctggagtgcaatggtgtgatcttggctcattgccaactctgcctcctgccacctccccagttccagcgattctccctgcctcagcctcccaagtagctgggattacaggcatctgtcaccacgcccggctaatttttgtgttttctgtagagatggggtttcgccatgttggccaggctggtcttaaactcctaacctcaggtgatccaccaacctcagcctcccaaagtgctgggattacaggcgtgagccaccgtccccggcctcaagtgattcttttaaaatttaagacagatcttgccactcctctgatgagaacctcccaaagttcttacgttgcctaaagggcttatgtggaatgtagaccactccctctctccaccctgattgctaggacctcatttcctaccgctacttccctcccctattttgctccagctacagtaatctacttgcttctctttacatgccaagctgactctgtatcatgggctgtatacttgattacctcaaacggaaatgctctcccctctactcactagtgtttctgatcagattaccaaattttacctctcggagaggctcttcttaaccatactgtgtaaagtaatgaagcctgactacgtcactgtttctccccttatcttggaggtttgttttttgttttgttttattttgtttttttaccatacctgttatcactatatgacatatttacttttttatgtatctctttcccaactagaatgccagctctatgaaaccagggattctttattgttcacagttatgtccttagaacctaaggcagtgcttatacatagtggccatttagttaatatttatcgaataagttggtgagccttaatacttaaatggagaatgtgatttgatttacactataataatcaaatccatagaataatgaggaaccttcaaatggagtctgctttgtttaaatctttatattgtattttcaacattgaacacggattacaattgtgtttcatagttaggttaatgctcatacaatactcttagtgtcaaaatgtgggatcatattactattttaaagattctttttatgggaataattacgtttttgttctttggacatagacatctgaccctcaattacattaacaaaccttatacacatgaatggaaagaagaatagcctcttttgaatccatgctaagactttatcaatatgaagtgcttcccacagagttctgctgaaagaactgaacttccatcataatgaaattgcaaattcatttgtatatgcccctcttatatttgaaagctactttttgatgttttggttggcaattaaatttattgtttaaggtcacaaatatgcaattctgactagaacaagttgtcagaattctttattcagcatagcacaaagataaatggctgtcttttaacaataacatatgaaagccaaaatttgttcccagttatacataatcttttaatcagtctactgctttctgttttccagtcaatagaccccttaacctgcttcctcaccatcttacctatctagattatgggtttttaaattactgcaaaacacttcatcagatggaaaaagataagtttaaacattttgatgctataattttcccatgcacattttatccttccatctgaattcttttgcctttacccctattctgtgtaaggtggaaaattatgtagtatgttagctaaattctatggttacatttctcactgttaacatgactagaaagtagatcatgttgcttaattgaaattgagtttttaagtgtttttttttcttcttaaaaaaacaacaaaaaacgagatacatgtgcagaacatgcaggtttgttacatacgtatacgtgtgccatggtggtttgctgcacctatcgagcagtcctccaacttccctcccctcactccccacaccccaacaggccctggtgtgtgttgttcccctctctgtgtctatgtgttctcaatgttcaactcctacttgtgagtgacaacatgtagtatttggttttctgttcctgtgttagtttgctgaggattatggcttccagcttcatccatgtccctgcaaaggacatgatctcattcctttttatggctgcagagtattccatggtgtatatgtaccacattttctttatccatttgatcattgatgggcattgggattggttacatgtctttgctattgtaaatagtgctgcaataaacataacgtgtgcatgtatctttatagtagaatgatttgtattcctttgggtatatacccagtaatgggattgctaggtcaaatggtatttctggttccagatccttgaggaatcgctatactgtcttccaccatggttgaactaatttacattcccaccaacagtgtaaaagcattcctacttctccacagcctcaccagcatctattgttccctgactttttaataatcgccattcttactggcatgagatggtatctcattgtggttttgatttgcatttctctgatgatcattaatgttgagcttttttcatttgtttgttggctccataaatgtcttcttttgagaagtgtctgttttcatatcctttgcccactttttgatggggttgttttaaaacatctctgggcatgtggattaacttattttctcagattctgtactgcatctaataaaaatgtatatgattttgattaaaatagatttcttaaatttttatgcatttcctttgtggcctttcctacagaagacatagaggaataattgccctgttatatttgaggccttactctttgttttttgagacagagttttgctcttgttgcccaggctggagagcaatggcgcaatcttggctcattgcaacctccgccccccgggttcaagcgattctccagcgtcagcctcccgagtagctgggattacaggaatgtgccaccacgcccggctaattttgtatttttagtggagacggggtttctccatgttggtcaggctggtcttgaactcctaatctcaggtgatccgccggcctcggcctcccaaagtgctgagattacaggtgtgagccactacacccggcctaggccttactctttatctaagaatatccagtgtctttatagatttattcaagggattttgataataaatactcaaagtccctttgtttaaggtgatcatagctataaagaagaacaaagacactgaataacagcagcagaatgttgtaaagccggcatagtaatgtccccattttaagatcttgtttaaatatttttttgcaaatctgagaatctttttttcttaactaccatgtaatttgaatcttccccagctgaagagagtagactgtttcaggaggatatataagaaaaatacataacttttaaagtcagacaatcccctccagcccccaaattctggaattctgactgctattacttttgtgacctaggttactgcattttttgagcctctgtgtagcaatgcaatagagaaaaatctctattcatacagtttagtgatatgattaaatgagacaacacatataaagagctgaaaacagtgcccagctatagtgagcactcaataaataccatttagagtcctgtctttctgctctcccctcaccccaactctgttcttcatgctctgtgatctgttctaattgggcttaatcagaaattaaaactgttgaactaaacttgaaacctttctgtgcctgccaactgtatattatgaatactgtgcattcactgatttaataggtagggcgaagtcaggaccttgaattgatctatatataacacccaccaggtgtatgtggtctttttcttctcagcaaattggtcccctagggatttgtagagactgctttactcccagccttcattttaagtccagatggagcccttagatttacttaagtctctcttcaacctgcctatttgagagctgagctctaagtaatgttaatgtgacataggaaggcattatcatattaatcattttgtgtaaggtgacttacttcattgcttgttgctcttttgaccattcataatgttcagatttttgccttaagagtttcatcttttaaaacattattttcagaaaaaaattgaataggtacttgtatctcaaaatatgttattttatgattgtaaattcttattgttttaggtgcaaggatggcttgaaaggatttacattttctgcacttaggtaagaaacatttatttttatgttgagagagaatttacaagttaacttaaaaaattatacataattacaataaataggtattgactaagcatttaaactgaaaataattttagaattcacaaaagtatttccaagcctgcggataaatagctcattgaaagagtaatttgtcagatttttctctctaaaaattaatcaacgacttcttttggacctgttgtgtgctttctactgtggggtatttgaaaagaaatacaagaactcacttcagggagcttggaaagacagagctgctcatgaacaattactgaaaagttaagtatttaattgtgtggtactagattatgggtttgctttagggcaggactcatgtactgtcaaacacagattcgattttaagtatcactagagtcttttcacctcatagcccatcttttagcatagcaattggcacatagtatatactgtagaaatgttcgttagcattagcattatattttatagttcaccaagaattttctcatagattagaaaattaaatttttgcaacagttctgtgagatgtaacatgatgagaaaactgaggcttagaatatttgactaatttaacatcacacaagttaactatatatactgactccatacccagtgtttgtctagtttatatcataaatgttgcctgttttgtaatccaaaggacatatagtagatgcttggtgaagatcagtagtatggtttttactgcaaatattgaagggaaaaattagggaaagcttcagtactagcaaaagtttttacctaattgtctcaaggttattttgaggatcaaatgagtcaatatgtgaaaaatatttcaaacagtggctggcatggagtaaatactccagaaatgttggatattatttttgttatattctcatagatgatgtgccttaaactgtactttaaggatagctttcgataactacagggaagaggaagtgcactctgggtggaagtgaataatagtagcaagagagtgaaaattgtaaaaatgaagtgtgaggtaacagtgagaaaatggcatgaaaagtttatattagggaatataaaatattttttgatatgtagagtagggccagattatggaagacctaggggagaaaaaagacaaacttggatttgataaggtcagcagtagggagctactaatgctttttgagcagggtggttgacattgtttcagaaagattggtctggccgcagtatttgagacactgaaaaagagagaaccagaaggtggaaagacaataaagactagaatttgggtgatagtgggaggattaaagagaaggagaaaaagttaagacttgtaatgagtgaaaatgaggactgatattttccttctttctcttcccctccaccctgcaatcccagccacgtattgaaaaccaaagtgcctgaaagaaggtgctattaacagaaaatcacatggcatgcaaggaaactggtttgggagggaacaaatggagtctactgtatgataagaatgtctttggttgtgagaactctgtgggaacaataactttctaagtcataatacacaacactaattactgttatttttcagtaaaagatcatgaaatttattagaaaataaagattttcttattgttgttgcattggctagaaagcatttggtattaagtttaaagttgataacaaaaacaaaagttaggttttcaaaagagaaggaaaaacttagtcttgttttcctacatctccttagactcccagaattcttgcaaaaacttaaaatgtgtcagatggttttgtgtcttttcttcaaatccacttttaacagagggctagtttggactatttgcacttaaattttctctgtattatagaaaaatattccagaaaaaatgtttgttaattcttgctaatattcttgttgctaaagcaagacaattgttaactattgtgaatggtcatgtttatttgtgcatctccttccactaagcaaattcagtttcgtaatcaatctgcagtgtggtgaatttggattcaagaaatgtggctatttcttgcatttatatggtgaatatggactcaccacattgcacatgaattaatctcaaacttataaagttgattctcagaagaatgttactaaaagccaaatatattttttattgtcaagtttcattgtaaaaaaataatgtgagttaatatgtgtgcttcttgtaggctttcaaaaagtattatctgacatgtctttcctgctacctctttgcagtcctggcggtcgtgatttttattgtagacgtatgctgtaaatttatagcaagtcaaaagtgcaaaatttaatattaattacaaagggaatgggaaaggaaaatgctttttgtagcacaatttaatatgagctcctgacaatattaaactttggtgaggaaaggatactcagagcttgatacatttgagaatggtgagattgaaaggaatacaatcataaaatggcttaaggaagtgcttatctcatacagatcataattgctgtatcatgaaaacatacattgttctctcagaggaaaactgtcctttatccataaaggacaaatatttacaaagtactccagtttaatgtgtcctaattagacaaaggctaaaaagctttaaaatattaaattttccttcaggctgggcatggtagctaacgcctctaatcccagcactttgggaggccaaggcgggcaatcacttaaggtcaggagttagagaccagcctggccaacatggtgaaacctgtctctattaaaaatacaaaaattagccaggcatggtggtgggcatctgtaattccagatgcttgggaggctgagggaggagaatggcttgaacttgggaggcagaggttgcaatgagctttgatcatgccactgcactccagcctgggtgacagagtgagactctgtctcaaaaaaaaaaaaaaaaaacagccgggcacagtggctcacgcctgtaatcccagcactttgggaggccaaggcaggtagatcacgaggtcagcagattgagaccagactgaccaacatggtgaaaccccgtctttagtaaaaatacaaaaaaattagctgggtgtggtgatgggcgcctgtaatcccagcgacttgagaggctgaggcaggagaattgcttgaaaccagaaggcagaggttgcagtgagccgagattgcgccactgcactctagcctgggcaataagagcaaaaactccatctcaaaaaaaacaaaaccaaaaccaaaaaaccacaaaactttacttcagtttagcacctttttaaaaatcacttgtattagtctgttctcacactgctataaagatactactcaagactggttagtgtataaacaaaagaggtttaattgactcacagttccttatggctagggaggcctcaggaaacttacaatcatggcagaaggccaagaggaagcaggcttcttcttcacaaggtggcaggagagggagagagctagagtgagggagtgccacactttaaaaccattagctctcctgagaactaattcactatcatgagaacagcatgggggaaactgaccccatgatccaatcacccccaccaggtccctccctcaacatgtgaggattacaactcgagatgagatttgggtgggaacacagagccaaaccatatcagcactcctcaacaagtgtgagataatacaggaggtacaaagctaacattcactgatagatatacttagtgtacatttattctgccccaggtcttgtactaagtattaagaatacactcgggaatgagccagatatagtctctgttctcagagagcttatggtctagtggggaagacagcattaattttaactgtgctgaaatgttgcaaaagagaagtgtaggttatctcaggaatatattttaggcaaaccttacctagcgtctttccccaagctgtggataggagtaaatgaagagaagaaagcaggaaatttgcacaaaattacttatagactagaagaacccaaatgtaataatagaagttaagtgttctataattcacaaattattaatacttttattttctggtgggggcgagtgggaatgagagagtggaaggagcatttaagatgaattttaaaagacaaataagatttttagtaaagatgtagggaagaatgatccagataagaagagcaatacagacgcatggtttatttggagaatgtcaaatagttcatttaattgtaatataataatagcttctatagtgagcactcactctgcaccagatactgatttaagcttgaaaagtttgtatttaattcagtaggccataagcccatgaagttctttgaggatatgtgtagtcagttcagatacgcactttgggaagcttcctctggaaactgtatgtaggatgatttgaaaattatctgtgtatatagataacagtagaagtcaaaagaatagtgtcaagaacacaaccacgggagaaaagccagtgtgagactctgaaggtgcgctagccttattcatcatagtttaaaacatagttagaaatatatgtagcttagtgtttaagaagccaaactttaggccagacaattctgggttcaaataattactgataatttattggttgtggacaagatacttaaccatgccaactctcgtgggaattgtgacacctatagtattgttgtgaggattacatgaattaattatatttgtaaaaggctcagttggcactgtgcctgtcgtataagatatgctcagaaaattctagctattactatgttcattcattcattcattcaatatgtattaaatatttaccatgtgccagacactatgctagatgctgggatataacagcaaagaagatatacatggtctcacaggcctcacagttgagtaggggatgtagtctactaaaatggcacgtacattactgtactggcagttcattgggctctcctagcacagaagaaagattatccccttattctggcctgggacagggccagcttctccaaggaagtgacctctaatctgaaacagtaaatcctgtaaatgaacagtaaatgaaaggtgtaagagaaactgttctatctgttctggcatagttttacccttgttgctgataaagaacagcagtgcagatcttaaactctctatgtacacccgtaagtaagaaacaaattcatttgaactgacagctaccaaagattcacagctgccatctggtgacaaacaaaacccttgcacaccccttatgatttgataagctagatgttttaccaaggttgtctgaacaggatgagttgcagttgttggtagtaacagctttttctttctaagtatttacactttcatattctgtttgtcacaggtctcaagttacattttttttttttaaagagacagggtcatactgtattgcctaggctgaagtgcagtggcatgatcatagcccactgtagcctttaattcctaagctcaagcaatcctcccacgtcagcctcccaagtagctgggactacaggcgtacaccaccatgcccagctgatttttaatttttttgttaaggtggggtctcactttggtgaccaggctgttcttgaactcctggccacaagtgattgtcctgccttgactcccatagtgccagggttacagcaggagccactatgcctggctcaagttccagacttttagtgtattgttattgatcccgttctatctgtattttactatattttcggaaagcttggaaggtagtattgccttgggaaagcttagttattctttataagggcaatgactcttacaggataggtgtaaacagtgatactgcaaactctgagaaaggatacttcttgagggatatctaattgtgataatattttccattcatcgtctttggaaaaatataatctagttttgttgaaataggaatattattttctagatattttatttttccaaagaaaaataagtagattagaataacatcagctttcagattttctaatgaaataatatgaggacttggggaatcctgactgttttctgattcctggtctgtactgtcctgtgtttccctgtgtgaatacagatgacctagtgtgctgcagctgtttatgactcagtgtcccaagttaaagggtgcttcattaagtgttgtgctgtattttacttggtcagtttgatttttaaatacctgcattatcaaacaaatgactattaattttttttgagtattcagattttgaaagtctatttttcttcataggatgatttgattttatgtaaattgtgaaaatactatctcaaatgataaaatacttgccaaagcgtatttgtttataaacaaagtcttttttttttcctcattgactatttttaagtgaaaaatgcctcacattgtgctcttttctttaggttcattgtagggaaggaagaaattcccacacattctttttcaccagaggcagcatatgcaaaagtggaacaaaagagagagcaacatgaggaaaaacccggaagaatgaatatgattggtctagtcaggaaatttgtggattcaatgtgagctctttatcttgatattttaacctgctttgtcactgtttcatatgatatttgtaccatgccaaggttatttttgttttctattcaggtaatgatgatcatttttcaccagaaactgtgcatagaattttataaaaggcacacaatggcaagtgaatattatttattatttctggcaggactgtagaccagcatatgcctttaaaagaggtttgcataaaattggaatacttttgtatttcaaaccaggcagaattacaggaggctatgatggagaacttcaggaaactgattactatgtgttgatttaatatgccaagtatggaaagaaggaagcaaaattcctgagagagattgaagaagattaaggaataataagggataacccttaagtaaaggatattttgtaagagtgaaaatttttggggttctcaaactgaaatgtttttatttgtatattataaaaagaagctatcatgtttcatacaaattttcatttatatttctaggatagatacttaagaaaataaatttaatagtttgaaattagattatcaaccaataaaatcttggtagtgatattttagagagggtggaatgagtaggcaataaagaaagttaggggatcaattatagcaagggtcctgaacctctgggccatggaccagtactggtccgaggcctgttaggaacctggccacacagcaggaggtgagcagcaggccagtgagcattaccgtttgaactctgcctcctgtcacatcagcagtggcattagattctcataggagcacaaaccccattgtgaactgcgcgtacaagggatctaagttgcgtgcttcttatgagcatctaatgcctgatgatgtggggtggaacagtttcatcctaaaccacccccctctccagccacccagtcagtggaaaaattctcttccgtgaaaccggtccctggtgccaaaaaggttggggaccattgaattataggaagctgaggtcctttaataaattagaaaacctatgtttcactcttattttccctctgccagcattgtaactttggacgagagatttaaccattatgcatttccaagttcttatctgttaactggggttaataatctctattaagaattgctgtgagcattaaatgagataacatttatgaacttgcctgacataaaatgttagcacagggagcgtactcaaatttttattgaatttaaagattttgtcttcatcttaacaaataatacatctagaagataacaggaataattatggtagttgaatttattaaacaagttcaaaaataattttgggttacctcagtggagaaaagggagaaaggaccctattaatggaaataatttcaacagtaatcagaggggaatgcagagaatgaattatatgggtgaatgatgccttgggcgtcagaactgatcaggtcatgacagaacgtatcatagtagcctcagtggatcttctggtatgaaagtggatgcagaatactacagaagcaaagcaaataatacaagagacaggcattccaggtgctgggaagccatttatgagtgactaagaaagactaattgacagtacggttgatatcaggatttaacttcactagcaaagaaaatttaggccaggcatggtggctcacacctgtaaaactaacactttgggagactgaggtaggagaatcacttgaggccaggagtttgagaccagcctaggcaacatagcaagaccctgcctctaaaaaaaatttaaaaattagctaggattgatggcatgtgcctgtagtcctagctacgcaggaggctgaggtgggaggattgcttgagtctaggagttcaaggctgcggtgatctatgatcattatgatcatgccaatgcactccagcttgggtgacagagtgacacccccatcacttagaaaaaaaaaggaaacttaacaaatttcagtgtagttctggtagcagtggttgagaaatatctttgaagtggacacttagaagtgtgaagagtgatggcttgcctgaggcagcctttctcttattcactgcttgtcaggtctccagctttaatcactcaacagcttcacatggccagatatgccttagcattctaaagatataagggctgtggccagtgtgaactgaactgttgctgtcacccttgactaggaaaggctgtatgctccagctgtagtgcagaattggatttctgtaaaggtcttgctaatcaatttgcgaatgggattggagaagtgcagagccagaacattgctctgcaagttattgttataaacaggaaaacattcatgtggttcaaccatgaaaataattaattagctacaatctgaaagaagttataaagaccgcttattttggaacatgaaccctcaaagagagagagagctagacccatgttagatattctgcttacttttttatgcctaaggtgaataaatagtcttggatttaacatgctaaaccactaaaatgagtgcatcctgaacagtagtcctcccagcagaaatatttattaaacactggagggttaagtggtttacaattaaatcacaaattagctacttttgaattaccacatgatctctatttctatatttatttcaactgaattttgaattctaatactatatcatgtttcttttccagatgttttctctcaaatctaattaagtataaattcctgtaacctgagcatgttctcattatgacttttgctcaagtactgacttcatggatgatttattaccaatatactctacaataagcaatttaaggtttccaaaagacttggcagagtatatatataatatatacatattttttcatatttaaccacaaataacagtgtggtttctccagtccgtattcaagtattttgactgcagtcacatagtttatacaatgtgtcaaatggtaagcagcaagtagaaaaagcaaaaatatatgttgttcttgcttctgtatctcctaaagcaccaaaagtgacacacatttagaagtagtgagtgggccaggcacggtggctcacacctgtaatcccagcactttgggaggccgaggcaggcggatcacctgaggtcaggagctcgagaccagcctggccaacatagtgaaaccccatctctactaaaaatacaaaaattagctgggcgtggtggcaggcgcctgtaatcccagctactcgggaggctgaggcaggagaatcgcttgaacctgggaggcagaggttgcagtgagttgagatcacgcccattgtactccagcctgagggacaagagcgagactttatctcaaaataaataaataaataaataaataaataaagtgatgttttcttctctctctttttttttttggttagaaagctttaaacagatccacaaacatgtacaaacacatggatatacacactttaattataattagtttaatttttttgggttcaatttcagatgcaaacatggaccaaggcatagatgttgcaaacattatgaagataattgcatctcttattgcattaaagtaagtatatgaaagtatgtactttattaacagtagggaatgggtatagaaattatttatttatttagaaataatttaaaaataaatggaaaagttgacattaataaatgctatcattctttgaatttgacttcaagagtgagaaatttatgacaataggtgacgatttagcttttagtattcacttaccagatccttaaataatttaaaaaattagcttgtttaaaaattggcttaattaaaacttatgatatagaagataagatgggataacaacaaggaaacataaagtcattaaaatttgtactttgtaatgtatcctcattagaactacatcttagaacaagactctgactcccagactgtgctgtgtgctagctggatcagcactcacacacatacactgtatgcactgtgccaagtctgttacaatggcatttaattttggacttgtaaaactattacttttttttttaagccattgagataactggagcatgtccacagttgctctgcattaagagagctaactatgcctggcataaattcttgactccctagtggacttgagtactagtgtgtctcttcctcttcccctgctgttgtgttgtccctcctcccttcccccatcaccaccacttctgagaagaaagttattttctttgcagtcagcatggcacaggtggcaccacctgctgcaagttctttagtttttttttctttttttgttaaagacagagtctcgctcagccacccaggctggagtgcagtggcactatctcagctcactgcaaccaccatctcctaggttcaagcacttctcccatctcatcctcctgagtagctgggatgattgcaggcacccatcatcatgcctggctaatttttgtgttttagtagaggcagggtttcaccatgttggccaggctggtcttgaactcttgaccttaggggatctgcctgccttgacctcccaacactaggattacaggtgtgaaccaccgcgcccggccaagttcctttattttgaatggtgctctaacagttccaatgctgtagaaagtttatgttcttcttgcaattttagtctctactcagttgatgatgagaagaacagagttgtgcagcaccccaaaagacagccccttggtggttactctagaaaggaggaactgtcccacattagtgctcatgaaggtaaacatctatggcccagtgttgacagtgccgttagcccagcccacacttagcttcacaattccccaaaatgaccaaggataaaatagtagggttttgttttgttttgttcctcagttgtgcaatactttctgacactctttccaaatttgatttcctgcctcagtttaaagtggccaaaaaaaaaaaaaaagtaacattgctggcagtccaagtcagctgataacctggatttattattccttccaactgaacatgattgtagttcaaaggaaaactttagatggggaactaagaggagtatttggattaaatcagaggtatttgagaaatttggcgtggggaaggtgatattaaaaaaattgtatgagaaagttagtgagaatttccaagcaataaaaaactagtgattctttcaaatgtgtaccagtactgtaaacttggcaatttatgtatacattggaatgccgtattatatccatgaatgtaaaactattggagacctgtgggtgaggaatttaaaccataaacatggtagtgaaattttttgacaatggacctcattattttacaaacttaattacaccatatgttaaatcacatccctgaataaatactcatattaattacattgtcctcaacattctgtactccattcacactaactttttcttggttccttatacctgccagcctcttaattggctttatgttttctgtctgagctgtctgaaatgtttttctcattctagcttcttctcttttgggtctatttaaatgtcatatcatttacatgtctgcccttaacatttaatctaatatagattgccctgttaatgtctatcctagtgtcttgattacttccttcctaacatttattataatcttttgtatttgtttacttagttgttttcttttccagtaatgagcatgaaagctccacaaaggcaagaactctgtgccctcctcatcactgttatccccagcatctagtgtaatgtttggcagataacaggcattcagcaaatattttctaagtacattaatgggtggatgaatagttctcttgaaaatagcatgaaaaagattgtaatgtaattataatccctaaatccttagattataaggttatcaatggcaagatgaaagtgtgaccatttcattcatttaaatactaggcaatttcagttaagcaaatgcttgagaattcacagtaattgattggacaatttgattttgtgttttaataaggcattaggtagtttcaggtaaattaaccagtgtttcctcatagtaattaatttttttttctggaaaagaaagctgcagtccagaaaatacaaacctaacttttgggcatacactgctatgagtgtagatattttccaattccagtcagagttagagaggaggaggatgggacaccggttttaacaatgtattggttgaactgtacagaaagtactattctttttgttaatgttttatgctgattgaaatttttcagtttcaatattaattacttacagtctctcagacatctaaaattcatcttcctaaatacagaaatgaaattgaccagtaatagtcatcctctccaaatctcttttgcactatggacagttgaaggaaatatagagaaatgttgacagcaaatatggatttgtagtgggtttgctttttcaagtttagtttaatatactttaaagctactcctccctagagatgttttagcccgacaggaatgaaaacctagacataattctgcaccccctgccccctggaagttcttcttacctgaccattgtaaaagttagcaccaaaggtctgaaaaaataatgaaaatatttttctatgaaaataatccctactcatgctaatcattaagagcagttttctgttaacattttcaagagcatttggttttattaagtagtttttggaattttagtgcttttgtatgtaaaactcatttgtggtttaggaatttaaaatcctgattattgtcaacaaaatgtcaagaaatggaattttggtgcataggcaagcttggccagtgcttgtgagactttttaagtctttgtaaatcaaagaaagtaaactcattccaagatttcactcttatttttaaggtaattgttttaaaattattgtttgaggttttaaggctttattttgctgtgctataaacttagattaaatttgttttgtcttgtttctattttgagatggtaaaattcgtattctatcaaaaacttcaaaatttgtttgtaaatcaggtttttctccaaatttcctctagggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaaggtaaggcttttagaagaggaaagaaaaatgggaaataaataacattgctattgttagaatgagagatggccttagttcacttattttttaatgcttctttctggaatattcatacatatcttgacataaccaaatctatacaatatattgggaagtgagggtacagaaatttcttcttttaaaatattatttaatatactcgagtgtgtagacatgtttgcatttacatatggtattacacattgtcagactcattttctttttcaatatatagacactcagaaaatatgaattttttggatatttccaatatcaaaaatgatattaatatgcctggcttatttatttttttatcatatttactgcctggttattaatttaaatgtatttcagatctttctagctgaaataaacacttgatagaatcggtgaggattttctattgtaacttatataagcaatgacttaggtcccttcttccacccactcacagttcctactacactgtctcaaataaccagagttcacagtcttccaccccattctgtatgttcctataaaagtgtccatacatatataagcccacgcctaaacatatatgtagagatcattcttaacctagtactctgcaactttaagtgatggccttttgcataatggaatcactaatatgtaaatcatattttattaaacgcttaaaagattctaaatctgaatataatctctaaatggtaaagtgtgttaattaatgttgacctaacacatggacataaagatgacaacagaagtcactgggggcttctagaggagggagggagggagcagggcaaggattgaaaaactagtgcctgggtattgggatcaatcataccccaaacctctgcaccacacaatatacccctgtaacaaacctgcatatgtatcccccgaatctaaaaaaaaagttgcaattaaaaaaaaaaaaaaaggagattagaacatatacacacacagaggaatgaccatgtgaggacacagggagaaggtggccatctgctagccatggagagagaaggagcgaaccttgagcataccgtgatctttgaactcccagcctctatgactgtgaaaaaaatagatttttttttaatctacaatcacaaattgctcacttttgccttaattttactctataaaagatatgtgttttgagcacagggattgtgtctcattttgtaggaacatgcagcaggcattccaatatgtctgactaatgaattaaggacattaaaggagtgtgcatttttgtagatgagatttgcctaccttccctctgtctacaaaaaaattataaatatatattttattcatactttatttctttgactgttttaatgtatattttaataaatatattgaaagaagaatatatattctgtgggtatatatatatgtctatatatatatatatacgtacacatatacacactttttgttgttaaatgcagagaaaattaatgatgggaaaactcaattctggaattatttagggtaacatggacagtgttgttttctgtaaaaatttactcataaaaggtaggtatggataaaatattttgaaatggaaaggaggaataataaactatagataatgaatcacttgttatgaaatattactaatattaaaaacattttcaatatggtttgactaagaagcattactaatgtatttgaatatacaagagttaaggacagattattggtaattgcatgtttatattcacatttaaaaaaatttctcacgttatagcatttgtatttattcttaacataaactcttaactgtttacatgtggtttatcaccaacatttttagccccaggttggttattctctgccatctagcttatctcagagtgtgttttgttttgcttttttatttttcatttctgttactatttatttacttaggtaatacaaacaaatggtattaaagtaacaaaaatacaaccgggtcagaaaatctcaggaaatattcacgtggtgtgttcaaaaattgtatgtgatttttcaaaaacaaattgcccatgctatagtatctttataagaatcttaagagaagagcaggcaaataaaccttgttttttctgtttcttggttaactgacccttttttaaaaatttgttaaggttcctctttatctctggtaatattcattgttttatagtctatgtttaatattaatatagctacttcaacttttcaaaattattgtttgatgttataatgtttccattctttcactttttctgtctttgtttgaaaaactggtttcttttaggctgcagagagttggccctttctttcttatagaatctgatcatctctgtcttctaattggcatgtttatactgtttacatataatgtattatgtgtaaatatatatagtttatgatgtgattgagtttaaacctactttcatgttagtttttttgtatttgttcctttttttcttcctctttttttttttttctttttcagccttctggattgattgtgtattttactatggctccattctagcttcactattgccttattatttgtacttgctttaatttagtggctgccttaacattttataatatacatttttaatgtatcagccaatcttcaagtaatgttatactacttcacatacagtgtcagaccttacaacactgtactttgaatttctccttcccatcctttgttataggatttaacatttatcgtttatctttatatatgttatatactccacgatatgttgttactatttttgttttagatcagaggtcaacacactttttctgtgaagagccagatcatgactattaggctttgtgaccatatggtctctgtcataactacccagctctgctgttacagtctgaaagcagctatagacaatatataaatgaacaagtgtggctgcgtttcaataaaactttatcacactataattagaacttgatgtaattttcacatcataagatgttgtcattcttttgatttatttttcattttttaagactgtaaaaatgattattagctcctgagccatataaaaacaagtagcaggccagatttggctagtgagccatagtttgctgacccctattttagatagttaattcacttttagtgcaagtaaagataagaaaaatatgtcttctaagtttaccttcacttttctatttccagaactctgcatttcttttcatagttctaaatttttgtctggtgtcatattccttctacctttaacatttctgtgaactcagatctgctggtggtggattttctcagcttttatctgtctggaaaaaatctttgtttcaccttcagttttaagaaatattttctctgggtatagaattgtggcctgacagacttgtagtttagccagctttttgttcttgttaaaatgggagtgatgcttttcccagcattcgatagctaggcaaaagtgaaatttatggatttattttgcaaaatcagtgcaataaaaatattatgtgtaatttcttaatagagtctatagagtaataactttataaaatattattgttcataatttttccaatcatgtatgcagtttgatttagatgagatcactaattggcctgcaaggtaatctgatgaatttattcattatagttgtttttgttttatgcttttatttctagaaataaaataactgaagtcattgtattttctccttaactagggtactagttgcttcctgcgctggatcagaaacttagatgatgaactacatgctattatagctggtaaagcaataataaaaatgaatggttattattgtattaatcagtggtaggaatgaattggaaataccatccaattcatccaatttctatgaatcttcctttctctatcgtaatagaattccagttgaggcacttgtccaaatactttgtgatgtttaacatatcaaggcactgttgccatctgatgttttgagttggcaatataatggcttgggtatctgtcctgctataggccataaatcctagcgaatgtgtcacaaaagaatataaaaagccttatatttatatttgccatataagtgattaagggaagttcaagtagatttcattgaaaattctatttttaccactggaaagtgacctatattttcataataactttttaaaggaacttaatcattttattaaaaaatctaaatattattttctataagtgcaatgtatgtattaaattaaatagataatttatcaggtatttattaggaataaccttagttattagtattcgacacctcccctcctcccctggccttggttttccatttatataatgaaagcagtgctatggagagaagtattgtgatagcactaaccatcatttgagctatttaatattaggagaatatatgaataaatatttccacttaaaatcgaaaaggaaccaagaggctttgaaaaattattttttttaaattgtatttggcaagaccactcctctttaaagttaaaatagaaatgtaaagcttcttgttatacataaatcagaactgtttatttctaactctgaatatcaattttttaaatttaaaaatatgcaataatatctcaccccattttaatgtcatctggtttattactgtccttgattgtgttgtaacaagagatagtgctgattctatgtaagtgaattaacatttctgatgacataataacaaataaatactctgcgatcttatcagttatttcttatttcttgtttcaggatttttggcaggtatatcaatgatgttttataaaagcacaacaatttccatgtatttagcgtccaaattggtagaggtaagcgaaatttttgtgcaagaatagttccaaagaacataaagcttttagctgctgactgttttagcagcaaatgtatatcccaatggcaaacataaattttaatcctctaaaagtatttgcaaagttgattcccctgtgtttttctttgtgtgtgtgttattttcaaatatacattaagtatagaaagagtagtgtaattaaccctcatgcacccatcatgcagcttcaacagttatcagtatttggccagtctcctttcatctatactcctcaaccccacaggtatcgagttattttaaagccaatcccagacactatataatttcatccttaaaaaaatttcagcataaagactccttaaagaataaaggctaaaggctttttcaaaacaaacaaatcaacaataccacagtatcattatcatacattaaaaccctcccagtaattccatactaatatatccaattagagtttatgtcttcactgattatcttataaatatgtttttgcaatcattttattttaatcaagttccaaacaaagtttcttgtagtttataatagttacccccctactactgctgctactgcttttcttcctcctcctcctcctcctcctcttccttctcctcctcctccttcttccttgacatttatttgttgaagatgtaggtcattagttcatggaatttcccaaattctggattttgctgattgcaccctcactgttgttgtttaacatgtttctttaactcataaatttttttagttgttaactagatcttgagacctaagcaaattcaggtttaaatttttgtaggaggtaacagccatacttcacatttactgtgtatgtgaacttccaattgcatcatcacatgacgaggcacaaaaatgtctggttctctctctttttgtgatgctaagattgatcagtgggcttaggtgttgatagagccaacataaggttccccagtagccctatagctattggttttcgcagctgttaataattatcactgggattcattatttcattaagagttgcaaaatgatgaaaaatactattactctttattctgtgtttattagctgaaattgttctaaatgcatttttccttttcaactatttggttactctgaaatacgttgttctggaaagtcaaaataaaatgcttgattagttcatttttaattaccagtgtttagaatgagttagtaccttagcatcctgcaaagttgacccatgagtctttatttttaaagtatcattatgaagatttggagtttaacatatatgatttattttcattatgctcaaattgttcccatctttggccatgagagcttccttaagttgactcctccttgttgtaacataacaccattatctttgatagctttcttgctgtaagacaatatattccgggctcatctgggacattttctgcctcagatgtagaatcagtcttctctgtaatggctcctagtttgttttagtgggaaatggtatttaaagatttcaatccaggtgctagaggttatttgctcccaggctagttactgattcttggctttcgcagtgaatggagctagagaatctccctccccttgctttttagaaacagaaaatacatttggaacatagtgatatttctaattcaaagttaagagtgtagattttatttaacttaattacttgctttacccaaatatatgtgtgtgtgtgtgtgtgtgagagagagagagagagagacagagaaagagagagagattgagagaatatatacatcatgaaatcaggaggacaggcaggagccagaccatcatgtaggattttaaaagctggggtaaagaatttgtttttttctcagtgcactggaaaccactgaagagttttaagcatggaaatgacagtatttaattcacattttaagaagaacattttggccactattttagagggaggcaggatcaaagctgagagaacagttagtctgtgtcaggaaatggtggcttgcaccaggatgatagcagtagagatggagagaactatacagatttggtgtatgtttaagagtagaattggcaagacttgctaatggagaggaaaagggaactgagagaaagaaaataatccttaggtggcaaaaatatattctttaacacaagaggaaaccaatattgagatctagtttattaaaggtattttacagctaagtggccagagttttttaaggcaaggaatggtatctctctgtttcttgtgtcatcaggccatatctgatcctggcaaaagaaactggcatataaactatggtgatgcagacttttttttttttttaaataggatattagaaatttaagcttgctatgtccttttgtggaattcattgctctggtaatagacaatcatttttctgtgattgaagttaattttatattaaaatgttctattactgtacagtgaaaatgatataaaaatcaactgtatagaccattgttttctaggaacctctgagtcaaatgcatgtatttatttagtatatattatgttctcattactgtgctaggtactggaaagaatatagaagtataggatatggtttctgtccttcattaacttagaatctggtttattaaatgaattttataataaataattagaaacgcagttattctatctattgggaaatagctgtttcacttaacatttctgtgacgcagttctaccacatctgaattaaatcttcaacatgaatacagcacaatgtatctctatcttgcaatatactgttacatatttttctcaaaataatggccaatgtatatttatcttgtttccaaaatagattataacttggtatatatcttacaaattctcatatatcccagtctcttttacacattatgtacatttaatcctcagtatatacttttggattgatttgtatgtaaagtatccaccttatcatttcctttgttgctttgctctttggttatggtagcttatatagatcttgaggattctttttatggcaattcagttgggatataatttaaaaagagtcagatttacttagcaaatattttaatgccatgttctaggttaggtactgaagatcatgcaaagttgaagaagagaaggctgttgccacctgtcagtgacttcttttgagttctcatcctatttatattctttattttgtggagaatagtgcccggcgtgtagacaccattaaatgtttactgaataaattaataaaggatgaacagatctatcagggaagagaacacatgagcactgtacagaaagcattgaagagtaaatatcatttaaaaagcagaaataaaatgctactgaatttacagaaaagtactactacttgaagctgggatttggagcaaaactgtgagggaaagggaagggctgacccttaacatcattatgaaaaatgtgacatcgtttgagctctgaagggagtattaggattcagaaaggttgtaggcagggagcacaatgctcaactatgtttttaatgctgaggttttttctttataactcttgtcttatgcttgttttgcagacaatgtatttcaaaggcattgaagcagggaaggttccctattttcctcatgcagatactatcatctattccatctctacagcaatttgcttccaggcagtaagtataactttttgaaatgagaaattgaatgattcctgtttctaatgtacgttaatcaaatgggagagaaacaaactctgggaacatttctatttacagtattacattttaagcttcttttttgttttgttttgtttttttttcagcaagatagcttaccagcttctaatcattaatgttaacctaatgcgctaggtcctttttatgagtacaccaatttttaggttttaatagagtacaatttataagtaaattattgttccagtaccttgggaagaatgccccaatttaattatccttccctttgattaaaaaaaaaaggataatagggatatgctgataataggcataaatataaataattgcatttctccaatattattcagaaggaggatggggaagaactagtttcatataagcattgttcaatctctgaattctgtaaccattattattgacattaacggtgttagggctgttgtaaaatttttgggaaaacttttatttgctctttctcataaaatgctgccagcttgaaaaactcattaaaactaatgaagtatcaatatctcagtaaatgcttcctgataatgactattcacttaattattatttcaaaagtgacttttttttttcttttttttttttttgagatggaattttgctcttgtccaggctggagtgcaatggcatgatctcagctcactgcaacctctgcctcctgggttcaagtgattctcctgcctcagcctcccaagtagctgggattacaggcatgcaccaccacgcctggctaatttttgtattttcagtagagacgggttttctccatgttggttaggctggtctcgagctcctgatctcaggtaatctgcccgcctcggcctccccaagtgctgagattacaggtgtgagccaccgtgcccagccaaaagcaacatttttatttgaaggcatatttacaaaaattcttgatagttaccaacttaaacatcaatacacctttgtgtatttcatcactttcagttttcatttatatttactaaaagaattctcaaatttaatactcaggctgtcatggaagttcagactttgagaccatcttactggaagttccttttaagactcaccaagggcaagtaagtgactacgtagttttcttaaaaatattatgagtggttttatctttttgagggaatattctttcagtggtaaagtaggtatttatatataaataaaatatgagtaacttaactaagaataacatggggcgttttttgagtgagcattattctgactattcttttccctataatattgtagatgttttaagtggtctagattaatatcatgttgatttgctaactactaattagctgctacataaatacttaagtctgactgtttgaatcactgtccatttctttttgattaaaaatattaaacagattcattaaagatcatctccacataattaactgatttccattttggaaatagtcatattgtgttgcttcttgttgtaagtatatgttcctctaccttacatatcatttttgctttgttttgttttctcccctgatcttaatctaattctttgggaggcattttgacctaatagaaagagcatgggctttggagtcagacagacctaagtttgattccagctctgctaccttcagctgtgttgctatggaaaattatttaccctcgtgagcctaagtttttttcggtctacaatgaaataataatgcatacattgtatggttgtaggaaaattaagatgcttatagtagcgctgggtaaattgcatgtatgaattgctatcattattaataataatagcaaatactagtatagtgctgacaatgtccaacatatggttttaagaggcacacatacaatatccatgtatacataaatatgcatttaatccttaaatcctaactgtaagagttaggttctgttattatccctgttttacatatgaggaaactaaaatgtacaaaggggttagatagcttgccagagtcactcagttagtaaatgaaggagctggaacataaaccaggcagtctggcttcagaactttccctcttatccatgtcactgtagatcctttacattgttattgtttaatcattttttgtcatttagttttctgcacattaataagttttactaattgattattttggaagggaacttactttggaaaagtactgaaagtcacatttataggctgtcagaataatgctggccagtgattcaaaactaatttcattcagctgttttctccagaaaggaaatgcttgtgaataagcacagagacccagaaggtctatcctgtacattagctaaatttgtgtgtttaaaaaatgttatatatcttaggttaggtaatggataacgttagggtatatttttactgtgttgtgtctattaaacatttgaaaacctatatgctgtttgccttttagtcattaaatgtttgcacatttgaatgtgttttcatttgatggtgagacattatgatgtcaattatgagagaaattacatttaatgcttttgcctcattggtaatgttagctcatttattgtttagtttcctgtgaattcattcatcataaaaataataatgaacctaattttctatttgatacagtctagtggaaagaattctagaagggtttaaaataatggttgtaatctctgcggtttcagatctggggattatctctttaatccttaatcctaactggattatctctttaaataaaatatgagacagtgtatctcgaagaagagccttcatgtgacttgaatctgccattgaatttagatcctttgccacgttagccttttctgttttcccatcccacataagataagtcaactaaaatgaattattttattttataaactatattaatatttgtttactgtattctttgttttacagatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcatttcggtttcagacttcaaagttgattaataaatttaatcttaactttttattcactggaatcaaaacgatggttggtactgtgtttactgtttaaaatgaagtactaaagccctgagaactgcacctcattttctttatccagaaattgtgcttatatattttcctgtcaggtttaaaaagatgttttaattcataaattattgttttcattgacattaaaagactgtgatattgaaagatgaattacgaaatttgctgagattgtttagtaaaattttgctggtcaaaaaggtgtatttctacaatttaccttttcatttttataaattgcagtcatttttttaaattttatgtaaaatgtaaaatgaaatagctatcatgaagcagaatacaatgatgaatgtataggttgagtgaataaccaatttgcagtggtggattgagaagtccagtttgatttcattgggacagactgcaaagtgtagttgtttgagcaaacacaaagaaactttgtgtttttgaagacaatcagaatgattacctttctacctctaactaatcaggtattgattgacaactttttggcattataaataaagtaaaatagatctctgcattcc

SEQ ID NO: 38758 - DNA, 9658 bp, Homo sapiens
tttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggtgagtcggggcccccgcccggcgcccgagccccgcgcgggggtgggaaggggctgcggaaaagttgggagccccgggtgccgctttgtcgcggggccgcggaggggtcgggctgggaaggccgcggggccggggcgaggagggaggcggcgctggcggggggcgctgcgggcgctcatggcggcggccgccgggtaaggcgggcgcagcgcctcaagggagcggccggggccggcgggcctggcgccgcggtgtccgcggcagcgccgccctgagccggagaagctttcccgggcaacaggtagggcggaaggtggggacgcgggggctgcgggcgacggggccgagccgtgggcttccctttgttggggagtggaggagcttggtgaccattggcgcgagagcctccaccctggcagcggcccgcggggttgccctggcctggacgcgtcctgtggcttgggtgggaggagaggggagggccctgccccgttttcttcctaccggcccaccgtgcccacctcgcaggcgaggtcagagcttccatgtgcttaacgggaaacaggaaggagcggcccggagcgcctgccccggcccggtagggctaaggcataccgttatgaggtgtggatggctggcaagggagctcctggtggaactggctttctgggccgtagcttgttaatcactagaggcccgtggcaagtgggttgactgcaggtgtagagcactcatctttagcctgcagttggagtctctccctccctaagcctagctcctggcatcaaaacctggtttcagtcacctgagttgccaggcccaggttcagggggttctgaggatcgtggcgaatgcagtgagcccctgttcctggagaagtgagtccgagcaggcctccagcaggcagtcacccccatatctgtgctggggcaggggtgggtggcggttgctgccgcataccggagtcgggatgaccgcaccggggtgtgagtggctgcacatgtaaaggggctcctaagggtaaggacttgcctgcagtcctgtccctgaggacctggcgctgaccataccgtgatctgcacagtctgttccagagagggatccttttctcccctggtcccccacttccctcactggggcctctggccagattttcccctgggaggaagggcctccttttacccctgtcactggccataggctggctgatccctcactgtgtccttcaacaccgccccagctgtctctcaaacccaccggcgtctccctgcccctggggccatagtctcatgcagtgttttggtccgtggaggcctttggtgggactttgcagacaagctgtaggccagatgaggctgaggactactgttctgactgcctctcacccacctcttttttacaatctggcttattttgaggcccatcctgcagcctggagggataacacacctctcattggctccatccatggcttgtagacttctagtacatgacctgcttctgttgcctgaaagttttcaacaaggaagactattcaggacttcttcagtggaagcagggagccggtgggacctttgtcactcctcccttgtcaacaactcctttctattttcctcagttattcttccaaactatgagagccagtcagactgaccacctggagtctgagagaattccttcctctcaggccgaaacttctgccttctcagccgtttggatctacaaactcccatggggatcctctgctcctttcatccacctagaggggtcttgtgggggtgtcagtcagagttggggcaaaggttggggctggacagagtcctgctcaagttcctgctaatctaatgccagttaaatccctgctcttctggcccctctccagcctgtgcctcagaaagtggcatctgtgcctccaaggcaggtgtgtgtgagagagagcgtagacagataccatgtctcttcatgtgtatgggggagtgaagtctgggtggaaaagtgtttctagatgtgattttctccataagaagtcaagtaactgccctgaaggcccagggggcctggaaaaacagggttgtctccttaccgtgtgtacacttcagcttttcttgccccagcctcttgtttatggggtcttgcttggatctgtgtgctggtgctaagaggcctccccagtactgccacagggacccaactctttggttctgtggggatgtgtaagtgaggccggccaggccccagctgtcctcccctctcttcatgttgagtcagaggtcctgaccctgctgaatctggggcctccctgctggggagatgggggtagtgcctctctgctaatggaggtgcaggaccaccagggagggctgtggtcatgggaagcctgcaacctcagtgtaaaagcccccattaatctgcatttcccaagtcttccactctccctgcttggagtggaagaggacaggcgctatctcatcttggggatgaggaagttgcactgcccaggtgtctgtccttgaccatgctctagtgcctactttgcctgccccccaccccctgttttgcaggcatgagacattcctgggccccaggagtccagcaggggctccaccctccctctgcgactccagcctgccgcctgactagagaaacatccctgccagttttcacagacctggttggggatgggatctgaagtctaggactgccagggcaacatggtacctttggctttacatttccctggagaagttgggctccaagagacagcagtcaggtgactgggtcaggctgatttctcgcttccaatcaggctgagcaaaaaagtgggaagagggggccatgtgcacacatcaaagtgttccgcattgtcccttctctgtgcattttctacccttgtcccttctttattcaattttctacaacttttctctaggaaaaaagtgtgtgtttgtgtggggaaagttccactgtggataattacatttaattttgttcagttcagaaggcttccatctgtttaattaaatatttattctggctgaggtggagggggcaggggcagtgtctggaatgtgtgtgtgtgatttgggggaggaggaggggagaaggtggagctgaagctcctttactggcagtgctgacctctgatttcatccgagagagcagtgaccaggagtggggacaagggggtaaagtccttgagctggaatactgacccgtgacaggctgagggatttcgcaagggctacagtggtgggtgggggtggagcgggagctgtcagagcagcagcaggaccagcccagcccagctgtggtctcaggctctgtcttcagtcagtggcaccaactagtctccaggtcactgtggataacaatttcaccactctcttttcttcctgtctctgctttcactttctgggccagcctaaatcccaccgcctcatctccttcccaggagaacaaggggtggggagcctggaaaagactgtcatggtcatcctgctgcggcttcttgctgagtcctaggattgccaggtgtttgctggacccagcatccctggctctcctggaccatcttgccattcctctcagcttcaagcagctgctcttccctcatgagccacacacgtctgaccgttccctccctcctctgggtatccaagtggtcactcccaccatgttgttcgtctttcagttgggggaggaggtttacatagcggctctttcctagactgagagggtatgggtgttcccctgcagactaggattctgttttctggatgagcatttatacgaaatagctctgaccaggcaccgtggctcatgcctgtaatcccagcactttgggaggccaaggctggcaggttgcttgagcccaggagttcaagaccagtctgggcaacatggcaaaaccctgtttctaccaaaaaaaaaattcaaaaattagccagatgtggtgtgtgctacttggtagtgcatgctactcatagccccaggcactcgggaggctgaggcaggaggggaggatggcttgaacctgggaggtggaggttgcagtgagctgtgattgtaccactgcactccagcttgggtgacagaggaagaccctgtctcaaaagaaaataaaagaatagctcttaattccatcagatgtattggtccgctctcttggttccctgccccacaatccctgactctttgcagccctaccttcacttttctttctgaagagttatacatagggtccttctgccttgtgtgtagggactagatggcttggcatggagtgtcaaccttgtgtgcagtagttcgatgtccagtgattgtggagctcagtgtcatttggggacataattttgctttaccttggcttttttttttttttttttttttttgagacagagtctcactgtgttacccaggctggagtgcagtggcaagagcatggctcactgcaaccttcacctcccaggctcaagtgatcctcccacctcagcctcctgagtagctgggattacaggcatgtgccaccacatccagctaatttttgtattttttgtagagatggggtttcaccgtgttgcccaggctggtctcaaactcctgagctcaagtgatcagcctgccttggtctcccaaagtgctgggatttcaggcgtgagctactgcccagcctaccctgtctcttaatttttctttagggacttgctactcagatgggttgtaggttgtagggaaggggaagaagggtttgcctcagccctgcaatgttttggggcaccccctggaagctttcagctgagttggcttggaggctcgaggaagtggccagagtgtagggggataagggagggactttactcagattgttggctacagcttctagggccaggtcctgcctgtcttgcaggttaagatagcaaaatgacaagacccccaaggttcttcccccactccccgaaatcagaggttgtaaggaccccaagtttcttaattccagggaatcacgtctgcaggttgctgtagacaataaatgctttttttttttttttgagacagtctcgctgtcacctaggctagagtgcaatggcgtgattccggctcactgcaacctctgcctcctgggttcaagcgattctcctgcctcagcctcctgagtagctgggactataggcgcccgccaccacacccagctagttttttgtatttttagtagagatgaggtttcgccatgttggccaggctggtctcgaactcctgacctcgtgatctgccagcctcggcctcccaaagtgctgggaccacaggcatgagccatcacggccggcctaacagtaaatgttaaaactggaaagccaccgtattacagatgaggaaactgatttgcccaaggctacatagccaggatagggatctagagttcgactctctgcccccttctccttttgatacatcctgaaaacttttattcatctatctcttcctccatagctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtaagcatgccagcctaccctcatgccttcccctgttgccagttgcagtttcttggacttcaagtttgttccttgctgtttaattagcccttgaccctgatgttctggctactcaggttcctgcccactgtgcaccccctcccctgaaggcaccattgtcttcctgaaggctcagcacccccaggccctttccatcaatggttatttgttctcaccctctacccgccgcccgcctggccactagtgaacacacaggcagctttgtcagctgtgggcagccctggaggctagagaaaagggggttgccaggaagctggggaaactgaggccagggtaaagttgccttagcttgcagccctttcccttcccagcaagctagataccttactcatatcccttccccaggtacgtggctacaccactggctgccctcttgaacataaaggagaaaactcggctgcgggcacctcccaacgccaccttggaacatttctacctgaccagtggcaagcagcccaagcaggtatgagccgcatgctgctctggctctgggaatcactgagtttggtggtggggggacagggtttgaatgttagctctggcaggtgaagagatggggaagcagtggtgctgactgaggttgttactgggagaggctggggatgctgctgagttccgaaggtaaacataacaatgggcttcttcactgtgcccaggtggaagtagagcttttgtcccggcagagcgggctctctggccgccaggtagagcgttggttccgtcgccgccgcaaccaggaccggcccagtctcctcaagaagttccgagaagccaggtgggggaggctggggcagaagctgggtgacaaggaatatcctgatgtgtcttgctgggagggataggcggtggctatacgcagggagatgtgaggaggtgaattcagttattaatggtatcttgtgagggtatctgcaggtatttgggggctgctgggggactgtgctatcctctgacctagccatttctgcttcctctgccagctggagattcacattttacctgattgccttcattgccggcatggccgtcattgtggatgtgagtggggattactgggaggtgggagtaggttctctggcaaggtcaggtgaggccatggaatttgggttcctcctcttttaacttctcaccatctctctgcagaaaccctggttctatgacatgaagaaagtttgggagggatatcccatacaggtatgagttctgcttcctcatgtgggggtggactaagacacaccctagtgaagagacggtttgtggaatccatggcagagggattagagtgatggaatgaagaacctcaggggctagggggtttgtggagtggggacacccttgcggctggttgctcttacctctctctcctctcccagagcactatcccttcccagtattggtactacatgattgaactttccttctactggtccctgctcttcagcattgcctctgatgtcaagcgaaaggtgggtgaaggggttgtgcaattaagcctcagagccaaaatgaggccctgggatgaacaccctctcctttgacttctgggtactctgaatggagctgttggtatatggggaaccaaaggcaaggggtaagaaggcatagtgagagctggggaataaaaaaaggccctggggcctgcatcatctctgcaggatttcaaggaacagatcatccaccatgtggccaccatcattctcatcagcttttcctggtttgccaattacatccgagctgggactctaatcatggctctgcatgactcttccgattacctgctggaggtcaggcttcctcaaatctagagaccctggtgcaggttcttctgtccctttggttttctttgggagggaggtgcggggtgggaatttggaggatgacattcctgggaccaaggaggagggcacagagtcagtgctcctaactggagtgtacatatgaatgtactcgagggagtcaggagcccatgatgatggatgggggctctctatgcagtcagccaagatgtttaactacgcgggatggaagaacacctgcaacaacatcttcatcgtcttcgccattgtttttatcatcacccgactggtcatcctgcccttctggtgagtaggcagctaggctacactcctgttctgaagaaatcaggagccttgcctttcttcccctcctgtatctccccggtgtctgacctgctcttgtccacgttctctctctccttgaatcctcaggatcctgcattgcaccctggtgtacccactggagctctatcctgccttctttggctattacttcttcaattccatgatgggagttctacagctgctgcatatcttctgggcctacctcattttgcgcatggcccacaagttcataactggaaaggtgaagccctgttcccattgtgtaggccttactactctctacaacttcctgaactcccatcttgccagtaactctctaaaaaactagtgtggagccctgggtataacaggaacaagccctcagagagaagcagtacttaggggtttgaggatctcatgtaataacccttcttgtcccttttccacagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttctta

SEQ ID NO: 38759 - DNA, 1695 bp, Homo sapiens
tccagtttccagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaaggtgaggagcgcggccctcttgtccactctgcgggtctggtctgagggggcggagccggctgcaagtggaaagggaccgggaccaacctggtaaaccattccccaagtctgagtcccccagaaccttgggctgaacccgcccctccatcgcctctaatggaagactggttagggctgcggagttaggggtggcgtagattggagatgcttggctagtggaaagaatggattgccttccggcattagagaaattagattggcaccttgttttcttgctcggttggatccgtgatgttatgtcctcacagctcatcgactatgggaagctgggagacactaacgaacgagccatgcgcatggctgacttctggctcacagtgagtgcgacctatctgccttcaaaatcccaccctttgctccctgggggtgggggttggaaaaaggagaactatgcagaattaaacttgggtactcacttatgggccagtgctgctaactaaattagaaactgtgtcttaagttagttgaagtcgatgtgaatatacctctgcacaactgcctataaacgacccctttgtgtaacactgactatgccagattggcgaggggagggggaggtctttctatgtgtggatggaccttacctttgggaatggtgtaaagttaaatgcctctgcagttttgcctgactctgctgtctcttggataattctccctctaggagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaatttgggttatttttggttagtgcaattttgtttttcttaatgccagtttacatgggaatgcatcctataattccaaatgttgccagaggtggttgtgttttgacatctggtctcctagagatgagtgcttgggatttcttagagaaagattacttcctgacaggggtaggg

SEQ ID NO: 38760 - DNA, 21185 bp, Homo sapiens
ggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgaggtaggcgctggcagggatgagggcagagatgagggtttgagtacttctagagagggaaatggcacttgatccggacctctgcacctcctgctggcctctgaccattgatctagggctccagcaccacagagtcaatggttagaatcgggctgatttagcccagtgaagacgttacgtgctagcaaaacggtaggcgcactttatcattactagtaacaaccagcttgtattgaatgtactatatgccaaatgctttatataccacatttttaaatattttatttttgagacaagatctcgttctgtcgcccaggctggagtgcagtggcactactacggctcactgcagcctcgacctcccgggctcaagcgatccttctacctcagcctcccgagtagctgggactacaggcatgcgccactacgcttggctaatttttgggtgtttctttgttcgtttgttttttgtagagacgaggtttcaccacgttgcccaggctggtttcgaactcctagactcaagcgaccctcccacttcgacctctcaaactgggattacaagcgtgaacccccacacccggcctacgtaccatatttaatcctcacaacaactgtataaagtagtaatattaccattgaacaagtaaagaaatactttagaagcctggagagatcatcctctgggtagcttctgcctgtactcaggtgtatagcctctgggtactgcaaaatatgaccagctccatcagcctggagagccatacatacggattaaaacaaaaattttggctaaatcgttttctagttttgggacttcagacagggcccttcaagttccaggcctcagcttatatatctcaaacatgggaatgatacagcccaccccacaaacattgttgggaacatttaggcagaatatgtgaagctcttgacacagctcttgtatgtaataggcacccagtaagtgttgaatgaatgtagtgtccccccttctactcattcccagtgggggaaaaaaaaaaaaacaccacccaatcccacctaaactcttcagggtctgctgccttgacagagaaaagcctacaaaagcccctaagaggccaggcacggtggctcacgcctataatcccagcactttgggaggccgaggcggggggatcactaggtcaggagatcgagaccatcctggctaacgtggtgaaacccggtctctacaaaatacaaaaaattagccaggcatgggggtgggcacctgtagtcccagctactcgggaggctgaggcaggagaatggcatgaacctgggaggcagagcttgcagtgagccgagatcctgccactgcactccagcctgggcaacagagcgagactacgtctcaaaaaaaaaaaaaatttagccgggcatggtggcaggcacctgtattcccagctacttgggaggctgaggcaggagaatcgcttgaaccagggaggcagagggcagaggttgcagtgagccaagatcacgccactgcactctagcctgggcgacagagtgagactccgtctcaaaaaaagaaaaaagaaaaaaaaggaaaaagaaaagagagagagagaaagagaattgttacccagcacaggattaatttagtaaactgccattctctatgaaaaggatatgaagcagacccagaaagagaatccccattcattttaagaaagaagcacagggctggtcatgatggctcatgcctgtaatcccaatactttgggaggccaaggtgggaggatcacttgaggtaaggaattcaagaccagcctgggaaacatagtaagaccctgtccctacaaataataataataataataataaaagtttcagctactcaggaggctgaggcaggaggattacttgaacccagaagttcgagagggtgtagtgagctgtgatcacactagtgccttgtagcctgggcaacaaagcaagaccctgtctattaaaaaaaaaaaaatggccgggcgtggtggctcacgcctgtaatcccagcactttgggaggccaaggtgcgcggatcacggggtcaaaagatcgagacaatcctggccaacatggtaaaaccttgtctctactaaaaatacaaaaattagccaggtgtggtggcttgcacctgtagtcccaactactcgggaggctgaggcaggagaacccaggaggtggaggttgcagtgagcccagatcatgccactgcactccagcctggcagcagagtgagactccatctcaaaaaaagaaagaaaatcagccaggcatggtgacctgtgcctgtaatcccagctattctggaggctgaggcacaagaattgcttgaacccaggaggaggaggttgcagtgagctgagatcttgccactgcattccagctgcctgggagacacagcaagactccgtctcaaaaaaaaataaataaataaataaataaataatacaggccgggagcagtgagtggctcatgcttgtaatcccaacactttaggagtctgaggtgggtacatcatttggggtcaggagttcaagaccagcctggccaacatagtgaaaccccatctctactaaaaatacaaaaactagccaggcggtagtggcatgcacctgtaatcccagctactcaggaggctgaagcaggagaatcgcttgaacctgggaggcggaggttgcagtgagccgagatcgggccactgcactccagtccgggcaagagagtgagaccctgtctcaaaaaatagtaaataaataaaatttaaaaaaaaatacaacatcattaatctaccatattccttattcaccagcatttagtgatgttgggccagactcactgtttctcttagagacactgtggatgtcctcatcctttccctttaaaaaggggcagcatgatggataagctagaccttagcactgtggaacatgtcatcaggaccctctgcaagggaccttcgaattgtgcattttcctggggcaggtttctcctccctatcggcttttctcctttcaccctcataaccctggcacttggtggatggaactcagcagcttgcgttcactgaataccaagatataaccctgacaaacccactgcctactaccacttaaataactgagcttgaggccgggtacggtggctcacgtctgtaatcccagcactttgggaggccaaggtgggcagatcatgaggtcaggagttcgagaccagcctgaccaacacggtgaaaccccatctctactaaaaatacaaaaattagccgggcttggtggtgctcacctgcaatcccagctacttgggaggcagaggcaggaggatcacttgagcccgggaggcagaggttgcagtgagccgaggtcatgctactacactcctgcctgggcgacagagccagattacgtcttaaaaaaataaaaataaaagtaaataaataactgagtttggtccagctttgaggtagaaatataaatgtttcccattcccctctgagggttaccataaaatatttaatataaaacatcttaaacttttttttttttttgagatggagtgtctcactctattgcccaggctggagtgcagtggcatgatctcagctcgctgcaacctctgcctcccgggttcaagcgattctcctgccccagcctccctagtagctgggactataggcgcgtgccaccacacctggctaattttttgtatttttagtagacagggtttcaccgtgttagccaggatggtctcgatctcctgacctcatgtcttttgttttttttttttcctttttctggagaacggggtctcgctatattgcccaggcaggtctcgaactcctgggctcaagctatcctcccgcctcttagcctccctgagagctgggattacaggcgtgagccaccgcgcccggccgatctcctgacctcatgatctgctcacctcggcctcccaaagtgctgggattacaggtgtgagccatcacgcccaagcccaagctttttggataagtgtacaggccctagcaggtgtttggtttgccttgttttaagtctgttttataatgttgtctcctttgatattcaaaactaacaacatctgttacctactgaacttttccattcaacagcttctcagaatttatagaattccccaattttcttgcttaccttgcctttcctggtgcttccagcatgagcaagaacagagtttggagaattgattagtctttttttttttttttttttttttgagacagagtctctctgtgttgcccaagctgtagtgcagtggctccatctcggctcactgcaacctcccactcccaggttcaagagattctcctgcctcagcctcccgagtagctgggactacaggtgcccgccaccacacccggctaatttttgtatttttttagtagagacagggtttcactatgttggccaggctggtcttgaactcctgacctcgtgatttgcccacctctccctcccaaagtgctgggattacaggcttgagccactgcacggcgaataatatattagtcttgataagaaggtattgatttaacccagtgagcacttggggttgatctgttgtatcttgttggtctccaagactgtctcacacccaagctcatctgggcagacactcttccttctcctcaccgactgcttaatccatatgttttgctcacacttgtccaatgttgagaagcaatagaggactagggtttggaatattactgctccatggactatagctgagcagcattacagggcagagtttctcaactgggttcacattagggctctcaacttccctggagtttgggtagtcctaatcctacttttataagcaaagacactgaggttcagagatgttaagcggcatgcccaaaatcaccagcaagcaagaggagtgaacacaagatctatctggcaacataaatcacacacccccaccccatggattgttggaattacttcttccttttgttccacctgagcctgcctgcccacagtagcccttcctgttggtccccaaatgccttcctaggatggctgttctaagaggcttttcctgttctactgtcataatgaacatctatgcagttcattgcagtttacatggtattttgcatatctcatttttttttatttatttaaaaaaaaataggccgggcacggtggctcacacccgtaatcccagcactttggaaggctgaggcgggcagatcacgaggtcaggagatcgagaccatcctggccaacatggtgaaactctatctctactaaaaatacaaaaattagccaggcacggtagcgtgcacctgtagtcccagctactcaggaggctgaggcaagagaattgcttgaacctgggagtcggaggctgcagtgagccgagatcatgccattgcactccagcctgggcaacagagtcagactctgtctcaagaaaaaaaaaaaaattggctaggtacagtggctcacgcctgtaatcccagcactttgggaggctgaggcaggcagatcacctgaggtcaggagtttgaaaccagaaataaataaataaataaaaatagaggcaaagtctcactatgttgctcaggctcatctcgaactcctgggctcaagcgatctgcccgccttggcttcccaaagtgctgggattacaggcatgagctaccacgcccagatgcacatctaattttttttgttttgctttcagacagagttttactctgtcacccaggctggagtgcagtggtgcaatctcggctcactgcaacctccgcctcccagattcaagtgattcttctgcctcagcctcctgagtagctggaattagaggcacccgccaccacactcagctcattcttatttaaacttcaggccggtcgcggtggcttacgcctgtaatcccagcagtttgggaggtggacgtgggtggatcatttgaggtcaggtgttcaagaccagcctggccaacatggtgaaatcccatctctactaaaaatacaaaaattagctgggcatggtggcaggggcctgtagtcccagctactcaggaagctgaggaaggagaattgcttgaacccaggaggtgaaggttgcagtgagctgagatggcgccactgcactctaccctgggtgacagagtgagactgcatctcaaaataaataaataaataaaataaacttcataactttgtaagataggcaaagcaagagttgtccctggccaggcacagtggctcacgcctgtaatcccagcattttgggaggccaaggcaggtggatcatgaggtcaggaattcaagaccagcctggccaacatggtgaaaccccgtctctactgaaaatacaaaaattatccatgcgtggtggcaggtgcctgtaatcccagctactcgggatgctgaggcagagaattgcttgaacccgcgagatggaggttgcagtgagccaagatcgcaccactgcactccagcctgggtgacagggtaagactccgtctcaaaaaaaaaaaaaaaaaaaaaaaagagttgtctccacttctttgtgaagaaaccaggctgagaaatattaaatgacttgctcaagggtggtcctattagaaccccagatgtcagcccttagaccctatcagctgccagtaagtgcaggactcagactcacaccccagatcctggaccccagaccctgtgcttcttgtcctacagcacctgccctttgtatcacagccccagagtatgccagagttgtgtacatgaaaccaataccacagccacagttgaacactgaacagaagtataggcccatggggttctctgggttcatggggaggatgtcctgctgctgcagtagttggtgaaattttggtgatgaaaagaatgtttctgggaatgtaagcaaatggtttggacccaaggccagggacttgcttggcagtgtctctgggaatccggaggcagcacccagagcctggctcagggagacggctatgccttgtggatctagaaaggatgggagttctcttcccactctggactctgtcacccaccatcagctttcccttctctgtgcagattacagccacggccttcaggagtgaccatagacgaatcctttctcacagaagacaagagcacccagaatcgcaagcttcttcagaaacgaaggacgctggttagtgacaatgttgttttggaaccccaaatgtcagcccccagaccctatccgtctcccttcctgcaacccaagagtaccacccacctgaaacatgcccacctgaaacatgcccaccagagtggcttcttctcagttagagagtgtggctcagagaggccaggcccaccaggctttggggagaagggtgtacactggctgcctgctccttatctgaaaagccttcccggatctccctaggcagagagagaactcgcctctgcccacagacatccctccccagcagctcagcattctgcagcggcccttacctctcatccctcccgccaacacaccaggcactgtgctacctgctgggacggtcacaccagatctgccaaggtccttcatggctgtgactgtatctttctatctttatggccctagaatctaacaggctacctgaatgtctgccaaatgttgatagctccataattgctgagtaggtgtgtgaaggcaggaggaaagagatgcgtctctaccatgttcactccggatctctccgccattcctcttttttaaagtttgtatataaaaatgaatgctgtaccaaaggtatcagaagagaaatgaaatttaaattaaaaaaaaaaagagccgggcgcagtgactcatgcctataatcccagtactctgggaggccgaggcaggcggatcacctgaagtaaggagtttgaccagcttggccaacatggcgaaaccccatatctactaaaaatataaaaattagccatgcatggtggtgcatctgtagtcccagctactcaggaggctgaggcacgagaattgctttaacctgggacgtggaggttgcagtgagccgagatcacaccactgcactccagcctggacaacagagcaagactacatctcaaaaaaaaaaaaaaaaaaaaaaagaatgccatctttttttttgagacaggcttttgcctgtcagggtgcagtggtgcagtggtgcagttatggctcgctgcagtctcaaatgccagggctcaagtgatcctcccacctcaccctcccaagtagctggaactataggcacatgccaccatacccagctaatttttttggcagggggggacagagttttgctctgacactctggctggagtgcagtggcacaaacacagctcactgcagactccacctcccatgctgaaccaatcctcccactcagcctcctgagtagctgagactacaggagtgcgccaccacacctggctattttttgcattttttgtagaggcagagtctaactacgttgcccaagctggtcttgaactcctgggctcaagctatcctccttccttggcctcccaaagcactaggattacaggtgtgagccaccacactgagctcaatactgtttttttttttgagatggggtcttgctctgtcacccaggaaggagcacagtggcgcgatctcggctcactgcaacctccgcctcctgggttcaagtgattatcctacctcagcctcctgagtagctgggattacaggtgcacaccaccatgcccggctaattttttttttttttttttttttgagacggaatctcgctgtcgcccaggctggagtgcagtgacgcaatctcggctcactgcaagctccacctcccaggttcaccccattctcctgcctcagccgccccagtagctgggacagacgcccgccaacacacctggctaattttttttgtatttttagtagagatggggttttaccgtgttggccaggatggtctcgatctcctgccctcgtgatccgcccgcctcggcctcccaaagtgctgggattacaggcgtgagccactgtacctggccccaatgctgtcttattaagtacttttgggctcttgttgatatgatcataggattgttattaatcagcaaatagccattgtccaaatctcataaaggaaaaaacacatttgagtaaacttacaactctggctcacagtggaacagcatgggctgtatggtggttttccttctgtgaccctgaccctcgtggggaatttggaaacacatgggccacacactttgtggggctggggactcccaacacccctgcgggagtgactccagggaggagaaaggaggggtcagtatggattattcgcagagaccaagcgcagcccaaaaacctgatgactaggggagagctctgaggctcccgggcacccttctcagctgccaccttctgtgggccaggctttttcattctttcttttgcgcggcatcaaccaccagggggcagtgttccctcccgccgtccctccggggccgccttcccgtttttacctacagggggaagcagagagcacggagcgcccgggagcactgcgttccagccacccgggcggagatccctcagctgttaataacctagccgagacccggccctggcagctggttctccagcttccactcgcctctgcaagcaaaggagggtagccacattttctcccggtagaaacagtagacagaacacgaggactggtctttttttttttttttaatattaattaatttattttttgagacggagcctcgctcctcgcccaggctggagcgcagtggcacagtcttggctcactgcaacctccacctcccaggttcaagcgattctcctgcctcagcctccctagtagctgggactacaggcacgtgtcaccacacctggctaattttttgcggttttttttttgttttttgtttttttgaaacagagtcttgctttgtcgcccaggctggagtgcagtggcgcgatctcggctcactgcaagttccgcctcccgggttcacgccattctcctgccacagtctcctgagtagctgggactacaggcgcccgccaccgcgcccggctattttttttttttttttgtatttttagtagagacggggtttcaccgtggtctcgatctcctaacctcgtgatccacccgcctcggcctcccaaagtgctgggattacaggcgtgagccaccgcgcccggccattttttgcgtttttagtagagacgagggtttcaccgtgttagccaggatggtctccgtctcctgacctcgtgatttgcccgccttggcctcccaaagtgctgggattacaagcgtaagccaccgcgcccggccaaggactggtcttttacaagtctgaaaaacggccgggcgcggtggctcacgcctgtaatcccagcactttgggaggccgaagtgggtggatcacctgaggtcaggggttcaagaccaccctgggcaacatggtgaaactccgtttctactaaaaatacaaaatttgccgggtgtggtggtgcgtgcctgcagtctcttcgggaggctgaggcaggagaattgcttgaacttgggaggtggaggttgcagtgagccaagatagtgccactgcgctccagcctgggcaacagagtgaggctccgtctcaaaataaatgaataaataaaaacaaataataaaaaatagtctgggccgggcgcagtggctcacacctgtaatcccagcattttgggaggctgaggtgggcagatcactaggtcaggagttcaagaccagcctggccaacatggtgaaaccccatctctactaaaaatacaaaaattagctgggcgtggtggcatgcgcctgtaattccggctactcgggaggctgaggcaggacaatcacttgaacccaggaggtggaggctgcagtgagcagagattgtgccactgcaccccagcctgggcgacagagcgagactcagtctcaaaaaaataaataaataaaattctgaaaaacaaggctggctcacacctgtaatcctaacactttgggaggccaaagaaggaagactgcttgagaccaggagtttgagaccagcctggcaacacagggagatttcatctctacaaaaaagattttttaaattaaccaggaatggtggtgtgcccatgtagtcctagctactcaggagactgaggtgggaggatctcttgagcccgggagtttgtagttactgtgaggtgttattgggtcactgcactccagcctgggtgacagagtaagaccctgtctctaagaaaaaaataaaaaataaactcccaggtgtcttccagggttattttgtgcttttataaaaattaggctgggcatcatgactcaagcctgtaatcccagcactttgggaggacaaggtaggaggatctcttgatcccaggacagttcgagaagcccagcgtgggcaacatagtgagaccccatccttttttttttttttttttgagacagagtctctctctgtcgcccagactggagtacagtcgtgccatgtctgctcactgtggcctctgcctccagggttgaggcaattcttctgcctcggcctccgaaatagctgggattacaggcgtgcactaccaggcctggttaatttttgtatttttagtagagatggggtttcaacatgttggccaggctggcctcaaattcctggcctcaggttatccgcttgcctccgcctcccaaagtgctgggaatcaggcgtgagctgggcgcgatggctcacacttgtaatctctactaaaaatacaaaagaactgggcatggtggcaggccagctactcgggagtctgaggcaggagaattgcttgaactcaagaggcagagctgcagtgagcagagatcgtgctactgtactgcactccagcttgggcaactccagcttggcaactccatctcaaataaataaataaatacatacatataaacatacatacataaataattacatccattttgatagtcttttttttttttttttgagatggagtttcactcttgtccccgtggctggagtgcaaggggtcgatcccagctcactgcaacctctgcctcccgagttcaagcgattctcctgcctcagcctcccgagtaactgggaatacaggcgtgtgccaccatgcccggctaatttttgtatttttagtagagatggagtttcaccatgttggccaggctggtctcaaattcctgacctcaagtgatctgcccaccttggcctcaaagtgctaaaagtcgcacatcttggcctcccaaactgctgggattacgggcatgagccactgtgcccggccagaatagctaatctttactgagttcctagcaagtaccagggtccatgtgaagcacacattatgctttccctctttttttttttttttttttgagacagagttttgttcttgttgtccaggctggagtgcaatggtgcaatctcagctcaccgcaacctccgcttcccgggttcaagggattctcctgcctcagcctcctgagtagctgggactataagcacatgccaccacacctggctaaattttttttttttttttttttttgagactgagtctcgctctgtcgccaggctggagtgcagtggcgcaatcttggctcactgcaaactccgcctcctgggttcatgccattctcctgcctcagcctccagagtagctgggactacaggtgtccgacaccacgcccggctaattttttgtatttttagtagagacggggtttcactgtgttaaccaggatggtctcgatctcctgacctcgtgatccatccgccttggccttgcaaagtgctgggattacaggcgtgagccaccatgcccggcctaatttttttttgtatttttagtagagacggggtttcaccgtgttagccaggatagtctcgatctcctgacctcgtgatccacccacctcagcctccgaaagtgctgggaattacaggcgtgagccaccgcgcccgactatgctttctcactgcatcctcacatcaatacactgtgacaaagactaccatcatccctattttacagacgtgagaactaaggctcagagaagttgtgacatagctaataagggacatttgagacttaacccgagtcttctctaactcaagaacccacagtcttaattatgaaccatgttgagagatgtttgtaaaacacatcagggctggccaggcacagtggttcacgcctgtaatcccagcactttgggaggccaaagtgggtggatcacgaggttaagagttcaagaccagcctggccaagatggtgaaaccacgtctctactaaaaatacaaaaattagatgggtgtggtggtgggtgcttgtaatctcaactattcgggaggctgaggcagagaacagcttgaacctgggaggcgaaggttgcagtgagccaagatcgtgccaccacactccagcctgggcaacagagcaagactgtctcaaaaaaaaaaagtcaggactgggggaggagagatggagagaaacattaggaaggggagcaatgttgccatggcaaccccacctgtacctccctgcagactggtcagttctccatgggtgggcacctgtccccatggcccacatacaccagtggccagaccattttgcaaaatcgaaaaccctgttcagatgactaccggaagcgagtagggtaagccagggtcagtcccatggtgggtgagctggcatgggccaggctttgggccaggagacagggcaggggcgtgtgttgccccagactgagggcacaagggccccgtgggggtgctggccacatatcagccactgtcccctgcaggagctgccagcagcacccctttcgcactgccaagccccagtacttggaggaactggaaaactacctacgcaaggagctcctcctgctggacctgggcacagattccacccaggaactaaggctgcaggtcagagccacagaagaaacttggggagggcgggggaagggtgggaagaagcttcacctaccggccgggcacagtggctcacgcctgtaatctcagcactttgggaggccaaggcgggtggaccacctgaggtcaggagttcaagaccagcctggccaacatggcgaaaccccgtctctactaaaagtacaaaaattagccaggcatggtagtgggcacctgtagtcccagctactcaggaggctgaggcaggagaatcgcttgaaccctgaacccgggaggcagcggttgcagtgagacaagatcacaccactgcactccaacctgggcgacaagagtgagactccgtctcaaaaacaaaaaaaagcctcacctacaaggactgagcacctcagaccttcaggggagacccacctctcccagctctcctgggtctccttccctgaacagaagcatgaaacatcccatgaaaatgccagtgaggccgggcacagtggctcatgcctgtaatcccagcacttcgggaggctgaggcaggaggatcgcttgaggtcaggagttcaagaccagcctggtcaacatggtgaaaccctgcctctactaaaaatacaaaacctgcagtggtggtacacacctgtagtcccagctactcaggaggctgaggcaggagaattgcttgaacccaggcggcagaggttgcagtgagccgagatcatgccactgcactacagcctgggcaacagagtgagactctgtcaacagaaaaaagaaggccaggcacggtggctcacacctgtaatcccagcagtttgggaggccgaggcaggcggatcaccaggtcaggagatcgagaccatcctggctaacatggtgaaaccccgtctctactaaaaatacaaaaaaattagccaggtgtggtggcaggcacctgtagtcccagctgctcgggaggctgaggcaggagaatggcatgaacctgggaggcggagcttgcagtgagccaagttcacgccactgcactccagcctgggcaacagagtgagactccatctcaaaaaaaaaaaaaaaaaaagaaaacgccagtgagcaggcaaggctgcaatgtggatccaaaagtctcctgaggctggagtttcctcacctgagtcaggtggcctggatgctgtgcccagtccctgcagctctgtgatccccagtacccaggttgggccactggacatcagtgaacgtagcctgaatgctggcagttgggcaagcaggggtcacaccgtgtttaccagtccagtggcaacaaccccaagcttaaggaaccagcacagatgcataaggagggagggaggaagagagagagagagagagagagagatcagatccaacccagataccagtgtatagtagggagagaatcaccaaatctgcttaaacaaggatgatgacagagaatccctgccttttgacttagtcattgactaaagcatttactgagcactggctatgtgcaagtgcaaggccctgggctggggccttacatcgatctcctgaacagataaggaagaaagcataccactatggcgtagtggggctgggcttcaaactcagggctgactctggagactgtgctcatttcagtgagcaatgctgcctccagaaacctcccatgtgtccaaatgggacagaagaccacacccctacttgcatgtcaggatgcaagggtacaaccttcaatctcctgaatctaccaggctctaagatggggagaggttacaagtgagaggccaatgatgcagtgtctagaaggcaagaggctggctgcctggagagccagagaggggctcaggcacagagtggatgtctgtctatggtcatggcagtccactaggcctcagagacagcatcaggacaggcctccagagagctgccccccaggctccgtggcactgtgaggtacccgggtggtatctagggcatttacttgaatataagtgacctggcagcctcatgctggaatactgctaagcccagtaaagaaaaaaacagtgccaggcacagtggctcacacctgtaatcccagcactctgggaggccgaggtgggtggatcacgaggtcaggagatcgagaccatccaggccaacatggtgaaacctcatctctactaaaaatacaaaaattagccaggtgtggtggcgcgtgcctgtaatcccagctactcaggaggctgaggcaggagaatcacttgaacctgggaggcagaggttgcagtgagctgagattgcaccacagcactccagcctgggtgatggagcgacactccgtctcaggaaaaaagaaaaagaaaaacagttccccactaaggttggcagctgtgggctaggagatgatgggttcccttttcttgccagccttacagagagatctttgagttcttcatagaggacttcaaaacgtacaagccattactatcctccatcaagaatgcgtatgaggggatgctgggtaagaatgcacctcctgccaggcgtagtggctcacgcctgtaatcccagcactttaggaggccgaggcggtagatcacttgaggtcaggagtttgagaccagcctggccaacatggtgaaaccctgtctctagtaaaaacacaaaaaaattagctgcgcatggtggcacacacctgtaatcccagctacttgggagactgaggcaggagaattgcttgaacctaggaggtggaggttgcagtgagttgagatcacaccaccgcactccagcctgggcaaaagaacaagactccatcgcaaaaaaaaaaaaaaaaaaagaatgcagctcccctccttgtcccagcctggaaggggtggagaagatcctattcgaccttctggtgctccacagcagggctggggcagctaccaactgggccttgaggtcaccaaggcccctcagccattctgcacagactgttccatgatagggcaccccagagcacctgacaacacctgtcattgagaagcacaggggggcagtccctgttgaaaatggagtgaaccccaggagagagtcagcacctctgggagtcagcaggctcccctgccaggctcaggaggtgcagggcatggtgcagctgcaggacttaaggctgtaggggaaaggacataggagagaccccggtcttcatctgaactctgccctttgtttaaaatcaagtgcaggaaggcctgaaacagggaccatggctttgaacaaggcatgcagagattcttggggtttgcaagcgacatagccactcacccatgaccttagggtgtcttctggctgtttgttctccatggccccaaagcagctctcccacctgtctctgcttagcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaatggaagtggtgtgatgatgaccaagtccccgaattcctgccaactccacgacaagggtgaccccctaccctgctctgcctttctacggagagtgacacactgagccaccaccttcccccagagccttgctaactccaccctctgccctgctgctaggctcagtactttccccacagggggaaacattggcaccttgccgaattctcagaaatggccaatctccttcttctttcacctttcctgttcacagtccctgatggggccccccagaacccagcccactccctggggtgaccagctgcatacaggggtccaggggcagcccctgaccacacagccaccttcttgccaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggtaagcctgaattgggaatcgggtttctctcttctctgagacgctggaagactctggtctcacccctaagccccattcattcagcattcctaagacctgctcattccataaccattcagaggggagatgtccctgcctcccgcagggctgtgtatcttctgagttgaactgagaattgtaggaacacagttggtagctgaggcagcctaggctcccagtgggctggacaggcctggtactcagtttcctgggcttctagactttagcctgaaaccctaggctggtagtgctgtgggcaagaaccagggaaccccaaacaggaagggcagagggcttcaggcaacccctgagaaagccacggtgacacgggctggtgggccccttcccctggcaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggctgctgcgggagaaagacttcttccctggtctggtaggggaggccccaggagtggggcttgggccagagtcagaacagccatgccctgctgctcagacaagcttttggggaaccaactggggatcttccctgattgggggtggggccacagatgggtccagagatgagctgatatcctccctcctagggctatggggaagccatccctgcttttcttcggtttgatggcctcgtggagaacaagaagccaagcaagaaggacgtggtcaacctcctcaaggatgcctggaaggaacgtcttgctgaggagcaggtcagatctcaccagccactctggcccagcatggtcttcagatccagagtcctctgcaggtccagaggtgacagggatgagggccaaccaaccgtaagactctgactgagcatttcctcgatcccgcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaaggtgagctggggcctattccccttggggagactgagaggggtctttgtccctagcatagaccagctttgcccccaccactcccaggaacagcaggtgaataatgcttctctccttatagcggagtgagaatgtgtatgtcacccagaaggagacagtagcccagctgctgaaggagatgacaaatgctgacagtcagaacgaggggctactaaccatggagcagttcaagtgagaggccagtccaggctacccccaactcctacccaactattcctgcatctgtagggaaaaggggcacctggtgggaagggccacagcctcggcactcactcccttttgagcactagggagaggcacaagcaggcctcagcaggtccctgttggccctcatgtctcccctacagcactgtcctcaagagtaccttccctctcaagacagaagagcaaatccaggagctgatggaggcagggggctggcatcccagcagcagcaatgcagacttgctcaactaccgctcactgtttatggaggtgggtgtgtggggtccggggactggcctggcccctgccctagccttggctggaccctacccaatgtgccctccccctgacttgtggcccctcccaggatgaggagggccagagtgagccctttgtgcaaaaactctgggaacaatacatggatgagaaggacgagtacttacagcagctaaagcaggagcttggcatagaactgtgagtgaccctcatccataggcgagtcccacaggctgggcccctgaagcccctgggtctccctgtgcaccatgcaccatccactgctcagcccagcacagaggagggcacctgggagtctggggcacggagaggaggggtcagggcctgtcactctctttcctgtggggcagccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctg

SEQ ID NO: 38761 - DNA, 26942 bp, Homo sapiens; identical to SEQ ID NO: 36970

SEQ ID NO: 38762 - DNA, 14507 bp, Homo sapiens
cgccgtcgcccgtgcccctcccagaccgcaccggccgcatggagcccccggagggcgccggcaccggaggtgagttcagccccagcccccgagacccccgcgcagcgcttccccgcagcgagccgcagcccctccccccagggctcacccttcgccgctcccgggagtcgcgaagacccctttggcagctcggggtcgtccggcgggccaggggcacctcccgggcgcggtccccgcgcggggctgggggcacacggaccgagtctccgcccccttgttctctgcgctcccggcccgggaagccgtgcccggcacgctccttggtgggtggcccggagtttcgtcctgagccccctcccagccaagccagccggtgacccggggagcgggggaggggggttccggggctggagtttggggtccctgtcggtggggcgtgagggcgacgctggccgcttgcaagcgcgtccgctttgttcgcccagccgcgagtcccggggggcgagggccgtagactcgcgggcagggatcctgccaggggcgaggggctgagatgggtcttggggatgtggggcatgcacgggcgcggcctgccggggactccagagctgcaagggtggctggtccgggagtggcccaggcgcacgctcatcggggagggtaggtgcgcgtggagcgctccctgccctgatggtggaggccctactgcaggaccttggagtcggtaacgggaagaaagctctcagaacctccccccttcccgatcagagacttttccaaaagggctttcggggttccatttgcctaggtaggaacttggatgcaaactgcagactcctccacctgcccagccaagcccaccacctcctggtttcctagagctcccattccagggagccagcaggtgcctgagggcacaggcaggccagcctgccgctctggaactacatgggaacctctcagtcccccagccgcacacagtggcatcctctggagcccgaagggctgtccccgggaggagcaggtccacccaccctgtgtatctgcagtccaaggtatagggacaaatgccccagggctggtgggtttgggttttgatttgtcatttgtgggagggaccagagctctttcttaacactgatagtcccaggctcctgggtattcccagtagcagctttgtggacataggaagcctggaggttgggagtgagggcttgggggtctccgagctgtttccagctgtgaactgtgggcagtcaggcccctgtgagcctcaatttccatttctgtcagtggagacagttctgcttcccctgcagggctgtgggagcccaaggcatttgggagtggaggttaatatgttttccctcctcctttgggaaaaaaggaggacttcccagcagcttaaaaggcagagaaagcaggttcagtttctgagcccatcagtcactggctgggggcttcagacacctgactcaatcagtgcacaggtatttacctacaggtcgcagctctgtgcagtaccctgcctggggtggggagttagtgggaagacagggccctgtcctctgagggctcacgctcttgacaccaactcctgtttccttgtctgcaaagtggccagtgatgcctactttgtggaacctcatgagatcacacattggtgactctgtcattacttatcacttacttttgaaaaccttacaaaagtagagagaacggcgggacaaaggcccatgtgtgacatcccagcccccaggcccacagcctcctctccagactaccaccaacctcccttcattagtggtttgaaccaaatctagacatattatttcactgataaataattcagaaatatctgtaaaatatgattttttttttttttgagacggagtctcgctctgttgcccaggccggagtgcagtggcgcgatctcggctcactgcaacctccacctcccgggttcacgccattctcctgcctcagcctccccagtggctgggactacaggcgcccgccaccacacctggctgattttttgtacttttagtagagacggggtttcactgtgttagccaggatgatctcgatctcctgacctcatgacccacccgcctcggcctcccaaagtgctgggattacaggcgtcagccaccatgcccggcaaaataggatttttataaagcattattaaaacactatttttgcaactaaaggaattaatgatttcttaatatgaaatgtacagaacacggaggtgcacgtgtgcacaggaatgtgacctgtgccctctctgagggccccacctggaagccagggctgtaacccaccccaactcagtctgcccaagggtccacagggacagagggatcctcaggaggctgagagtctagacacggccactccagcatccctgaaatactttgggggtccaaatccagagaggaaggtgctgggggatggggggcaggtggcccctgcctctgcgaccatctctccttccagccatttagttttatgatattcattcattcacttcattagctcatccgtccatacagtggtgtgtgccaagtgcctcctcgatgctctggacggggccctgggcacacaacagggaacaggatttgggccaagtttcccagtcgagaatgtgctggaaaataggtcagcagcagagcacagggcatcagcaatcagccctcagggaagcctggggggccgggctgaggcaccccaactcctggctccctcgctgaggtgctccttcagtgcccactcatcagcgagggcaccagcagcccctgcaggggggttgggtcccccttgataggggctgtgctggggtaaggaccagaacattgctgtgtccccacactctggggtccttcctgggacatcagaaacacctgcttgcctctgccctggccctggagaccttgggggctgccagcacccgcccccatgcctgcctggcattgagcctctggttcccaccctgggaaaagcagcaggtctcgcccgtgaggaattttcttcttcctacaagcttgttgagagggtgtcagacaggcctgggtgattcctagcgcagtccctcactaaccgtgggctagttgattcaccctcatttgtttactgcgcacctactgtgcgctaggtcccaggaatgcagccatgaactagatacaagccgcttagagctgatgcttctcgctctacccagtcccagcctgctctggggctgtgcctgggggtctggcgtgtggccgactcacagtgtatgtgagtctctgtcatttcctcccggctttgcctatcagttccagccaagatcaacctttgtttccattgaggattgtttttaaattgagatattattcacatataaagttcacccttttaaagtgtacaactcactgtttcagtatattcacaaaattgtgcagtcaccaccactatctaattttataatatcttcattacccccccagaaagaaacccatacccgttctccccttctccactgcccaccccccagcctctgacgatcactgatggaatgtctacgcgcttgcctattctggacatttcctaggaacggcgtcacacagcatttgtccttttgggcctggcttccttcactcgaatgaggtgatcaggctcatgcatgtgatatccggtgtcagtaccgccgtccttcttgggttgaatctcactccatggtaggcacagaccacattctgtttatccattgatccactgaggacattggattatttccacttttggctactgtgaatcacgctatgaacatgcatgtgcagctgactcttgaacaacgttaagtgttaggggtgcccacctccctcaaagtcagaaatccacatagaacttttcactccccaaaaacttaactgctaatagcctactgttgaccagaactttactgatatggtcaacgaacacatatctgtatgctgcatgtattacacagtaggctcagtcatttgaggacccacgagcatgccttatagcagctgcacgctcttcatgccaagatccatcgtgcccctcctgggggctcaggtcttgtccctggtatcacattcttctggccaaaaaattcgtgtcctgatggcagaagctgcatcttccaaattttccttccccaaagccccaacacagaccacggcaccagactttacagaataaagaccaggccaaagggagatggggaaggaccagactagacacctggtggcttcaaatgcttacaggactggatctcatcaacgctgacaccatcagctacagatgtgttgctgtctcaagaatgtggaaataagaaaagatgcttttttttttttttttgaaacaagagtctcgttctgtcgcccaggctggagtgcagtggcatgatctctgctcactgcaaactccacctcctaggttcaagcgagtctcctgcctcagcctcctgagtagctgggactacaggcacgtaccaccacaccggctaatttttgtatttttagtagagacggggtttcgccatgttggcccagactggtctcgaactcctggcctcaagtgatccgcccgccttggcctcccaaagtgctgggattacaggcgtgagccaccgcgcccggccgaaaggatacttcttaagagtcaactatgatattcattccacacagggctgctgtgaagcttccacagggctagagctttgtcccagaagctgtctgtagccccttgggaccccaggatctataatgaggactgctggcattcgcatgccccctctccagtgcaagatggggaaggggattgctgtttggctgaggtcctgcttgggacctccatctcagcacaagcagagggtgcctgcagacttacctccctctggactgtgcccttgctggcctcgtcgtaaaaatgcaggtattggcccggcacggtggctcacacctataatcccagcactttgggaggccaaggcgggcggatcatgaggtcaggagttcaagaccagcctggccaacagggagaaaccccatctctactaaagatacaaaaattagccaggcatggtggcgcacgcctgtaatcccagctacttgggaggctgaggcaagaggatcccttgaacccaggaggtggagtttgcagtgagcagagatcgcgccattgccctccagcctggtgacagagcgagactccatctcaaaaaaaaaataataataataataatttaaaaattcaggtagatgctgtcccactccattcaaaacccttcaacggcttctctcagcttactcagtatagaaaccaaagtcctgacgatctccacacgacctgcacacaccacccctgccctgcctcacagcccccagctgtcctcaaatgcactctgctcaggcctttatgcatgtccccccccgccccacccagtatcacacggctccctcccacctccaggctcctcctccaagtttggtagagcaccctccccagatgccccctaaaatgggagcacagccccgcactgctcactggcactggccgtccctcagaagggcaggaatcatctattttgtctatgccatgtccccagaacagagggtgattcggaagtcttggttgggtgaatgaatgaatcagagccttcgtctagatgaggggccccgcccagtgagagggggactacaaggggagacgccacctctgtcccaccttccttcagagatccacgtccccccaggtcaggacccagggaacctaagccagcaagtggggacttcctgctccctctgctgggccctgaaccgggatccctggttcccatctccacgccatgatcaggaacaggctgacaggtgatggctgagagctccagctgcgtccctggccagccctgtgctgcatgctggggacagacgctgagctgctctgtgcctcagcttcctcctctcaagtacaaagctcagagtcttccccatgtagctgggagttagggtgaggtgagaatggagttagtcaataaacacagaatgctgggactgtactagaaaaccataagccactgtctttttttttttttttttttttaaggcaaggtttcgctctgttgctcaagctggatggcacgatcacagctcactgcattcttgacttcctgggtttcaggcggacctcctgcctcagcttcccgagtagctgccacacaggtgtgcaccaccacacctagctgtcattattaacacagaaccacctgccccacctgcctctgagggtgctgtccccagagattctctgcagaactactctggccccaggtttccttgatattagggggctgccagagaggagggggtgggaggccagggtgtatgatcgcttgaacccaggagttcgagaccagcctgggcaacatggcaagaccctgtctctaccaaaaaaattttaattagccaggagtggtggtcccagctactcaggaggctgaagtgggaggatcgcttgagcccaagaggttgaggctgcagtgagctatggttttaccactgcactccagcctgggcaacagtgagaccttgtctcttgagagagagaggccaggtgcggtggctcatgcctgtaatgccagcactttgggaggccgaggcagacggatcacctgaggtcaggagtttgagaccagcctgaccaacatggagaaaccccatctctactaaaaatacagaattagctgggcatggtggctcatgcctgtaatcccagctactcggaaggctgacgcaggagaatcgcttgaacccaggaggcggaggttttgatgagccaagatcacgccattgcactccagcctgggcaacaagaacgaaactccatctcaaaaaaaaaaaagagagaggagaggagggggtgcccctcaggacagaaggaggggcggggagggacagaggtggagctgacagctacaccccagagtgctgctctggggtaagggtgtccatggagttcatgcctggcctgtaaacctggggaggtaagagcccctgtagccttcctcagctggggatcctgagagcagggcctcctggccggtgacgtacatccctgcaccttggttccccactcgtacctgctctcagggctctgggtcagccatgccagagggacagcgcctgctctgtcctggacctggcaggtctgaggcccctgccgcaccctcagggccggctgcagcaccctcctgagactcgaggctaggacagggctacgccctctgcagccacggccactgctctgagctgtgtggaagcattttggaattgtgaccacagcacagtccagcaggacatgaacacactgtgggcgggggcctggggctttggtctacactgtctctccttgaggaagggcccaagggccaggctgggtctcctggagtcccctctcctgggcaccccctcagcgctatggacaatggtcaagcaggcttcttcctgctggtgtccgggaggtccccctgctcacagccttagaacagagtccacatctcaccccctgtcccctgtgccctctgggcggagaggtatccctgctgggcttgggggtgggccaggacaccagtaacttgaccctttaggatgctcagaaacctcattccagatgccagtggaaaggtggaaaccagattccgcgagagccccgtccagcccgcccaacccccaggcctgaaacgggccatgccatgacacagcactcggcttctcagacaggaggcaggtgggccacacagaatgaccacacggccgacggggcgaggggacactgtcaggccacagggctgcccccaggcacagcctaacactcggctcgctgccaggccacctgcccacaaccacactgcccagctcttaagccactggggacctcccagccctgcaccggtgcccctcactcaggaggccgggcacctgcgggcctcagctcccttggctctgctggggaggggtgggggtgcaccgggacggacgctccaggcccacctggcagtatctaggctgccagctagtgccacgggggaggacaggcccacccctcacaggcagctgctggcgctgtgaaccccagctgcagccccctcagcaagagcctcatggcagcagctgctcccctcggcttcaagcacacccagctacgatcagtgctcaccgctgggggctgccaaaaataccccacagggtcctcagggtgctgctggcagcaacgggaaggcacctatccatctgacaagcgtgcgctgggcacccactcaggtgggaggtgctggtgtccccagaaggcccctgccatgcagggtccaggaagcagctgagggaaggagggccatctggaaacaggttcctgcaggggcaatgggtggggggaaggaagccagcgctttgtctcttccctgagagatagacccacagggcctagggccaaaggggggcatgcacccagggacaggcctgactctgactaacaggactcactggctgcctgaggcaagtgaggtggccgctaggacggcgtggccctggatgagagggtgagcagctgaggaggggctgaggggatctgtggagggatggacataagactcgccaatgtccccggctttgggtcagcagccaaggggcctcctgctctcatctgacaaaacaattgttaagtatataaaagaaacagttgggccaggcacggtggctcatgcctataatctcagcactttgggaggccaaggcgggtggatcacgagtaaaaatacaaaaaaaaaaaaaaaaaattagctgggtgtggtggcgggcacctgtagtcccagctactaaggaggctgaggcaggagaatcgcttgaacccgtgaggtggagactgcaatgagccgagatcgcgccactgcactccagcctggtgacagagcgagactctgtctcaaaaaaaaaaaaaaaaaaaggtagttacgtttgtgaaaaaaaatgaggccaggctcggtggctcacaccttgtaatcctagcactttgggaggctgaggcgggcggatcacctgaggtcaggagttcagcctggccaacatggtgaaaccccgtctctactaaaaatacaaaaattagccgggcgtgctggtgcatgcctgtaatcccatctactcagggggatgaggcaggagaatcgctcaaacccaaggggcagaggttgcagtgagccgagattgcaccactgcactccagcctgggtgacagagcgagactccatctaaaaaaaataaataaacatgggagaaacctggaagaatatttgctcaactgtgaggcatggttggtggctaagggatcacagaatggcaggcctgcctattcctcctggtttgtaactttcatttaatgagaatgtattattctgaactcaaatacgacatcagtttttaaaaggaaaagtcagtccacagtggagaggggctgttctggtttgaaggggaccaagaggctggacatggaaatccatgggcgatccttcaggggaccctgggccgagctagaaatcagaggccaggacggcactggaatgcagccacgcgggccctggtgggacttccacgcctgcatggtcggctttcatgggtgcttgcgtaccaaaggtgatctggatctcagattccttgttcactaggggaggccagggcccaaggggaaggagcagcctccttgaagcccctcaaccccttgtctgggtccaggcatgaggccacaagcccagccatcccatcacctgctggtcactgcccagagtttcaaaggactggatgtgccaagtcctcacacccagccccgcgtcctggggggatgtgggagccctgtggatctcaaggtgacactgtgtctttggatgcagagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcgtaagtactgctccctgcccagcgcacgctatggggaccccgtgagctcccccaagagacaaggcagcagggtccacctcctgtccaaacactccctggggggtctaggtccggcgctgtgtgctaggctcttgcagctctggttctctgagcctcagctgcaccatctgtcaagtgaaagccttctagtcatgagtatacgcaacactcatcagatcctgccggtgtgggctttgcaggaagctgtggttcacccacagccttgtgggaggacacagcacactctctcctagacccccggggctctgagcagccttgtgggagggcctgagggctgactgtaccccctctgccctcagagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtgaggccggcatcagggctgggctgggaggtgtgcctggtgggctgaggccccttgggaagtcctgggaggtgtgtgtggtgggctgagggcccttgggacgtcctgggaggtgtgtttggggggtgaggccccttgggacgtcctgggaggtgtgggtggtgggctgaggccccttgggaagtcctgagaggtgtgcgtggtgggctgaggccccttgggaagtcctgggaggtgtgtttggggggtgaggccccttgggacgtcctgggaggtgtgggtggtgggctgaggccccttgggaagtcctgggaggtgtgtttggggggtgaggccccttgggacatcctgggaggtgtgggtggtgggctgaggccccttgggacgtcctgggaggtgtgggtggtgggctgaggccccttgggaagtcctgggaggtgtgcgtggtgggctgaggccccttgggaagtcctgggaggtgtgtttggggggtgaggccccttgggacgtcctgggaggtgtgggtggtgggctgaggccccttgggaagtcctgggaggtgtgtttggggggtgaggccccttgggacatcctgggaggtgtgggtggtgggctgaggccccttgggacgtcctgggaggtgtgcgtggtgggctgaggccccttgggacgtcctgggaggtgtgtgtggtgggctgaggccccttgggacgtcctgggaggtgtgtgtggtgggctgaggccccttgggacgtcctgggaggtgtgtttggggggtgaggccccttgggacgtcctgggaggtgtgtttggggggtgaggccccttgggaagtcctgggaggtgtgtttggggggtgaggccccttgggacgtcctgggaggtgtgggtggtgggctgaggccccttgggaagtcctgggaggtgtgcgtgtgttttagcaagaatccctcagcacttcatttcaccacgctgctatctgcccaacttgaagcaacttccccgtcacagctgcttaaaactttacttttcaagtgagcaacagacggctaaagccactgtcccctcaaaagcagaatttaatgaatgtgaattttcatcataaaatgggccaagaacgaaaggtgggggtggtcaccagcccgggcccctcctcagctcacttaacttcctctgattcccacgggagcgttgccattggcctgaaggcagctccagtgtcctcacactgccgagcagggcccccagcacggccattgtcgtgtctccttcctaagccgtgacgagagcacaggactcatgaggatgcgacagcgcgtcctcagtctctgacagtgaccagtgaaggacactgacgtgacctgtgtgaacttcagtaactgtgagagcatcagggccgagccttctccgcatgggacagtttggcccagcctctgcttcccaaccccccaggccactcaggacctcattaaaaggaccagccccactgtgactcctgccggtggccagctgctcccatggttcctggagttgtcaggaaggggtgtcggcctgtgtgtcccaggctgctgcagccccaggtgtctgggagggaatggggcctcatgagtcagcccccagctcacctccaggacaaggccattgcctgaccctggccagttcccaccagctccatgttggcggcaacccttcccacccagcccgtgagcccaggcatggctgttgtggctggggaggtggagtgaggggctcagactccagcccacccgaatccccagccccacagagcctgcaccggggactcacaaggcccatgatggggcagaggctccaagaggccggggacacacaaggcccatgatggggcagaggctccaagaggccggggacacacaaggcccatgatggggcagaggctccaagaggcctgcagggctcatggagggtggttggctgaggtgggacacctgcggggggaacagtttagggaggccccaccagggtcacttaatgaccaaacaggagaggctcagcctagactatacagtgactccggggagcaccagaaaagaccctgcccaggccccacccagaccacaacatccacctctctggtggggccagtgtgtggtgggggcctcccgttagaggtagatgtgtgcatgcctggtgcagggggctggtgcagagcattggcaggagtggcgcaggaggccggcggcacctggagctccgcagcatccacccaggcctctcagccacaccgagttccccttcccgcatgcccctaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcg

SEQ ID NO: 38763 - DNA, 13536 bp, Homo sapiens
cagggaggggaagacggggagccggacgcacgaccggcgagcacagaagggcacaggagctgctccgcgagataccagcgagctgaggcgcggggctggctgggaagtagtcccggccgggccctggccccgcccctgcagggcggagggacgcatcacgcaggggtggggaagccggatccgtgcgcagggttgctaagggtgaaacttttcattgactttgctcacttcgggccggggcgcgggaaggtgcgggttgttggctgaggcaagccgtggctcgggcgacgcggggccaggagggcaggaccgtctgccggcgacagcccataccgtctgccgttgcgcgacacgaaccaccctccgatccgccatccccgcgtcgtcgccgctagtccgcccgcccgccctcgggccccccgctgccgagcccgacctcctaagagctgaaagaaattattgagagtcatagtccatagccccctgcttcgtcccccaaccctcaacgacgaaaaggacttcggtcccctggcccggcgacgcccgggaaggaaaggagagcgacctccgccccgcgctcaggccaccctggagggagaagccgccccgcggccggtagagcgccccgccgccgcggagacccgagtgagtgagttggggggcgtgcgggcggggggcccgccccgagacccagccggccggactacctcttccaccccgccccactcccgctttgctggactctccacgttgctgccgctccctccccgcctggccagcattttctttccccatccagcttccctccagaccccactttccccagctcctcttctcacgccatctgtgctcctggggtgcccaagagctcctttttctcccagttccaagagtggccctctcctgggtggggtgcatttcctcccttccccgcctcccccggttctttatatcctagctactcgctagatcttccttgttctccaaagaaacataactccccccaccgttaaataaatccgaggaaggaaggggatccaggccttgtttttctgcttcttttcccgtgtgcagggaaggggggtggtaattgttaatagactctatttctggctctgtggagcctgaagggtggagggtggacaccccctttggcgacgggacaggtcagtggagattgtccttgggccactgagccagagttcaccgtttcggctgagctctttatactcttaagtgttttaatggaaaattgggcagaaaaaagtacccttagagcagtgccagtgagtggattctgcttatcttggtaaggtgcctgcgaggtggggccctacccccaaactccttcccctcctgtccggaggatgaactgtgcccttgaccaccagaaatctgggaggggaaggagggtgcagagaggaggcacagccggcaggccctctccctcccccaggagaaaccagaaccccgcacagcaagcttcagcttggggacgggtggaggccagtctctggtgctactccgtatctaaacggtctttttctccttcttacccaccgtaccctgggaatgggtccttcatctctgattttccggcagaaaaacaatcctattgctttcttgggcttctacccccatccctccgtgaagcatagggggaaagaagcttgtgtgggaggaaggattaaggaggtttaacacccagcgggggagcttgccgaggatctggtaagtctggtcgtaaagcagaccttgcaatgggaggagacacacagaattttagtatgagaagatgctcaggtgtcaggtgtacagtttttttcttctctgcctgggaaccttttcctatttccctctcccggatctggttactcagtcttcgattagaaatggggtgaggcttgggccctgctggccttggcctggcgcctccccacagcttgactggaaatttctttggccgagaggacgggagaactgggtttgattcctgcctttcctttcctggctgtttggggtgctggagccgagtccgctaggcattaagtgaaaaagatccgtttccctttgaatccaccgtccatccagcaaccccacacggaccgcccaggccctggaattcagattgggtggggggaagggggtcgtgaccttatctaagccagcccacccccttcacccagaaaaaactcattagaagcagatcctagtttcatcagtaatgggaggcgatgaagggaaaggtgggaaagttaggctctcgtaaagcctagaggatgtggtggggccatacaatacggggagtaggccttttgggtagaatctacatgaaatgtattaggcgatgggaggggggcgccgacccgcctcagcgcgcatgtgcatcggaaacttttcctgggctcttcgaccctcggtcggctccccttaccgggcatgcgtattgcggccagttgggccttcgcaaagtgctcagggaagtgtagtgtgcagggaaagtaggtcactcctgctatcgcctggtccggaggtgtttgaggactacaattcccagagtgcagagcgggccctcaccgcccgcctctccgcctacgtttgggttgagtcgagttttcctagctcctgaggaacatggagtgccctagaaagggtcttcatagccgaaaggggccttgttgtcagacctaaggttgaccggtctgtgtctagggggagatgatgagagactgggcgcggtgttgcagtcagtcagcaccagtcctggaagcctttcaatacacacccgcctgtctgggccgctgcctctgggaccagcgagttggggcggatcccgtgtctcaccaaggagaggagctgcctgcgtttggctctcactccccggacagcggcagggcactcgcatccacccggtctgtgacacctgctggcccctccacacttagttgagtcctgtagtccgtcattgtaggacagtttgcacatttaaggcttagaggtgtctgagtatctttttgggtttggggctcagtggattccatcaccattatccctccttttcctctttgaaacagaattttctttctgaaaaaccttccggccgggtgcggtggctcacgcctgtaatcccagcactttgggaggctgaggcgggcagcggataacctgaggtcgggagttcgagactagcctgaccaacttggagaaaccccgtctctgctaaaaatacaaaattagccgggcgtggtggcgcattcctgtaatcccagttactcgggaggctgaggcaggagaatcgcttgaacctgggaggcggaggttgcggtgagccgagatcgcgccattgcactccagcctgggcaacaaaaccgaaactccatctcaaaaaaaaaaaaaaaaaaatcttctggctaggcagtgactcacgcctgtaatcccaacactttgggaggcggaggcgagcggatcacgaggtcaagatttcgagaccagcctggccaacatggtgaagccccgtctctactaaaaatacaaaaattagccgggcgtggtcccgcgtgcctataatcccagctactcgggaggctgaggcgggagaattggttgaacccaggaggcggaggttgcagtgagccaagatggcgccattgcactccagctctgggctacagagcaagactgtctcgagggggggaaaaaaatcttccttcgcttctgacattagagcaggcagacacatgcgcgcgcgtgtgacacacacacacaccttcctcacatttttatcagaagttctctctggaatctgcactgactgaggcttcttttgagcttcacgccccacttcttcccccgtcgtctttctcctaggcacctgctctttaaaacacaagtcagcacaagggatcagaatccaggtttaactttgctgctggaagtaaacaagtgaggataaaattcttagtgaaattggacagaattttgctctcatatttgccctttttaataggttgacaaaagggagattttgctattgttaaacacctcaccatttttattcttcttgctccctttttcgccgtttgtgcctacactggggttagaaaagatcttagtgtcctctgcagccacttaagcgaatccctttacttgttccctttattgacaggtagttatttctaagctttctaatcttaccatacttccataaatattttatatataagctctagaatttgttcatagctttttaaaaaatgaacaaactcctctgaatggccactcctatctttagctaaagacaagccagcaccagtgctttaatcctctgctccataagcttcttgcagtcaaaattagagcctgagctgatagagcagaaaatctcattctggttgtccatcatttttgtaaggttccaccccacagccatctggtccagcctgttctctaattaaagaggcaaaggtggcattatatgcttccttatttgtgcggcaacatcactgaggtataaattggtgtgcagctttagttgcttatgctgcagaaaatggttagctaggcagggctgatgacagtggttctattgtattttggggtgggaggcttatttcccaatgactttggcctgcatttaaaatgctctcattttgaggccgaactgttcaggagtagttaacttggaaggcaattatgcagccaggtttgaggaggcttagaaaggtgtagaaaccctttgctctcagtggaaataccaagaggtgcattttaagaggccatgcagtaccttgggagaagtatcatatgttgacttcagtctgttttagatttcaaaaatactttggaaacactgtctttaacaacaggttccattctagggaaccagtatcaactttcctcacaacttttttttcttttttttttttttttgaggcagaatttctctcactttgtcattcagactggagtccagtggcatgatctcggcttactgcaaactctgcctcccaggttcaagcgattctcttgcctcagcctacggagtagtgggattataggcacccgcaatcatgctgggctaatttttatggggttttttcttttcttttttttttttttgagaaaaatcactcttgcccaggctggagtgcagtggcgcaatcttggctcactgcaacctccgcctcctgggttcaagcaattctcctgcctcagcctcctgagtagctgaggttacaggcgtgtgccaccacacccggctaattttttatttttagtagagacggggtttcaccatgttggtcaggctggtctcggactcctgaccttgtgatccacccgcctcagcctcgcaaagtgctgggattacaggcatgagccacaatgcccggctaatttttgtgtttttagtagagatggggtttcgccacgttggccaggctggtcttgaattcctggcctcaagtgatccacctgccttggcctcccgaagtgctgggattacaggtgtgagccaccacacctggctcttcacaactttttagtctgctccttgttggacacctctatggactatgtggcccttcagacctctgttcctgagagaaggctcatggttctggtgggtagttttgtatctgctgatgagcctgatcctcataaacagaaagccctttattctttctactattcttacttttttttttttttgaggtagagtcttgctctgtcacccaggctagagtgcaatggcacgatctcagctcattgcaacctccgcctcctgggttcaagcgattctcctgcctcagcctcccgagtagctgggactacagctgcgtgccaccacgcctggataatttttgtatttttatagagatggggtttcaccgtgttagccaggatggtctcaatctcctgaccttgtgatccactcgccacggcctcccaaagtgctgggattacaggcgtgagtcaccgtgcccggcctctactatccttactttttatacccaaaaaagccctgaaattggtctgtattgatcattaatagacatttgaggctgaggcacgtggatcacttgagcgtaggagttcaagaacagcctgggtgacatggcaaaaccccatctctacataaaaatacaaaaaaaaatgaggctggacatggtggctcaggcctgtaaacctaccactttgggaggttgaagcaggtggatcacttgaggccaggagttcaagagcagcctggccaacgtgatgaaaccccgtgtgtactaaaaatacaaaaattagccaggtgtggtggtgcatgcctgtaattccagctactcagtaggctgaggtgggagaattgtttgaacgtaggaggcagaggttgcagtgagtcgagatcacgccactgcattccagcctgggtgacagagacttcatgtcaaaaaaaaaaaaaaaaagccaggtgtggtggtacatgcctgtagtcccagctacttggaggctgaagtgggaggatcacctgagcccagggaggtggaggctgcagtgagctgtgatcctgcaccctagcttgggtgacagagtgagaccctgtctcaaaaaaagaaaaagaggccaggcgcggtggctcatgcctgtaatcccagcactttgggaggctgaggtgggtggatcacgaagtcagcagttcgagaccatcctggccaacatggggaaaccccgtctctactgaaaaaaaaaaaaattagccaggagtggtggtgcacgcctgtaatcccagctacttgggagactgaggcaggagaatcgcttgaaccggggaggcagaggttgcagtgagccgagaccgtgccattgcactccagcctgggcgacagagcaagactccgtctcaaaaaaaaaaaaaaaaagaaagaaaaagaaaaaaatagacatttgaagaaacttagagatgaagtctgtgttggaggctgggaaaagagggaaaccagggtattctgagtcctgagtgttcttgtggagggtttgggagaggcatagttgtggtacctctgctgactcccatgtgaccttctctgttcctcagaactgaaatgagggttaactagattcagccactgtcatgctgctccagattgacccagtgagtcttctctgatacattcaccccagaaatctttttctgaggatttagtcccaaaaatgccccttaaggccgtgtgtgttggctcatgcctgtaatcccagcactttgggagaccaaggcaggcggaacactttaggttaggagtttgagaccagcctggccaacatggtgaaaccccatctccactaaaaatacaaaaactagccaggcgtggtgacgggcacctatagtcccagccattcaggaggccaaggcacgagaatcacttgaacctgggaggtggaggttgcagtgagccaagatcacgccactgcagtccagcctgggcgatagaacgagactcagtctccacatacatacatacatacatacatacatacatacatacatacatacatacgtaaaattaaattaaattaaatgccccttaagagccatgggcccaggcctgagaattacagggaaatgtgttggggcaggtgtttagaaaactcaaaatccccaagcctgaaattagcacctggatacttcaagctggatccagaaaggatttgaatcaaaatccagccccaagtctttcataggacagaagatgcccttgacagttcatggagcagtcatgtctctttgcttagctcagcagcacagccttgcccagaggtctggctaggaacatgttctggctctgcctcctctcagagatggctctttcagttcagtttctcccccagcatgagccccggagctgcccttttggagaaaatgagattaggatcactggctctcaggacctcacagatcatcttcctgagacatgaggctggcccaggccaagggaataaacctttttgacctcagtgggatctggctgtgagagaatcccaaaataacaatctggtgtttatcttgggctgccttctctccggggatctcaaaacacttgataaatctgatctgctgccgaggacaggtggtcagacagtccctgggagactgagtgatgatgggtccctaccggaggctgcagggtgatggaaaatttctttcctctgccaccctcatcacttacattctcaccagaaactacagagattccccctccttttctctgcttccctgtggcagccccgagtcagcagttcccttgttggtccacatctctgattgtgacaggtcttgcctttttcctggggctcatgctcttgtcttatgtcttattcctttttttttttttttttttttttttttttttgagacagagtttcgctcttgttgcccaggctggagtacaatggtgcgatctcggctcaccacaacctccgcctcctgggttcaagcgattctcctacctcaacctcccgggtagctgggattacaggcatgcaccaccatgctcggctaattttttgtatttttagtagagacagggtttctccatgttggtcaggctggtctcgaactcccgacctcaggtgatccacccgcctcagcctcccaaagtgctgggattacaggcatgagccactgcacctggccggagttcttaaatcagttctgcaaacctggactgaaccagacagcatacacacccatggggcccatgatgacagatggatgtgactggagtccaggcccccagtgaagaattggcagtgctctttcctgttcagtgacctgtatcccttttcatttaaggaggacaaccaaatattttaaacttacatcttagtctgtgacagtttgggggcacgacttcaccaagatattgcagagacagcaagagacttcttcttcacctgatttagggacttgatttttttagtgtcattcatacagtgacctgaattctcaagatggtggaaaacacagcttccctatttctttagaattactttaaaatagtagcttttttttttttttttttttttttttttgagatggagtctcactctgtcgccaggctggagtacagtggcatgatctcggctcactgcaacctctgcctcctgggttgaagcaattctcctgcctcagcctcccaagtagctgagactacaggcatgcgccactatgcccagctaatttttgtatttttagtagagatggggcttcatcatgttggccaggatggtcttgatttcttgacctcgtgatctacctgcctcagcctcccaaagtgctgggcttacaggcatcagccaccgcgcccggccaatagtagctaactttatcaattaccttttaattgccaggtacactgtgaggcagtttatatccttgaactaccttaacttcatgatggcctcatgttactaatgaggaaactggggcccacagtcagacatgagccactggtggggcagaaataggctcctggttctgtgtgatccaaagttggtgcttttctgtctatccctagctgttggtcaccaccagctttctgcatattttctcacggtgcctctcatttcccagagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcggtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcccagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttcttttcaagattttttcttaaaaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtgtttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataatagccttc

SEQ ID NO: 38764 - DNA, 20035 bp, Homo sapiens
gctgacgcagccatggcggaggcggctttggaagccgtgcggagcgagttacgagaattcccggccgctgcaaggggtgagtggctctcccacaggctgcggcgatttccgaacacgggaggggccctgggatgccgctgacaccgggggctcggaacctcgtgtgtgcgactgccctgaggccccgctcgggttgctcttctgtggcaacctgcttcccttctcccgtgttcgcgcgctcccgcggcttcctgggtgattctgttcacgttgttcccaaggcccggtgccgtcttgaccgtggtcgcggcgaagccctgtgtttcctacagtcttgagcagcttgctgttacccttgttgaaagctcatcgaaggcacacagctggtggtcggattcctcccccacgcgccccacctccgacctcaactcccttgtcgcactttgggaggattgcaggctgaccaaatggtccctggctcttcccctgcttggtttttattccttttctttctttctctcttccctccttccttcttttttctatttttaaatgatttcttaccactgaacagcaacacaggctcatgtgtatgtgatgggtatgtaatatacagtggtacgcaatgtaaatgaagcaaggtttcctcccagccccagtttgcattcttacagaaagattgtttatatccgtgcacacacgactttttaccctttttttgtacaaatagtagcctgctaaacacactcttctgcaccgtgtatcttggagatcatttcacattcctctacctcagtctttttcacgtctgtgtgctagtgctgtattcacttagtcatttaggtcatgtccaatccgttgttttcaataatgctgcaacgaatactttgaggattgatttaacaaatacttattcagcatctctgtgtgccaggctctgttcagtgtgtttgagatacatcactgaacaaaacaaatctgtcttttacagtctatgtcctgttacattctaagtgagaacgtggacaatcaaccacaggtgtactgaatgagtacattgtagagtagaagaagtaggttagaaggtaagtgcaggcaaagccctctttgggagtatgcctgatgtgtttaggaaacagtgaagaagccagtctgcaggagcagcgtcttctgcgcatgtgtgagtatgtttgttggttaaatactttatattttttgagacagggtcttactctgtcacacaggctggagtgcagtggcacgatcatagctcgctgcacctcgacctcccaggttcaagagatcctcctgcttcagcacctgggagtagctgagactacaggcatgcgccaccacgcctggctaatttttttgaattttagtagagacaaggctggtctcagattcctcaaacaatccttccacctcagcattccaaagttttggaacgccatggaacacataagccactgctcccggccttgttaaattcttagcagagttatggggtcaaagcaattgtttggatcccttttgaaattttctcacttggaagccccaggagaggaaagcagccattctctaaaggaaatggtgagcaagtaaaacaaatccctaattgcagaagtccaaagggtgaaaaaatggcagtttccatgtattttcagaatcccaggctgtgtgcagtactcacgcctgtaatcctagcacttcaggagaccaaggtgggaggcatctcttgaggccaggagttcaagaccagcgtgggcaacatagtgagacaccatcgtgtggtggcatgtgcctgtagtcccacctcctgaggcaagaggattgtttgagtccagcagttttgatgacagtggcgggcagttggaagcagatgctgtcatcatgctggctgcagtggggaggcacaagtcgggcagcagaagtggctctgggagcagcagtggtggtagtgagtcccctgttccctgcatccccgaggcagccgactgcaccacccccaccctcacatggctgggcaggacctgctcctcagcccagaccctctgctgcagcctgaacctcgctccctgccacatcccagaagcctgcgagcaccctgccaaaggtgcaactgggacttgtagggacttgcacttgtgagtacaaaaatactcacacatgtgcacaaagaccctgctcctgcaaactggcttcttcactgtttccggaacacaggactactaggctcatttgtttggggtggtcagagctgccatgccatatgcaccttgcccgccgccgctgtggggaaaacgtgaagaggagaggcagctggggccacatgttccacagagctggcgggaactggggacaagtgggagccccaccccttccaagttggtggagtgggagctccctaggcgcaattacagccacccaagccaggactgcaactcaggcacccctgtgctcttgggagctaggagcaggcaggagccccaccctcctagatgcagctgcagcctcccaagctgcagctgtggacccaggcatgtctgcacttttggggacccaggaaggccccttcctgctgccgcaggcttggaagtgcctgatcctgctgtctggcttctccccactgtcagcacctgatcagatcatggagcaaagttgaggccgagcctgggtgctattgcagtgctgacacaccagccccctgcctccttggccccctctggcctttgggtgccaacgagcatgggagggaggccaagaggggctgagggcagctcagtgctggcctgcaggcacccccttggcacaaacagcttgggtgccgtgaatggtggcaagaggcagacaggttcctgggtggaaggtggcgggtcccggtgaagcccgaccttcaagccagggaaggcctgaagcctgggggctgggctgccggttccatggaccggaatgggaacttttggtgctttttccggcccacccatggctgcccatggaccaataggcatgtacctcctcccctgtgagacccataaaaagcccctgactcagccagaccagaagagacgatgggacgaccagctgcggggaggagctaccctctctgctgagagctggagagatgacaggacaacctgcccacagagaggagctactctagccagggaagcaagcaggcatgccagctctttcttttccagtattcctgggcccagtggggtcttctcactcagttacaatatttgatctaagaacattcactttccaactgatcagaaagtaaaggtgactggcatggtgtggctgtgagagatgcagtgtgacctcagaggtgaacatcagtgccgggaccatttggagcaggatgtggtaaccaccaaatggaaaccacggccttttggctcgacctagagcatgaatgtagcaaagcgaagccctgtacactttataaaaaccagcagaaagacactccagtctgagtgagcagctggaacaaagctctgctgagctgaacactcaacaggactacctgcctgcagagagaggagctatcctctttgctgagagctgaacactcgttgggacaccctggctgcggagaggagctgcccactgtgggtctcctctgagctatcctatggctcagtaaagctcctctttgtcttgtttaccctctgcttgtctgtgtgtacctcattcttcctggatgcaggacaagaattgggacctgctgagtggcggggctaaaagagctgtaacatgaagaggactgaaccatgcgtcttgctcgccacattgtgggtgtccagaaggaaagaagaactgcggccctttggggagtccagacccaggagcttcccaagctggggttctgacaccctctttagggctctgcggttcctggtatctgcaagcttccaggcaccaccatgcttcccagtgtcagctgtggaagctgcttatggtacacctggtctagctgcagccttgcaggaaaccagcacctgtgttggcacctgaagctgcctgccccaccgcagcccacatgcctagctgtgcgcagtggccaaaccccacactcattcgctcacacacccctcgctgccccactcgcccttggcaggtgtgggatccaggccggtagcatgagctgagcacagcctgcagggccgagtgggcccaatgggcccgagcaaaacaggcaaaggcatcactggccacagaggtttccagctggtaaagcaacaccccaaagatcccgtgacagtttatggctgcggtgagctattattgcgtcactgcacttcagcctgggcaacagagcaagactctgtctcttaatctcagcgagtacaacaggaagatgtactgagccccagaccaccccatctctcaaggtgactgcttggatgggctggcgtgactgggaaggcctttgccactttgctgtctcctggattccatatctactggatgggtgccatcttgcctctagccagggaagcaagcaggcacaccaactctttcctttccagtattcctgggcccagtggggtcttctcactcagttacaatatttgatctaagaacattcactttccaactgatcagaaagtaaaggtgactggcatggtgttgctgtgagaggtgcagcgtaacctcagaggtgaacatcagtgctgggaccatttggagcagcatgtggtaaccaccaaatgggaaccacggccttctggctcgacctagagcatgaatgtagcaaagcgaagccctgtacactttataaaaaccagtagaaagacactccagtctgagtgagcagctggaacaaaggtaccacctgaatagagggtgtgtggcaagggcaggcacgagacaggaaatcagactggaagagtaggttgggcctggtcatgcgtgccaaggcaggcagcattctctaaggagcagtggtaagccatcaaggcatttgttactaggggtgtgacaatatgagattgtattttcagaagatgactggggctatgatgatgaatgctttgggtgggagtggaattaagccagagaaaccagctagttcactactgcaaccatccagccaggatactggagacttttattcaacattaggcaaatacttgctgagcacatgctatgtgctaggtactgttctaggtcccaggggtgcatcagtgaacagacaactgtctctgcccttgtggagttcacattctagcaagggtgaaagaatgataaacagtttatgtaggtgaaatacatatatatatatatatatatattttttttttttttttttttttttgagataaagtcttgctctgtcacccaggctggagtgcagtggcacgatgatagctcattgcagcctctacctcttggactcaagtgatcctctggcttcagcctctagcgtagctaggagtataggtgcatgccaccatgtccagttaatttttaatttttttgtagagatggggtctccctacgttgccaaggctggtcttgacctcccggcctcagcaatcctcctgcctctgcctcccaaagtgctgggattacagacatgagccaccacgtctagccctaaaatatatagcatgtcagatggtgatgaatgctaacgagaaaaaatacggaaagggatataaagatttgcagcagggggacagattataaatttagaaagtatagtcagagaaggaagtcttatcaatgtgatatttgagtgaggacccaaaggaggtagctggaatgtggatgccagtggaggagaggagacggtgggtttgagagacataggagacagaatcaacaggactcagagccaatcagtaggatgacgggagtgaaggagaaagctgagtcaaaaagattttgattagaggtgacacagggccactgtagacccctgcgcaggcggcacaccacgcagcctgccgaagtgtacgtggtggccctgggtgtctggagatggtgatgctgttcagcaggacccaaaccatagccgagcccttccttttcctccattggtgtcatctggtagtttgtcttcccgggtaagaaggttgtaaatttcttaagatgatgattgtgtcatccctgatagccccagattagccaagccaagtgctgagcacattcctggtgctcagtaaatgtcactgttaaagggggcttcccagagccacacaacacccagaatagcccgtggccatggggcctcagccttactcattctggagctcccaatgccacttccatggtggcctttcctggtagatgctaggaggctggcctctccagggtgggaaggcatagggtccactgtgcagacacagccccacaggggatttggcttatgggctgggtagcagcctctggccctgtggacggtcagggcccatgctggtgtgtgtgcgtgatgctttctgctttcatttttccgtcctcatctttctattactggttgtccagggtcctttggtcaccaacgagcatttcccagtgacacagcgcggcctttccagggagggcatctcttgggcagggactgggtgctgcagacatcagcccttccatcccctgtcttcttctttctctcagagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcaggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggtgagtggaggtggggtggtcgtggccctggacagggaagatatgggaaggaggggggtcagcctgtttgcccttaggtgatgacctggcctatgggcttggtcctgtcagcatctggtgcagctcactaaatacattcccaggccttgacttaatcatagatgaattgccaaagattgttgtccttccttctgccccagggagggaggaccccttccccaagatttcccaacctctgcctcttctccctgacccctttcttgggattcttctgtgctcacccaggttttggctctggcatcactggatggcagctttccccagcctggccttcctaacttgctctctgccttctgccctgcaggaaagatgcccgatgctgtgaacttctggctgggggaggcggctgcagtgacttcttgtaggtgtaaggggaatacaaaggtggggaaggagcaggttggggcagagggagggaagacgaggccaggagtggagggatggccctgggtggaggttgggctgttctctaagatttcttttggcttctaggactcgggcaccacagagggtttcccctgacagctgaggtcggggaatggacccatggcattgggggcgggtgcattgtttcttctagacccaaagaaacctccctgaaggcccgctgggccagggggtaagtgtaggagaacttcccctcttgttgaagaggagtccagggcctggtgagcatcaggtccctggtaggcagagttccagaatgcccatcagagcccctggcatctccagcccactggctctgtgcgtgcttctcttttgtcataggacgtcttggggtgcagggctctcagcatgatggtttgcctcctcccgtgcccctgccctccataccctgcccccgggccttctttctgttggcagtgcacaaggaccactatgagaacctctactgcgtggtctcaggagagaagcatttcctgttccatccgcccagcgaccggcccttcatcccctatggtaggggatgtggcctgcagggaggggctggggaacagctggcccaagggggagggaggcagcaagagcctgggaggccagttcccaggcctgaggtgtggctgtggcatccccagtgcaccagggcccctgatccccttgcccctgcccagggctggctggggtggaggagggtctggcaagttccaggctgtttgcaattcccccacacccttctcccttgggctccagagctgtacacgccggcaacctaccagctaactgaagagggcacctttaaggtggtggatgaagaggccatggagaaggtgtctgtcctgttcttgggctctagggagggagaagggcagaagcctggctctgaagaacaggcacaaaagatctggggaggtggcaccttgctctgaaaagtctctaagtctgaggcctttcactgctgagccaagcagggcctgtggtgttgacctttggaagggacagagcctgaagtcctggggggtctggggggctgctccctggcatctgatgtgttcccaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcaggtgaagagttgcccaggccgcctggggagaggccctgtcaaggtccagcagggcctctggggggaggcttgggaggctctaggtcagaagagggatcttcatgctcagatccccgttcttcccacagtgaatttctggtatgacatggaatacgacctcaagtatagttacttccagctgctcgactccctcaccaaggcttcaggccttgactgatggagcactggtgaacaccaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgtatgtccttttttttttttttttaagatggggtctcgctctgtcacccaggctggagtgcagtggtgtgatgtcagctcactgcaagctccgcctcccaggttcacactattctgcctcagcctcccaagtagctgggactacaggtgcgtgccaccatgcccggctaatttttttgtatttttagtagagacggggtttcaccgtgttagccagtatggtcttgatctcctgacctcgtgatccacctgcctcggcctcccaaaagtgctgggattacaggtgtgagctgctgcgcctggcttatgagtcgtatgttctgatcctccctcttgaagttgccttctgtggtctaaggagggcctgaaggttcaggtaaaaacttcagggtgaccttcactgggggtgagggctggatcccagcctgggcccaaagagccgtcagctgcccaagtcccgctgtccatgagagtcaccgcagcccctccctgggacaagcaagcagacctgagtcttgtagctctctggtccggacctctttgcccaggaccttgagagctattcctagctctcctatggttactgtcctcccccagttcaggggcagcaggtgggacctggtgccctggggataacccctgtttctcccataacaggcacaggcaggaagggacggaagcccccgcctctcctggggctgtccctctgaggaaagagttggtctccacacgctgacccccccacaaaccatgccctggaggcagaagaaccccctgcccctgagtgccaacccacaggcctcatccctggccactcagcacctagctttgaagggctgttttatgtgacagccactcccctgcctgtcgtgagggggcccgggtgttcatctcagattgatggatccctgccatcaagactgggcattcctgtccaacaggtgccagagttgcgaaaggcctgtgacagggaactccactcttcccttggctgctgttctgggactcacccctgctttccttctgctcagcccctggcagcaagctctccaggctgggattgcagggctgggtggggcaggcccagctggtaaaggctggcgagtgccacagaggtatcaggagctctagtataggcttagggtgcctcatttcctggacaggtggctggttcaggagtgggtgtggagcttaggtggagcagaggcggcgggtaggagggacttgggaccaattgggacatcacatccctggctctgggttagaaagctgacagtccttgatcctgtggccactgccccatcattcctgctcctgaggactcagtctcatggctgtggtaaggcctggcagggccctgggtccctactgggacccctggtctctacctggggcctagttaatatgtttcttatgggagctgtggtcttctccaggggtagggaggggagtttattgaccacaagaccagggtagcgggcagaagccaggggaggaggaggcttggggatgagggatccgtcctgagtgttttctgtcctgggaacgggctcctggcagagctccctggcaccacagatttgggccctggagactcagaggctcccagctgccgccctgaggccctggaagcaagtggctcctccatgctcctctgactcagttgcctggagtgtgagggccctgggctgaccctggtggatgaggccctccagcactgccctggacctggttgctccctggacttgacctgttagggtccttgtggaggcaggtggaaggccgaaaggaagcagttggcacaggcttccctggtcccggtgcgcctgccaggctgcattcccagaaccaggggcatgggtttggagggagctaccgggggaccatcttcagcctgacctggcaggacctggaggacatgacagcctgtgaggggtctgagctaggagccgcctcccctgcccaggagagagcccatttccaggatgctcttctgaccagggtggagggagggtacgagagcagctcagcctggggcccaaggccctgatgtgctacttcccctccctcgatagcttatgtcccctgccacccaagaccagccggaaagctgcttagctggggtgtgggctggggatgtggggtggagagcctaaaggatactagcccgagaaggtggaagcaggtctgtgtgaggcataaatctggagccagcctgcccgggctccaaccccaattgtggacctcaggcaagtgactgcttctctgtgcctcagtttccttgtggagtgggccatcgtaaatagtatctgtgcataaggtggttgtgcgataaatgagttaatgtatgcaaagcccttggcccagagccggcgcagagcattgtgtaagtgctggcaggcgtcatgatggagatatcatgtctcctcttgttgattcaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctaggtgagtgcgcaccgccctggcccctgtgctgggctgagggaggaggagggtgctgaggaggagggtgctgtggctggatttggtggaggcgggtgggccggtgggcagggcctagaggagggagctgagaggagcttctgggtggaaggtggcagctggggctctgcctctggcccccacttcccctccccctcagtcttaacccacatggggctctaggtgatggaaggaagtgggtctgggcggctgggaagggctcttgtccaccgctgggcacttgttccttcccgcagtgaccccctctgactgctacgtgactctctggctgcccacggcctgcagccacaggctccagacacgcacggtcaagaacagcagtagccctgtctggaaccagagctttcacttcaggatccacaggcagctcaaggtgggccaggcatcagcgctgactctacccacatcctcgccagccactgccgctgccctgctcacctttctgtcccctccctcctgcagccctgtcactcttttcccctccagaatgtcatggaactgaaagtctttgaccaggacctggtgaccggagatgaccctgtgttgtcagtactgtttgatgcggggactctgcgggctggggagttccggcgcgagagcttctcactgagccctcaggcaaggcggtgtttccacggcagccctagctggtgtctgggttgaaatctccacgcgcacacatgcacacacacgcatgtctctcatactcactgacatatgtgcactccttctgaccctttctaacttacttctggctctcttcccagggtgaggggcgcctggaagttgaatttcgcctgcagagtctgtgagtcaggggcctggggcagtttgggtgggagtgccttgtgggaaggacagcactagtgcctgggggatgcccaggtctctgtggggtgggaacctggactcctgctaagggggctctgggggctctttccagggctgaccgtggcgagtggctcgtcagcaatggcgttctggtggtgagtgtgccagtgctctgggaggcggtctggggtccccgggactccctcatgccagcgacttgaggtacaggcccaccgctgcctcagcctggggaccctgggatttcagtttgttaagggaatacaatctcaagggcccaggtaatgaagtgcagaccagcagcagccagggtgctgcgagggtggggtccctgaatggggggtggggttagtgtctgaggggctgtcttcatgactcaggcccgggagctctcctgcttgcacgttcaactggaggagacaggagaccagaagtgtgagtccccaacccactgggacagcccctggctctcagctcttgtcttccccctttaagcattggacaattctccttggggcctgagctttccccttaggccttctcgggggactgtggtgggggatccatctccaccagaccatttcagcggggagagggaggtgccctccaggccacgcagcaagatgggttctgtgggcagagataccgtccccagcctctctgctctggttcctgtttccagcctcagagcacagagttcagcttgtggttcctgggtcctgtgagggtccgcaggaggcctctgtgggcactggcaccttccgcttccactgcccagcctgctgggagcaggagctgagtattcgcctgcaggtagtgtgcctcgctccctcgaggtggggcccccagaacttcctccctccctctgcacctcctcccagtctgacctctgctccacctggcagagtgggcaccctggcagcatgtgtgggcccatgctggcctccccttcccgtccctcccataactctatggctgccggcgggagtttggtgaggtctttgctaggagtggaagcgtaaagattcttaggtctgcattctttgtcccctgcaggatgcccccgaggagcaactaaaggcgccactgagtgccctgccctctggtcaagtggtgaggcttgtcttccccacgtcccaggtactggcctcccagggaaggaagcaaggcgcctggatggggctgggacccaggccacaaagggaggggcctgcttcccgcttctccgtgggtcacaccctgagcaggtgctggggccaggctctttggggagtgtcctctgagcatccctgcttcaggcctggcgcctgtggagacggtggcggggcgggggtggtgcgccggggatcagggtaagaggaccagagctgggtggaggtggccgaccttttgtgactggggccttcacggttttcaggagcccctgatgagagtggagctgaaaaaagaagcagggtgagaggcctggctggggactgggcaaggccctggaaaacaaccagggtgcggggctggaggaggcctggaggagtgagggggagaaacagccgcccctcatcctcatgctctctgaaggggctcaggcttgcgctcgagggggcacgaagtactgggaggagtactgggaggagtcttagcacctatggtcagaggggcgagtgaccggcccagtgccaggcacccggggagcacttgataaatgtttggctggaaaacgcagggaggcaaggatggaaaatggtaacatggtttggggcgcagagagggcaggaaaaccaagggagagaagaggggaaattgcgcccttttgggtggaagctgttatggctggaccttaaatgatcttcgtagagttgtcgcccaccctggccctctgtcttgagagagtggcttctcacctcacagacacaggattattggtccttttctgccccgccccctgccctttttttttttttttttgagatggagtctctctctgtcgcccaggctggagtgcaatggcgtgatcttggctcactgcaacctccgcctctggggttcaagcgattctcctgcctcagcctcccgagtagctgggattacaggtgcccaccaccacacccaactaatttttgtatttttagtggagatggggtttccccacattggccaggctggtcctggcctcaagttatatgcctgcctcagcctcccaaagtgctttgaactccgtgggtaagggacagaacacgagacttggaggggggggatctatggtatggggcctgcctgggggcctgtctgcacctgggaccccaagcagcctctttcggccacggcattctgggtcctgccagtctgctttgctgcattcccaagcatgtccacatggacacactctccccaggtgtcaaacttcagtcttgtgacacgggagtggcattgagggttggggagaagagggagggcagtaggtattacaggtgaggcagacccagctttccattctctggggagggttgagagctgtctcacagtctcttccttccccggccagactgagggagctggccgtgcgactgggcttcgggccctgtgcagaggagcaggccttcctgagcaggaggaagcaggtggtggccgcggccttgaggcaggccctgcagctggacggagacctgcaggaggatgaggtttgggggctgggctggatggggtgtccccgggcttgcttgggcctagctcctggtgctgaacactggagctgcttgtccccgatctagaccagagctcgtagctgcctgtccccaccctgcttcctctcacctggtgttagcagggacttggtacaggcagagtgttgcttgaggcacctggagcccacatgggagctacctcatagggctggctttcctactctgtttcttggttctcagcctagcctgtctgaggagggagacagatatctggtatgaggcctgttggcccagggtgcttcaggaggttcatattagcctgggccgtctcctgggggagtgatggcaatttgggaaaattctgaggcgggccctggggcttccagaaagtgagcgtcaggctcgggggctgagggcaaggagatgaggctcagaacttgcctgggccattttttcctggagcccttaggactggaggagctgggcactcaaaaggctgtttctggcccccagggctgactgagaactggtcccaagacctgtgatcaggccttagctgtgggctgggtggccacttgacctgctacctcttcttcctgtgacttggccttccccatccctagggcctctacaggcctggctctcttcttttccagatcccagtggtagctattatggccactggtggtgggatccgggcaatgacttccctgtatgggcagctggctggcctgaaggagctgggcctcttggattgcgtctcctacatcaccggggcctcgggctccacctggtgagctgggggcaggctgatgctggaccctgtgtggcagggggtgctggtgccagggttctcctaggcctctgagaaaactagaagggctgggagaatgaatgtgccagggagaaacgtgctcaaggggaccctgggaaggtccctgccaggccattgtcctagaaagcccggggcacgtggggtctagacggggtccttcagtgacagccctctggctttggctttggcttttcccagggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgaggtgcgggggctgcggcctgggggcagagccagggcaagggctggagctggggctcggtgctggacagcagggtgggaaaggccctgggcacccaggccgctgtgggtttaggttctacgcatctttccccagccccatgatcacaagctctcagatcaacgggaggccctgagtcatggccagaaccctctgcccatctactgtgccctcaacaccaaagggcagagcctgaccacttttgaatttgggggtgagtggcccaagagctgagacctgtgcccttgcagttggtggaataaggggagaacgaggactgtgtgcagattgcagatgtcacacccacctctcctgagccaggtcccgtgctttctggagaccggcaccctaccagggtccctcagccctttgggaaggaggcaggggccttaggtcctatgcacgaagcccaggccacaaggcctgggcctcctggtcctcagctgccctaaagcaaaaccctgggtcggggtgggggtgtgggtgcctaagggctctgcaccatgaggctgaggcgtggactcctcacagagtggtgcgagttctctccctacgaggtcggcttccccaagtacggggccttcatcccctctgagctctttggctccgagttctttatggggcagctgatgaagaggcttcctgagtcccgcatctgcttcttagaaggtgaggggcactggcaggctggggaagctgggccgagcagggaaaatgggtcctgggtgagagggcagcctcggtcagaagagtttcctgggccaggactggccatggggaagggtaggattgggacaagagtcgggggccctcttccctcacggccgctctttcaggtatctggagcaacctgtatgcagccaacctccaggacagcttatactgggcctcagagcccagccagttctgggaccgctgggtcaggaaccaggccaacctgggtaagtgctccgggcccttcataagggtgccaaggggcagccagctggggctgcaccagggggcggggggttcacacctcttccccctccagggtcaccaccaaggtggggataaaggtgcaggagtccccatttcccccaccttgcctgtgtagacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaaggtacctgcttctctccaaagtcctcctgtggccacctgagccttgagtccccagtccagatacccctcacagtccactcccattctcctgctttgagcttgattccctggactacttggaacaggggtctttttctccttgtcttggggacccagggcccacctgcagggctgtgggggtgttggttcagcaggagagcagggaccagaggccagagtctctccttccagcaggaatctggtacccttggtatctgtgacaattgctgctctccccaaccttccagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccaggttgggaagggtgggcagcccaccagggaggcggtgggtggcccctgtcccctgaagagaggggctttggagtccagtgtctggttcagcttcctttaggagctgtgattgggacactggaatcttaatttgccaccagaggagctcattcttttccggaagttgggaggctggcgaggttctcctggtatcttgtagctgggtcccctttactgacctgcgaggtgtggtcctgggcctctgggcccacctgctgagtctgctttggctcccagtgtcagaactggaatgctgggagtaacccggctccgtctagccccagaggagctgccaccgaggcctgtcaggtgtggagagtttttttccaacgactggcttcataggccccactggagaccgttttggcatttgagccccaggtcctgtgcatcttacgtcagccccagtgttgaggatgccaggggccctgtccctctgaagccccttctgcctgccctgcagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggtgagctgctgttcacctccccatcctgctgccccagtcccccacacctcctccgtcccctgtgcctctccaaacctgtcttccccacaacgtgttccccatgccaggctgcactctctccacaggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaatgtg

SEQ ID NO: 38765 - DNA, 103671 bp, Homo sapiens
cgggcccctcgccactaccgccgccgccgccgccgtgagtcccgcggagccgcgcgcgcccccggctgggccgagccgctggccgacgagcggagcctcaggagccggcggggacgccatgcgagccaggtaggcaggcggcggcggggagcgcctcgggcggcagggccctgggggccggcgggggcgcggggtcgtgctcgggggctttgcactcccttgcgggcgcagatcgtgccgcgggcgccgatcgtgccaccgccgcctgagttcggggctgcgcgggtgcctgggcgtggggcggcttcggggaagcctcgcgcgcccctcgccgctcccccgggcgctcgggtctccctggtgctggtgggcagggacccggcccggggttccgggcgccgagccgcagccctccgcgtgcgctcgggccgccccccaaccccggctctggccacttcccggcgggcggccctgcggggtggcctccctgggcaaccggacgcgtcctcgggcgcaaatcggggggcgcgctcggctcacgggggccgtgggggccacgggagggcgtggaggggtcggggcgcccccctcgagcggcgctggggaggagggaaggacgcgcggtctccggttaaacttgttggtgacaatgcatatttcaacttcttcggagatccctcctgtgaggatgaaattgaaaactccggtttctggcttggcgatcgggtgaccgagcagccgcgaggtgacagcgccggcggcccgcgggcggggaccggctgggatagaggcgcgttgttctctgagcgatgtttaccgagaagcccgctccgcggcacgggcgggtgtcagttgggaccccaaccctgggtcccgcggctcctagcccggggcctgcggtgtagacgggggttggggacaggcccagctggccctgaccgggtgtcgggcgcccagagatgccgcgcgggaggagccgcgggagagccgccggactcagcgagcagagggtcgtggagcctgatggatcgatgagatctgaaaaagaacactgtgcgagattgtattcctgcttattctttccaagttagtaggcagattggaactatagaatttatccgtgataataataaagttcgcataacttttgttctgattacagaaacaatgtatgctcaggacagaaagctagagataaagagaaatataaacagcaaacaggaaaccatccccaatcccacattttttaccagccttgtcacagcctggcagatttgaacattaagttagaactggagccattcttgcctaaaccagagaatccctgaatgcagccgccccttctcacccttgtgaccgtctctgagctccaaagtttgggttttttccttgctccctacccgggcagaatctctgctggccacgagtccccttcccagtgggctgggggctttccttgagatccgtggcccagatgaaatgatgggagaggcctggatcctcaccgccctctgtggttttggttccttgccttgtaaaaatgaaggtaatgattctcaatctgcttctcaagccaccataaaaattaatgggtggtttgcagagcgttttgacatccgtggatggacagcggctgtactttaaggcgctggggaacattctactgttcctcattgcagtggtcatgcagtgtaataggctgcctctcacctggccgtcctgcccaggaaacagactccaggaatgtccagtggagccctgaggacaatattcctggttccttgctcagtgccctcgggactcggccaaatccctcagagtgggaagcttgggaagaggcagcgctctccaatccccctcctccacctctgctttctgcttgtaggcggatttcttaaagtaagggggcagtgatatttaggcgggaccccagattgcccactgcctgatgtttgtgggtctgtggaatgcccgggccgtgcttatccaaaagaacagttagttctgggaggacgcataaactgaacaaacctggcttcctagagatttgtatggctcacttgtttactaaatgaacaatgaccggctgcggagaagcccaggacacttctgtgagctttattattatttttttcctgttgtcccaagactacattttagtgatcttataaaacaataaataagaacccatgccatttgttaattctgggtaccaaaggcccaggtggggagaggtacttcacagcatgccttttgtccccaagcacccatgccacccccacaacaacaaagtaatcagggtagaagatcctctttctgtaaccgtctgtcgtttgatagtttcattttttaaattgtcctttccaccagcacgtggatctgatcagggtctgtctagttgcagatcacagctcaagagggggttttggaaagacccagaaagtgggctgaaaaaaatgctgataaagtatccttcaccgggtgccttgtctgttcatgtattgtgctcttacttttctctgtggagggaggaccttcctggcttttctcccttgctcttgtttgctaatccggcagcctggaattatttccctctgggctgcttgaatagactttcttcttattctaatgctggattctagtctgatcataagatatgcgaatggtgaatgtggtttacgcccttgaatcctgggaggtgttcctggttttaaatcctgggatcctggccagttaagagcccctggctcccctgaaattgcgtgggaggtgtgtgtgctttcttttcctggggagcttcttacagagcccttgacccaaacaaggttgagagctccagagtgcggccctggcagacctcgtccctggaccctggctccaggcagacctcccagttccagcctcgtttcaggtaccagccttgttttgaccgagtaggagctgctgtttacaactggccagccatgtggatttcccttagctttattattttcaaattgcacacctaaattgggctgtgttgtgatttttcttctgcaaattggactcaggcccctgggacatttcccaaggccctggaggtgggcatcaggtcttctctgttgcgaggtagccgcctgacaaccaggaatccgaaaaggtcaccgatcactaaatagagttctcagagcactctcagtgcgcgggtcagctttgctcctggccaggagcgagcctcaggccaagcaacgtttacactcagcttctggggagctgggctaggtctctgggctccccagctatttgcacgaaagaagcctcacattctgccaccaccctgtggagcagtgacagaaaaacaattcatctagcccccaaatacccagggaacaatccagctacttgattcagtatcctccaggaagccgaaaccagctcctcggtgggccctgagggcgtccacgtgttacataacccagcacctgatcccaccgtgacctcgctaaagggaaaaagtctcaataatcagtcttcagagggcgagggagtgcagaatatgctttagaaagaggctgtgtgccgtgttttaagaagggtaaaatcccatgtagaacatcacagcctcccatcttccaggtgaacagtgcctcctgaagtcatcaggaagcatatggatttgaggaagtagaattgctgtatggaattcctctaatttaaggtttggggtattttgagggatggaaataggtaccactcgttgagggcttaccatatgctaggctgcatgtgtgcccttttgaatcctcacgaaaactaccaggggtttcattttacagggaagctacgagaatttaagaaactcctccaaccttagactttaatgagtgcttgagttgggatttgaacctggatctgtccaagtccagagctcgtcatcacatctcccggggtgctgaaattaaagaaacaaacggctctcagtcacacattggagcctgaagatacaggcatgcaaatagcggagtgccagcctccctcacacaattagaaaatagcttgtactctgaaggtgatgaaatctttaaaacatgtgacgctttctcagcctaaatggaaggcagccattttgcacctttgttcgtgaaaccctcaccccgtcaccagggcgaagcaaggtttatttggaagattgtgactttgaagttgggataacccaggatttggtacgatgtctttccttgtcccgtgaaaagagggtgtttgggcacatggggtcactagaatgagattaagattataggaaggcggttaagtaaatgtacaataagggttccaccttcctctttacaatcaaataaatgacatactaatgagattattcttatctgcgcaataaaagcttatctcaggggagctctctttgctgaagcctgttagcccaactcttctgtagagattgagaagaatacttcctttgaaaggattttatggttccaagtttttattaaatctgcataactgaggacaaccctgcctcttttttttttttttttgagttgagatttctctgttgcccaggctggagtgcagtggctcaatcatagctcactgcagccttcaactcctgggctcaagcaatccttcttcctcagcctcctgagtagctggaactacaggtgcacaccagcacgcccgggtagtttttttttttaaattcttgtagaaatggggtttcgctatgttgtccaggctggtcttgaactcctggtttcaagtgatcctccagccttggtctcccaaagcactgggcttacaggtgtgaggtatgttgccctgcccttgccccatttttatgagcaggcaggaagcttttctagcccctccaatgtaggaggtccctgagctcatagtgtgccggtaaacctgctctctgaggagaaagcagagcttcgattgcagtatctgccaatttctgtgacgtaaatattcccaccatggctaatttctttttcttttttttgagtctcactctgtcacccaggctggctggagtgcagtggtgcaatctcggctcactgcaacctccacctcccagattcaagctgttctcctacctcagcctcctgagtagctgggacaacaggcatgtgccaccacgcccagaagtttttgtatttttagtagagaccggcttccccatgttggctaggctggtcttgaactcctgacctcaggtgaacggcccagcttggcctcccaaagtgctgggattacagatgcaagccaccatgcccagcctgatttcaaactgccagtttgggctgggaacattactaaatagttaacaatctgtgtgagccaagaagagctgggtcctgctcaccattcattgcactgagcccacccacacgacacccctgcttccccttccgtcacccccatcactttaatggaagaaattgtggcctcacttctgcttggtccatgtctgcctaggagcagtactgaaaaaggatttgggtactactgagtaaccgaatttggccagcaagagtagaaggcttcaaaactcaggctgcattttaaaatcacccgggagcttaaaaaaacaacaatccatgttccaggcccatccccagttgaatcagaatgtctgggtgtgggtccagacctctgtagatttggaaagcttcccgggtgactgtaatgtatatccacgttgaacaccagggatgtggtgatgaatttgttcaagaagaaagctgagggggtgcagtttggggcagggcgtggcagaccctgtgtatttgagcccaaggaggtgagatctcccttgcagagcagggaatgtttttccttaaggcctcgtagagggtgaggaagtgctgggctaggagaggcaggcggagcccatcttccccccaacaggtctgtcctcctccaggggcacgtgtcctacactgatgaggtccacatacttgtttggctttggttgcttctgctggtctagaaaggaaaagagtcttccttccaggaagtcagggggtcaggatgaagccaggcagaccccctgggtgggtgtgatgagctgttctcagatattaaagcagaggggcttactgggaccacccagatgaaggaaagagaaaccctaccgcccaaggaccatagctgaacactttgtaagagtccttgagcttgggtgcgcacataagctgattattttttctccatcataattaccagtaaaattattttaaaatgtgagagctttccttggaggcagtaagcatgtgggagggaaaagtcattcaacttcagagccagccatggtgagcggggctgggactggggagaggcacacgaggcccctggggtgcaggattcaaggaggtgctcgccctgggggggtgtctggggaagggtctgtcctgctggccagaggagggctgtttgagagagggcggtcctgggctcacttccttagagttgggcagtgagtgtggaagagctcatacatgggaacctagagtgaagagcaggggccaggatcacactgctggatcacccccagaaggggcaggaaggctaagggggagccagtggaggagcagctgggatgggagaacaagtgccctgcggggccctgaagtcaaggaggagaaagatgggggtagggggagagggggttgagagctcaaagcagacgggacagttctgagtctatcatgtgcggaggatttatgaacgggaggactggaaccctgtcactgtggtagtggagaaactcctataatagaagaaatagcacagagtggaggccacgcagaagaatgttggtgataaaagaaattggaccgtatttgatggtgtggagacagggcaggagggagccagggttgggtcagagggactgggattctagcaggggcggaaaattctccttggggtacccgtgcggtggggagtggccgcagatgctgagagggaagcattgggtgtgaatagctgatcaccaggagcagctggttaaaagaccttccccaaatgctttctcagatcataacatctgcaactttttcccactagcctttgtggagggctggctggggggcccatttgtccttaagactcaattcagcagactcacttgctcttccaggcccagttcacactgccttctcagacacacccgaggaacctgcacctgggtctgcctgtgtcctagctttcttacctgtctgttgtccccctaggcagggcgctgcttgggggcagttgcattttattatctctgcatcctccatacacaggagcccctcagacaccatgcccagtgcatgaaagagctggcagagagagagagagagcctggacaaggtgaaaacttagggtggtgacttcatacagccatgtagtgacaactccaatattctcttcttgacatcttggcagtaaaacttacaatatatgatagaagtaattcctccctatgaataataaacggcttacttataaatactgtccagtggccatccccgtagttctgtgcaatttaatttttaattcaggtaggtttaccttgcctttgtttacccattttccactgttgccctttgtaagaggatttgacttttttttttttttttttgagacggaatctcactcttgcccacgctggagtgcaatggcacgatctcggctgattgcaacctccgcctcctgggttcaagtgattctcctgcctcagccccccaagtagctgggattacaggcgcatgccaccatgcctggctaatttttgtgttttcagtagaggtggggttttaccatgttggccaggctggtcttgaactcctgacctcagtttatctgcccacctcggcctcccaaagtgctgggattacaggcatgagccaccttgcccggcgaggatttgattttttaaaagctttaagattaagagataaatggagtattattaaaatgcatgtacatttaagcatttttaaatcctgctaacaatcatagttgatgtacaagtgccgtcaaatatttgtatgtgtcctgtgcataaatgggaaataagggtacggtattcagatctaactgaaaataatgattggagctgatgtaatacttacacataattcatgtagaatgctaggcccagggcctatgccccattgcaaagtggtgaatacagatatggttgtggttcttcctgctgtggtctggtctcacgtttccttacccctgtcccaaatatcccctctagcaagttgggtttttgtttttatcttgtggtttgaggaatcgatatttcaaatgtttgtaagaggaatgctctgttccggttcagtacagagcagcagccattggttctctcctttacagtgtgggactaggacatcaacacaattttgaattttggtctcatttcaggcctgtgtgagggggtgctgactctgggtgacatcaggagatcaggcactggctagtcatcacaaacagaatcccaagagttcacttagtgcccatttttgcttatatgtgtatcttattggagccacctgtgattttcagaactgctgaattgggggaaagcagacgcaactgtttggggccacgtgcgcacacacttgaaatgctcagttgcactgtgtaatgtaggatttttccgtggttttggattcttcccatttttgttggccttttccctgtgttacgcactgagacacttctgtacacagctgtttcttcgaaatcaatcaaatttgaaacagcctgatttgcaaaactgaaagttgttgtatggaggaagatccttggtaagaattacatggctcacgtatcatgttcttcttacattgttttttgtttcccagccattgtcagggaacaatagctggaatgacgttttcacagactgcaatatgagaagttcctttttccagtggcagctccatggctctttgttgggacctggttcattgcggggacatcacagtgggaaagagcagggggtgtctgagccccacacacctgtctgtgtccgaatatttggcttctcttcctgttatgacctcggtcacatttttggacatctttgaggctcagccttctgatctctaaaatgatgaccatcgtacttcgctcctggagttgggcagtttaaatgagatcacactcaatgccactgtactgctagctgtggatttggctccatcattgtccctgtggtttttgtttgtttgttgtttgtttttgagatggagttttgctctgtcgcccaggctggagtgcagtggtgcgatcttggctcactgaaatctccacccactgagttgaagtgattctcctgcttcagcctcccaagtagctgggattacaagtgtgcgccaccatgcccagctaatttttgtatttttagtagagacggggttttaccatgttggccaggctggtctcgaactcccgacctcaggtgatccacctgcctcagcctccccgggtgctgggattacaggtgtgagccactgcgcccggcctccatgttggttttgagccccatgcttgtcagcgtgcagttcatcatgccttgcttcttttgtcttgtgtacatgtaccatagtttattcttagatactgagttaatagaatttctgtgatgttccagcatctgagttgaacagagtgtaagggtttgatattcttctgatgctcaacttgacctttaaaaagctcgtaggtgtggaccaggggctcgatgcagtcctaagtgtctaaataaggtttagggctcatccatgccaactttgcccagttcctgaagttcctggaggaggtggggtggtgggggtgggggtgggggtgaggagggggatgtgtttgatgaggctacaggtccccagacctggggtggagtgtggctctggcaggtagcatagaaggaccagcagcaagtgccggaggcccctgtgcctttgtttgcaagaggtctttacctgccctgacttcttgggtggggtggggaggtgataacatcttttgttcactgtaagtactttgtagacatatgagttgttttcagaattgttccttgtgattttctttcagcttttggtttttttggagacagtgtctccctctctcacccagactggagtgcggtggcccaatgtcagctcaccacaacctccgcctcccaggttcaagtgattcttgtgcctcagcctccctagtagctgggattagaggtgcatgccaccacgctcgggtaatttttgtatttgtagtagagatgggggtttcactgtgttggccaggctggtcttgaactcctgacctcaagtgatctgcccgccttggcctcccaaagtgctgggattacaggtgtgagctactgtgcctggcctcttcttttccaaaaaaaataataataaaaaaaccttttctgcttatgtattttaaattactgaataaattacatgtttgtacatgtttgttttagaaacactagaaaatgtaaaaagaaaaaaaatcacatcagtggaattctaccacccatgatgaccactctggacactttcatatgcgtctttcagatattttcgcttgaagtatagagcttccaaacaaaaacaggctgagacagtgagtggtcttgcctttgtacctggcacatagcaatttttcaataagtatttattgaatgaatactatgctttttttttttgagactttttaggctggagtgcagtgatgtaatctcagttgactgcaacctccgcctcctaggttcaagcgattctcccgcctcagcctccctagtagctgggattacaggcacttgcctgtaattttaatattttagtagagacacagtttctactaattttaatattttagtagagacacagtttcaccaggctggccaggctgttctcaaactcctgatcccaagcgatccaactgcctcagcctcccaaagtgctgggattacaggcgtgagccaccacgcccggcaatgctatgcttttaaaaatagctttttatctaaaattgttgacatattttcagatcaataaatacagatttgcatcctcatttttcatgtcaggtttgtataggtacaggtacagtaccctgtttgtttaataagtgtttgtgaatagacacttcccagttattttgaaattataaacaacactgcaatgaacatctttgatatatagatttttccatgcatgttaagtttctcatttgaatgaatcttttacttttattgtgcttaaaatctatgaagaacttataattatattaattgttgggtgactgtataattactatacagaaaagcacctcaaaagggagtgacgttgggaagagttccagaatctgttgtataaaacttggtgaactttaagagcggccgtacttgttcccatcctttttgggggaatgctttctgtttctccagatcctgacgtgctttgcgttctgcgcttttggagtgggagggtgggtcaacagagtaatgttgatgccttaaacgcatacttcagttttaggatgcacacatacatgccagcttcagaagcattaacatctgggagtaactgtatgttctagagtccaggaggtgtttccgttgggaggtcttcagggcccactccctcctagaaggggatgagtgatggttttcatgcattcagcttcggagctgttgttgtaagcttctccagggtcatgtcgtcatgggtgtccagagtgattttgtggctgtgtcacttgatcagctgtgacaagatggactgcagttggatctggcatctggtaaaagcacagacttggttttcaggacctctgggttcactaaggggagagtttgtcatggctcctgctgatcgcaagactgtaatttggatcttgactgcggtctggtgtcgcaagccttctttctggcaagagaggaaaactaatttatgggcggaatattttttggcctgtctcctgtagttttgcacaggggcctggctgcctcctcaggtcttggcaccgcagtatttgtgagtcatccacctataggtaacatgaggcagcactttggggcttcgtgaaaccccagctatggggataagggactggccagcattcccagcacgccccaggggctgcttagaagcaggaaactgtccatgagttctggttttttgttctgagtgtggaggacaccttcaggaggctggggaggggccctgacatcaagcctgagagctgaccccttttctaactctctgggacatggtcctggctctttccctcttcttgttcacgctttaatgccttttaattccttgactcactgctgagcccctctgcattccgggtgggggagataaatggggagcccaccagatgcagcgtctgcccacagggagttcactgcccagcaggggagaaggggcattcaagtgcaccaggggaaaggtcagggttcatgaggttgtagttgtactgggggtcaggacaggatccctaaagaagccccactaagtagggggacctgaagaatgagcaggccaggaagtgcatggtgatttaggggggcagtggactggtgggttctgggcagggtggcttggtgagtccaaggaaccaaaagagggccatagtgagacccccttcccaagagcacctgggagggattccggggcaggtggctggatcggacaggtccttctgcacttccctcgctttgaacttgtatctaagggcaccaagaagacgcgattagacgtgtaagcgtgacttgaaaggggccgggtgacctgcctggggttccctggcacagggggtgacccatccatcatcgacgcctggcagggaggctaccctgtgcaccacatcctgttccagacccccatcttcacagccctggcactacgtgtagcagagtcggtctcccagcccagtgctcccgtgacccacatgtggtacttctccctcccggcctgctgtgagattcttataaaattgtctctgattaatcaccctgtacagcttttaaaagttacttttattacccaaaacaacacttcagaaactaagctgacggttgaatcattgaaggagtcacagcattctttcatcccagagagaaaaaaggtaatgaagaagaggagactgtccagtgaaaaccacatgagaggcacccagcatcaatgcacctctctctggtcagctgagtccttgaactcctcggcagttccccctcagggaaggtcagcggacaggctgtgtcctggctttaattgtcagtttctgaaactcaccaggctgggtagtcagacttctgacagccactgtctctgcacccccgtgagctgctgagtttactggccatccagagagacttctgtgttgaacccacattaacctggctaatcccatctcttctgtgaaaacttgaatacaaccttttgcaataggaaaaccggctgtcctcaactggctcagaggaaaaccattagcttttcaaggtgaaaaggaaatagtgaaaagctgggagatgatgtcataaacactgatttttttgtcattagtcaaattgtctagaaattggctgcttgctaaattgggagtgggatcgttattctgggaagatgggggtttttttcatgctcaagaagatgggtaaaatggcagtgatttccacagcgaacctgtgttggagggctgcgactaacaggtgagtaacattcgggacaaaattctgatttactgctcagccgatgattgccaactaggcatgatgggaaaaacttgcgcttgtgtgacttcgaatgtcaggttgtttgtggttgtcctcttgtgctactaggatttgcaaataggcaatgcagtagagctcgcaaatggggtctggaagggaatgtacaaaaataacaattgttgtttgggttgagatttggcctggcgaggttgaggatggtcatctcctgctcactacacctgacccctcccgttgtctttaaggaaacaaagtaaacttcgggagaaagaggagaaagaggctgggcacggtggctcacacctgtaatcccaacactttgggaggccgaggcaggtggatcacttgaggtcaagagttccagaccagcctggccaacatggtgaatccccatctttactaaaaatacaaaattaaccaggcctggcctgtaatcccagctacttgggaggctaaggcaggagaatcgcttgagcccaggaggtcgaagttgcagtgagccgagattgcgccattgcactccagcctgggcaaccagagcgaaactcggtttaaaaaaatgataattaaaaaaagaggaggaagggaggtggtggctaaaatttgtagagcagctacaggcagtcactgtactaggttatttcactttcttaatcctcaggaaaactcagtggagtaaatggttttgtttccattttatgatgaaactaaagccaagaggataattaatgtgtccgtgaacatagcaagtatctgaaataccacgcagtaaatcttgtgtgtggcacttaggtctggatattaaccgaggggaattggagacacaaggcaccggcatgttgattttaattttctgcaaactctatttcacattctgcatttgaggatgcctgtgacttggacatcattttgactctctaatattcctttgaattataagggtcttttgaaactttggaaatagttattttcattggcggcaaatggacctggtgtcaaactaatgtgaacgttgcctgtctggcagaaaatgtaaaaaaagctttgcttaattaaggtaacattattcttgatagtagaaatattaaaaatacataatcctacttcgctaactaatcacatttatgtattccctctttctgattcttgtttggtgttcatgcataacacatatattgtgcttatagtaataatagtaatagaatagggctgcatgccatcctgtgttttcagcgctttacaaccttacaaccataggaggggagggactcttactgtctctgtttaacagatcgggaaactgaggaaccatggggtttagggacttgtgtgagctgggaagtgcagaagccaggagttaagtccaggctgtctcaaccatgatactgttctcccctacacggggggccaggtctcaattccagggtgaacaaggtgcttaaccgggaccagactggggagcaggatggggctgtgttgtgggaggtagggaacctgaggtcgcagatgacgtgtgagggtgggcgggaggttgccaggtgggtaatcaggaggatgagttcagacctacagcaggagcactccttggaggatgaggggaaggccctaacaccaagagggtgtggagctgcggtctcaccactacaccctgacacgtgggctctccatcttccctgcctgcttggagtctcctgcagcagtcctcgaccttccagccctgcagcttctgcagcagccttgcacttccctaagtggtattggagctgcgctcattgcaataaggaattattctcatggctccatatccgcgtcaggttacctccttcccgtgcctccctggctccctgggttcttggttcttggtgctcacctctgcacagacaggtgtcactgaagcccctcacccagtgacccagtgatgctgagtcccgctttgggaggtgtggcacaggggcagccacagtggacccttggtggagaggatcagagccaggatccctgccaccctgagtggcggatgctgcagagacaactctttatacctgagaagcttgccctcaggtatctgtactttgtggggcttctctgattggccattgtgtgttcatctaagagttagtgcaggaccggaagctcccacccagatggtgaaggcacctgctgggtttcctgccacctgtggagaagcccgctccttcccttgctcaggtgagggcgaccacacccaggtccacctggttccaccaaccagtccgtagctgatggaatgaagggagcagctgggctgtagccaggtagttagggatctggtcagctcggtggtagcaatgataatagatggagtgttctaggttttcccctttggaaatctgaactctattcagggaatatttgttagtagcaacatcagtagacttatgaggtggggactgggggcttgtgtttccatgaggggttgcagaaacacggccacctgatgcccagtgagtttgtagaaccggatggaccttggggtgttctccgtgtaccttctaaggagtctttaactcaacagagttgttcttttttttttttttttttcaagttgtttactcttattttctagttaccctctagaattattgcattggggccaggtggtgtctagtacagttttttactttggagaatttattgaaattttctttggctgagaatgccttcagtgtttgtggttattccttggatacttgcaaatcgattgtattttctctgggacacggggtttcagatagatcagttaaatgaagcttgattatatcgtatttcacgtcgcatgccatgtgtcttgtctgttggactgtcaggtctcaagagacgggcttgggtttccctgtgtggctgctgccttgccccttccccgatccacactcacggcttttaccatatgttttagtcgttctttcggcataattggatgtttccgttgctttgcaattttaccagtagagaaatcctgtgtgtgtgtatttcatacttttcctgatacccttttattgcctccctttctaggtcatttcattgtggttttattttatgcaaacagtgtgcaagtgattctttctgccagttttcatatttggtgttgtaactcacacagttgatcactgccctcttctttgaagatgctgtcttctagagctctttcttcctttatgatttggaagcgagaccagccaccctggttccaggcgactttgctgttagctttagaaaggagagcattcaagctagtctcagcccagggctacttcccccagggcgcctcttccccgtagccacaggggagctttcatttgagaggttctaattttgtgttgttgaagttgccagtcttgttaggcagactgacagcttaggctatctcacttattggctttttgcagaattttgtgggtggttttggttttgtacgttcggtgctctgatctgcgggtggctttggggaacggtagagtctgggtctatgctccttcctcatggtcaagtcccctcccctgaagtttggaagttgcatgtcatcacgtgcagccctgggacgtcccagtgtgtgctggctctgagtaggtggctctgtgaccctggcctctgactgggaggccacccttgttcctcctgcccattcattcgttgattctctcagcagacacgcacaggctgccttcagcgccagttgtcgccttccagctattccaaggactgaaaacacagatctgatcgtgcctcttcctggcctgcagacttccaagggcttcgtggttgtacagaataagcctccgcttttccacacagcacacggagcctggcaggctggacttggagggttttatcccgagcctgctcctgccctgcctcctctggtgggcccctaggatgcctgtgggtcctctcagggaagcatgtgtgtaccccagcctttcccttactgcctctgcccagtgggaccttccttctcagctttcaggctgagacgcgtgcttgcgcgcacacacacaccccctctttctctgtctctctcacacactctcgctgtctctcacacacacacttacacacactctgtcacacacacacatttgcatacacacacactccctgtctctcacacacacacactctcacacacactcccacatacacacactcgctgtctcacacacacacactgtcacacactcacaaatacacttactcacacacactcatacacacactcacactgtcactcacacacactcacaaatacactcactcacacacactctcacactcttacacacacactctcacactcactcacactccccctttgtttctagagcgcttctgctttagttgtagccgtattggtcagaactcaaaacatttgggaacgctgatgccgaaggactggccggatggaatcttaaatgtagagaagccttaacccctctgtaaaccttggcgggacttctcctttgtgcatcagaatcaactgtgaaggttaaagatactgctcaggtccttcccctagagattccattggcctggaactgggacctctggctttttaattttaaaagcatcctaggtgactcgataggcccaactgggattgaaaatgagcagtttagacagttacctcctttggaatacgtgtcttgagtggtatcatttctgagatcatggttttacaaaacttcgggtgtgcataactctttttattgtaggaataataaaagcctttgtagtcattccaaacattacagacacatagaaagtgaacagtgagtcaccctcctttcctggagcgccttccctcggggcgcccgccttgcattccgccgctaattccagctaattggggtgcactcttcagctgacttctgttgcgtaggtttccatgtctgtattcccagatgggatttatgtgtcgttttcttttttgtttattagcgctggggatcaggatcactttttgcctcgtaaaagcaattggagagagggttgactttttttttttaactgcgttggaattgttctgtaggttatcacgcccagattgaaagaaggtagatgtggggatggctgcagcgtgagttaccggacacaaatttcttcagagactacatgaagacaacaaaataggctactcattatggccttcccccactgcctttaaaaaaattctaaaattgtggtaaaagacataatataaatgttatcatcctaaccatctggagcatacagttcagttgccttagtgttgtacagcagaatcttcacacctttttcatcttgcagaatgaaaattctgtacccgtttcctcctcccccagctcttggcacccaccattccactttctgttgctatgaatttgattactacaggtacctcacgtaggtggaatcatacaatatttgtctttttgtgattggcatatttcacttagcatagtgtcttcaaggttcatccatgctgtggcctatcatgttacagttgaaggctgcataatattccattatatgtatatgttatattttatttatccattcatctgtccatggacatttgagttgtacctcgtggctattgcgaataatgctgctgtgaacctgggtgtgcagatatctctttgagaccctgctctcagctcttttgggtatattcccagaggtggaattgctggattatatggtaattctatttttaattttttgaggcacttccatattgttttccttagcagtcactccatttggcatttccgtcgacagtgtacaagggttccggttccttcacatcctcaccagcgtttgttattttctggttttttgacagtagctgtctcagcaggtgtgtggtggtctcccacagtgtttttgatttgcatctctctgatgactcatgatgttggccagcttcccttctttaaactgcatttattaacttaaattttctgtaaagttttcctttttctttttttcttttctttttttttgagacggagtcttgctctgtcgctaggctggagtgcaatggcgtgattttggctcactgcaacctctgcctcccaggttcaagcgattctcctgcctccgcctccagagtagctgagactacaggcgtgtgccaccatgcccagctaatttttgtatttttagtagagacggggtttcaccatgttggccaggatggtctccatctcttgacctcatgatccacccgtctcagcctcccaaagtgctgggattacaggtgtgagccaccgtgcccggccttttttttttttgttttttgttttttttttgttttgagacagtgtctcaatctgtcgcccaggctggagggcagtggcgccatcttggctcactgcaacctctgcctcctgggttcaagtgattctcatgcctcagcctcctgagtagctgggattataggcacgcaccaccatgcccggctaatttttgtatttttttagtagagacagggctttaccatgtggccaggttggtctcggactcctgacctcaggtaatccacctgcctaggcttcccaaagtgctgggaagcatggtggctcatacctgtaatcccttcagtttttttgtattttttctttttttggtagagatggaggagggaggagggaagctgaggcaggaggatcgcttgagcccatcagtctgagaccagcatgggcaacatagtgaaaccctgtctctacaaaaaaatacaaaaaattagctgggcatggtggcatgtacctgtagtcccagctactgggaagactgaggcaggaggatggctgagcccaggaggtcaagcctgcagtgagctgtgatcatgctgctgcactccagcctgggtacagagcaagaccttgttaaaaaaaaataaataaagctcaagtgaattgttttagatagtgtgtgttttctttcattgcacgtttgcttggggagcttatttctgaacagactgcagagagaagttccttccgtaaaaagtgggaacaagcctttttcccggcttcactcttccaaagccacctttacctttgcagattgttgagagtgaatgtagttgaagtaggttgtgttgaaaaacacgtgcagaacacagacatcaccgcagacctgagggctgagactcaagcctcctggtgactctaaagtatggccagccattgtccttttgtctgttggtgagttacatgtgtatcatagaagatgtagaaaatagagcctcggaaagaaattaaaaatcacccgacttcccttaactccattactgtgagctaaatcacagagacattctttttagatggggtcatttgtgttcatatctgcaccctgcttctttcactgggtggtttcactggcagtgctgacgtcgcccacacaccatccacctgtgagccatccctggtgggaggtggaaggccatcttccggggaaattattttcagtgctgtttcgtgacccctcgctgatggaacacagtggttcacctacccctgtgccctcccggttttaacatttcccttccaatcttccttgctaagattggcatctttgcagcatttctaagcagtatgtacagcctcactttgcagaagtcattccagtgctctgtcctgaaatcaagtcatcgaggatttgttgaccacctcttatgcaggaggcaccagtcccaaagcaatttgactttctgaggcagtcgtatgcaatacgtacccccctgaacagacagtacctgccctttctcacttaattcagctgtaggctcccagaagcccttctgtgtaaagcctggatttttttttttttttaggcaccgtcttgctctgttgcccaggctggagtggagggcacaaggatgagtgacttctgggctcaagggatcctcctgcctcagcctcctgagtagctgggcccacaggcgtgtgctaccacacccagctaagttttacaactgtttttgtagagagtttccctatgttgcccaggctagtctcaaactcctggggtcaagggatcctcctgcctcagcttcccaaagtgctgggactatagatgtgagccactgcacctggccaagcctggatttttggggggctgtgaggctgcactgccaacatgagccagtctccaagtgctccgggtctagtaagtcaacaggggaggctttcagaactcagcagctcctcactggctctgggaaaactcatttagcgatttgtgaaggacctggcgcagtggctcacccctgtaatcccagcactttgggaggccgaggcaggtggatcacctgaggtcaggagttcgagaccagcctggccaacgtggtgaagccccatctctaataaaaatacaaaattagccgggcatggtggcgcacacctgtaatcccaactactcaggaggctgaagcaggagaatcacttgaacccgggaggctggggttgcagtgagccaagatcgcactattgcactccagcctgggcaaagagcgaaactctgtctaaaaaaaaataaataaataaaagagaaagagagatttgtgaaggtcatgagttccagcccatttcactgctccataaaatgctacgttggtgaaatgggcaggatgagttgctctgtggacaggcagccctggagctaacaggagtatcctgcatcccaccacaggatgtgctgagtccacttggaagcccagaaaaagcttctgtgtttagcccttcagtttcttgccttagtgttaggctggcgcgggccttctggtgctcagggcccccgttccctggtctcattttacactaacaagggcttcatgcagcccgcggcccagggcgttcacaagctctcttagttccgaaaaatcgaggggttccttgccagcttctctggctcctgtctgcctcctctttgttccctggctggtgttggggtgctttctggacaagggtgaggggaggggaaggaatctgagccagtcagtgtgcccacactgggggtgctgcaggtcgcgtttcaccctggcacgccctgcctgccccgttacgtggcgatttgtgatggggatcataataaaacttagcctgattagaggcatgtgggaagcatgcccagcacacgtctcagtcccgtccctcggagcaggccaagctcgggcggcaggcagctgccttgcaattctcggagtttcaggaactggacaggggaaggttggcttgcgatgtatttctctgggttcgtttggtgccgggattgagtatttctggtgagacagttgttggagagctcctggggagacaggcattttgtggttggttgcattgttatcccacagggaattggtttcttgcctccaggaaatggcagtaacatcggggacagcagcagttgcaggacgacagacgtgtcactgagggtgcagggtgctatggctggagctgctgctgttctccctatcactcgtggggaagccaggcctggcgaggtgcaggcacttgctgaggtcacggcggccagactggagcccagaactctgtctgcacctaagcacagtgtcccttacctccagcatctgagtcccatcgtctaatgtggctttaacctcaggatcgggcctaattctagaatcctacctgcaagacaagcactgtaagtggcttcatttcatatatggggaaactgaggcaccgagcagttcgctcaagctttgagggtcaaaaattgaatgaaagttgtttgaggctgggcgccgtggttcatgtctgtaatcccaacacttcaggagactgaaacaggaggattccttgagtccaggagttcaaatccagcctgagcaacatggtgaaaccccatctctgcaaaaaacatgaaaattagctgggcatggtggtgcatgcctgtagactcagctacccgggaggctgaggtgtgaagatcacctgagcccaggagattgaggctgcagtgagctgcagtcatgccattgtactccagcctgggcaacagagcaagaccctctctcaaaaaaaataaaaaataaataaaagtagtttgaccaggaacattcaaccttagcttctctctaacctctagtggcttccccacttctctgcctaaaagaagctatttcttttctccagcctcagtttcctgtctcgtcagccccatagaaactgagctctccaaattgaacgaggaccccagaacacgggagtctgtgccgagtttggcaccagggatgatgtgtgtggttgtatcttctagggacaggggccctggctttcatctagtgacccctgtggaggactcctgcggattccccatctacccatgaagagcggctcctgcggggtggcccgggttaccccagcagcagcccacctggccaggtttgaagggcttgggcaggacaggtggtatctgggcccttctcctaaaaattgcctttttataaatgcaggccaggctgtcacctttatttatttattcattcagtcacttagattttaaacttgtgttgaccttatagtcaactgatagttctgagtagttaagttagatccttagggggtgacagggccggtgtgtaccaggttaaggtctctcttgcattttgtgggtggctgcctgcagttaagcagggctaccgtctctcggcccggggcttcttgtttcatgataaatacagaagccgatgtttacccgcctctggtagcggacataggggcatctctgagcagagcaagcaggggcctgcggaaggggttaagaggggctgggcaggtgaccaaggtcaccatggcagggataagtcacgctgatggcattgtgtggcaagaaggacacctgcctctggtcttcctctcagtaacacacaacccagtctaactgggagaaaaacccccagccgaggggcgtcttacagaatacctaaccaggcctcctctactgtcaaggtcacccaaaacacacaatgtctggggagatgccctagccaagaggagcttaaagagacacgacacctaatgtcatgtggtgatctggatgggatcctggaacagaaaaaaaggacctcagggacaaacataggagacccggatgaaggacaggctttattgtttgatgatagtgcaccgacatccattgtgacaaaggtgccgtcctcctgtaagacactcacagggaagccgggtggcgggaggcctgtgggaattctctgtattatctccacgacttttctatgaatttaaatctatcctaaaagaaaaagcttatttaagaaaataggtaagagtggttaggaaggctggttggaggctggggttccaggcctgaccctctgcacccgtgtctgcttcaggcaggtgacactgggcacctcctgccggggagaagctcagggtccccatttcctggccgggaacttccctttcctacagaccctcgcttggtgcgccatggcagctgggcccaggcctcccagttgggccgaggcccatctcttttcccaacagcacatcctttgttctctccagcccagacgtgtagaggtgagccaccctcctggccagtgaggagcttctaaacacggaggcagatcagctttttgccgagtgaacttgagaaccggagcagagctgcagggacaatggtgcattattaaactgctctgaaactcagagcccagagcacccagctctggggcgactggcaggtgttggacctgtggccgtggtgccagcccccactaatcccattagcgacttaggggtgagtggatggaaaacaggatgagagtgtctctcccccaaagagggctggttcaagtatgaatattcacagccacaccgaggcacctgctccgtagatgatttttttttgcttatgcagttagtgcacagagtgagccctgcgctgggaaagacacgcacacgcatatgcacacacatgggcacacacacacatgcgtgcacacacacgcagaccctgagaccctgcacttgagtttctagtcttaagcaagaagggtgtcaccgaggttgtgtcctgcagctgctagtggccagtctgtcccacttggatggtctgtttctattttattttattttttactttttttgagacagagtttggctcttgttggccaggctggagtgcagtggcgccatctctgctcactgcaacctctgcctcctgggtttaagcaattctcctgcctcagcctcccgagtagctgggattacaggcatgcgccaccatgccggctaatttttgtattttttagtagagaaggggtttcaccatgttggccaggctggaatcgaactcccgacctcaggtgatccgcctgcctcagcctcccaaagtgctgggattacaggcgtgagccaccatgctggcagtctgtttctattttggcatttcctcactgcacctggagaagagcttcattcattaattcatccattcattcattcattcaacaagtacctgacagcctgtacagcagtggtgccaggtgaggagggtgggtaaaaatgcagggtcctcctcactgcagtcactgcgggaccaggtactcttttcctgcgccccacactgccccaaggccccactggtcatccgtccagcactctgtgctcgctgactggtgcggtgaactctccggctgggctcctttcctgctgcaggtgccgcgtctctttcttaagcctgtgtagaaagttcttttgtccgggtgacattggcatgattgaatcagtgccagagccaaacaggatgtggttctgggcgactcccaacttccagcaaatccgtggttgttttcagttaccttaagagggacaactgaaacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccaggtcaggctggaggcttttgcatttggtttggcgaggagagacagcaggatttctgggtgccggacatgcttctcggtcagagctggtgcgtttctttgcagggcaaggtggaggcggggatgccagggaggcatctgctgcatttcttgaggtttcacagggtgcagagcccctgtcctcactgttctgtggggtgctaagggagcaagccatgtggtccctgaactttgagtagatacaggtaatatttgaaaatatttgggaatgtttacacaatcacaaaaacaatgaacacttgtgtagccactactcaggccaagaaatggaacttaactttgaaattccctttgcccctcccaatcccagcttccagctcccgatcctctccccttcctgcaaaaatgtgtttatcagataaacctgaagcatttgagggagtccctgtcctgaatttcgcagttgtcattctctgctgttttttagttttatcacatggggttgtgtttctaagcaacatcgtttgtttttgtttttaacttttatgtacatggaatcatgcagtatcttttgtggctggcagactctgagatggccttcagtgatccacacctcctggtgttcacatcctgtgaagtcccctccctttggcgtgagccgagctagcaacttgcttctaaccagtaggatgcatccaagttgatgctgtgccttcctcccgtgattacattatgtgggcttagaacttcttccttgacaacagatggtctcccctgctggctgtggtggagcaggctgccatatagagaggccatgtggcaaggaactgagggtggcctcccccggcagccagcatgcagttgaagcctcagtcccatggccacaagtaactggatgctacaacaagcagatgaccctggaggacccctcccccagatgaccctggaggacccctccccagtctagccttgagatgacaccccagcctgggccaagactttgatggcagctctgtgagaggccctgaagaagagagtctcttctttaccagttaagccacatctggattcctaacctacagaaactgtgtgataatagaagtctgttgtttggggcgatttgttacacagcattaggtagctaatacatagtcttgcaagagttcgttttttggctgagcattatgttcttgaggttcatctgtgttgatacctgtagttgtagttcatctgttttcattactatgtgcctttcccctgtaagtagtcccccccttatctgcaggggatacagggcccccagaaggtgcctgaaacttcagatagtaccaaaccctgtatgtactatttattttttcctatgtatacatgcctatgagaaagtttagtttgtaaattaggcacactgagagatgaacaataatgaataataaaatagaacaattatagcactatattgtaataaaagttgtgtgaatgtgttttctccctgccagaatatcttattgtactgtagcacctgttttgggaccacagttggccaggggtaactgaaaccatggaaacttggggtgaggggggactgctgtatgttaatgccttagcttaattattctttctgctcctaaaggacaataggttgtttacagcctttgctatcaaaaaccacacttgctgtgaaggtctttgtacatgacttccagctcagcgtgcaaatgtttatctagggagtgcggctgggccttggctgccagtccagctccacttcccacagcagccttcaggttcgcccaggctcctccgcatgctcccctccctcaatattgtccgcctttttttcacttggggggatggtctgatgggtgtgagatggtatctgagtgtttttatgttctgccagaagctaatgttcactgaccattctgatttcctcccatgcggaaatcctttttgtggtttttgcccgtttttcttactgaattgtaggagtgcttttcgtttttgtttttttgagacagggtctcactgtgtcgcccaggctggagtgcagtggcgcacaagctctgcccactgcaacctccgcctcctgggtagctgggattacagccttgtgccaccatgcctggctaattgtaggagtgctttgaattttctggaaaataagcctctcttagttacgagcattgcagacactgcatcccggtttgtcccttgccctcatgggcttttaaaatcaaatcaggcacaattctgaatttttctgtcccgggaggataatttgcagaattacacttttgcggcattcctagtcctggcctgtgtgtcctggtctttgggtcatggactggtgcctgtggactcggcccctgtttatcgctcttgcttgatgctgccttcctgaggtggagactgctgggctctgttcccgtctgtggctccccctctagtctgggagtgctttcctgttcagatagctcattccaacctcttagtcactttggagagcctcgttcagtgagtcagcacgggacctggagctcggggacccctcacagccaggccagtgcacacttggaatctgcagtttgtcttaggcccctgaaggtgattgcttgaccgcagaggaatgcacgggtctggggagaatttgcccagcgtgtttagaaggaatgcattcctggagaaagttaaaattagaaaaagctgctacatttcctgccattcagtcgcagttggctggtgtttgtttgcacaaggattctttggtaacaatctgcagtcggtttctggcggaatgtgaggtgaagtcacgactgactttcgggatggaggtgagcggtttccacagggatctttgttgtgggagtgactgctttgttttccgagttgttgcagaatcataccggagtggaaaaatattaccgaaacaatcccttgttgatagttagcaagaagattattttatttattctagaaaacagctctttagtgggaagcaaatatcgtggagcgcatctctttgtaagctcggctgccattttcccgtccccgcctccttcctgggtggccacctctgatgtcgcctcctgaggctgggctttttgggaaactccctctgactggcacaggcagtggggtccaggttgagcaaatacaaatgcagaatacccgggtccatttgaatatccggggtaatgtacactaaaacattattagttgtgcacctgaaaattcgatgtaaccggctgttctgggttttgtctagagacctctcccggcccagctacactttgaagcccgctctgtcctggtctctggtggtgcctgggcctctcccagctgagcggggcatcgctggcaccaggtgggctattggcaccagtgggcacacctgtggctttgcagggttttgtccacttctgtgttggtgccctccgcctgctggtgctgggctggggtcgtgtgcccactttatggaggcggaatggagaggccggagggttaccagcctgtccagtagtgtgcagctcgtaaatggaactgttagtctataggtctcaaagcccagcagctggagggcacaggagaaattaaaccatcttcttccctggggagcaaaaaaagatggtcagaaactcacgcacagggaggaagtgctgtggggctgagagtctgggtggcaggtgggctatccccgagacctgggaacacaggctgcggggaagcctcagtgtggggcttgagggagaggcagtttttgcacaggcagggaggggaccaaggaggcattccctagtcacaggggcagtgggcaaatgggaggaggtgggatatgtataggggagtttgagggtggggccgctgacctggctggagtgaccagtggatgccatggagtctgtccacgtggggtagggcaaactgcagagaaccccgaaatggggcagggaagcctggctccaagggaggaagaggcaggaaggagcaggcaccctgtgctcttgagccggggataatacaatgatgatgaggcagtggggctgtaaatttggtggagagatgcagctgagaccagcggggaggtggtggatcggtggacctgagaccaaactgccgattacaggtgcttgggaagcttccttttctgttcaggcagcaggtgctattgatgcagctgctgctgagcactagtgcaggcctaggggctgggtggggatacagaagtgagcaggacaggtgggttcctgcccgcaggccatacaggccaacttgcgaaacacccgggtgccaattacccagggcactccacacagcccgttcaaggtgcttcttgtttttgtccccagatttgtgcttgagaagctctgagttcccgtctgtccacctgcattggcatatgggtactctataaatcatccatccattcaaacattggctgactgcacctgctatgttccaggttgttcctggtgaacaggacaaagtccttgcattcatggagcctgttctggtgggagaaaaaggagagaagtaaatgacagatacaagaatgtcaagagcggtggacgagaccaggggagggagtgggcagcaatggtgtgcttgtgtttttgatacggtgtggtcggctgagtaatcccttccacaaaaaacatatttctatcctaatgctcagaacctgtaggtgttaccttatttggcaaaagggactttgcaggtgtgattcattgaaggctcttgagatggtgagataccctggattacccagatggaccctaaatgttatcacgggtcttttaagagggaaatggagatcttaccacagcaggaggccctggaatggtgggagcagagactggagtcccgagctttgaagatggtggaggggccctgagccaggaatccaggcagccacgggatgcaggaaagggcagggccacagaagcagctcaccccctcggagcctccagaaggcactggccctgtcgtcagcccagtgggcctggtttcagatttccagcctccagaactgttggagagtcaatgtgtgttttaagccactaagtttgtggtagtttgttacaacatcgataggaaagtcacgcagggttctgcggctttgagggagttacgtttgagcagagccatctgaggttggggctgggcttccctgctgacacgtgggctggggccacagagcctgaaccaggatccaggcctagctaagggtcaggaatccctgctctggcagttgtcctcagcctggaagtgacccacagggcatatacacgtgtatgagttttcgtttgtttgtttgtttggtgcggggcagggtctcattctgtctccaggctggagtgcagtggtgcaatcatggctcactgcaacctcgacctctgggctcaagtgatcctcccaccccagcctcctgagtagctgggactgcaggcacacatcaccatgcctggctaatttttttttttttaactttttgtagagacgaagtcttgctgtattgcccgggctggtctcaaactcctgggctcaagcaatccccctgctttggctgtccaaggtgtagaaattacaggcatgagccactaagccctgtccttttcagtgtaaaaatgtcagatgaggaatcaatcccctttgctgagtataagtgtatcttattaacagaagaaaatatttgcttggctttctaaattgggaatttctaacaatccgtaacagcccactggctttgaccagaaccgactgagtgctcaggaccagaaccgaccgagtcctcagttacatcactcagctgagtgcctgtgtcgtggacagaaaacccagtggtctagcaccatttaccatctgtcctggtttacaacccctgaaagcagagcctgagacaaggacttgggtgctgatgttttcggggagatgactggtcccagcagtccatccaaatagaagagggtgagaagagggaagaggaaaagctaatcgggggtcagctactgagctagtggccactgttaaccaactattagggctccatcatgctggagacgcatttgaggagccatgagactatgccctagaattgtctttctggaggccaggaggcgggggcgtcgaccccagggcagccctgggggctatatgtctgcagcgcatcctccatcctgcaggctgacccgggcttggggctgtggtgtgctgggatagcggagcacctgcagatcacaccccctatttggagaatatcttgacagcgcagcaacagagtagtgagtgtacaaagatctactatagctggccttcacttccacgaagtcctcactttgtggctgtcccctgggagtcataagaaaggcacatagtttagctccatccaccaagatttgagtcacctgccaacatctgccttaatgacttcacagacagtcattgtggcggaagctgtttagaagaatatgggagaaagtcaaaagtgtgcgtgaatgaaggggaatgaagtgggaaaacgcatctcacctgcatacacatttttgactcttgtgcacaagcatttttgaccctctgtgcacagctgtttttgacacttgtgcataagcattttagacccaatgcacacagtcgtttttcactctctgtgcacaggtgtttttgaccttctgtgtgcaggcattttgactctccgcgcacaggtatttttgaccctctgcgcacagatatttttgaccctctgcgcacaggtgttttgactgtctgtttgtagcatcctcccttgatgtatgttcgggtgaagcagccctcgatgcacacctatgagctcagggactgtgcgcaggtgaaccagcctgtgacacacgcctacgagctcaaggagcacggtgcaggtgaaccagcctgtgacacacgcctacgagctcaaggagcatgatgcaggtgaaccagccctggatacacgcctatgagctcagggtccatgtgcaggtgaaccagccctcgacacacacctacgagaacagggaccatgtgcaggtgaaccagcccttgatatacatctatgagcgcagagaccacagtgcaggtgaaccagcctctgacactcatctacgagaatagggtccacgtgcaggtgtaccagcccttgatatacacctatgagctcagggtccatgtgcaggtgaaccagcccttgacacaaacctatgagctcagggtccatgtgcaggtgaaccagccctccactcacacctatgagcacagagaccatggtgcaggcgttatctctcttattcatgaggaggcccagtcattccctccctaccctgagttgaggaggaaggataagacttaactgtggtcccagcatttagtggcagagccaggatttgagtccatatttaaataaggtccaagtcttcaacatactgatgtttcccagatattttcagcctcctaaaggtttattagggggacaaaactctttcaagactccgtcacaaacattcgtagtctgattcaggcaggaatgttaacttctactttcaaagacttgtgattttataacctgccatgggaaaaggaaatgcaggattggagcctggtctggaatcttacaccctcacttgtccacgtcctgtcttactgcagcctgtgtggtcttgggattgttctgtttgtgtttgtcgttactctgcatatcatggctggtggctttgggttaggatcccagcttttcacttcctgatctcgggtgagtctttgaaacctggtcagcctcagttctcttatctgctaaatgatggcatgatgatacctgtctggcctacctcatagggttgtgaaaagcgaccgagaggccagatgggaaagtatgttatcaactaggatacattatgctaatgattttattttttttttttttgatgaagtttcactcttgttgtccaggctggagtgcaatggctcaatcttggcttgctgcaacctcagccccccaagtagctgggattacaggcatgtgcctccatgcccggctaattttttgtatttagtagagatgaggtttcaccatgttggtcaggctggtctctaactcctgacctcaagggatccacccgtcttggcctcccaaattgcttggattacaggcatgagccaccccgcccggcctgctaatggttttcagaggcagcatcaacatcagctgggagcatgttagaaatgcacattctcaggcccaccccagacctacagaatcagaaactgagcgttgttgggcccagcaacctgtgttgtaatcagccctccaggtaattccagtgaatgctggcgtttgagaactactgccttagtcacagaatttcacgggtgttgtatgcaatttctactatgtatttggcactcagtgtctggtatatttcaaagaaaaaaaaaaaagacagggtccctgccctcaacatggtctacaggctggaagaaaaattaaagcaagagaaacccacatgaacttgatgtacgttagagccccatgttacagttgaggaaaacgaggcccaggaaagatgagtcatttagcaaaggtcgtggagctggtgtgagaaacgtgaacccacatgtttgacttatgacaatctccagacccttcattccccaggccgcctccccccaacatgggcggctcatggtgtccccccacttattcatgcgagagagttccgaggtcagaatcaaagcctaggacgccttccttgagacactctccttggcttgcttttaggtggtgattttcgaaaccttggattaaaaccttcaccccccacagccacagtagagtccagaatgatgaactagatcttgtgaggctccagaagtgattgggcagtgagttgaaaaagtcaaagtctagaagaatcattaaaaatacaaggaaaagccgagtgtgcatgggtcttccagtctttctgttgggtgcaggtcttttctgagtgtgggtttggccatggtgtctcctgtgtaacccacatgcatgatgacatcattgatttccagtccaagatggcgccatgacacagggacactggtgaagccatccatgcccagagttctcctagagttgactgcattttcctcaggtgtttaatgtcatttagcttgccagccacatttttttttctttgagtcagagtctcactctgtcgcccaggctggagtgcggtggtgtaatcccgcctcactgcatccttcgcctcccgggttcaagcaattctcctgcctcagcctcccaagtagctgggactatgggcgcccaccaccacgcctggctaattttttgtatttttagtagagacagggtttcaccgtgttagccaggatagtcttgatctcctgacctcatgatctgcccaccttggcctcccaaagtgctgggattacaggcgtgagccaccacacccggcccgccagccacgtttttaagtgattcacctttagcgagtctttctgaaacatttcacttgaattgccaagggagctgcccttgtctcacccctggccatcagtttatgtagtaattaaatatgtaaaatttccacaacaaggaccccagctccagccaggggagcagagcccaaaggggaatgagaaagtagtcttccggccacacaggtgtagtgggccctgtgtctcattgtcctcccgtcttcacactcaaaggcagggggcctccgcctcctccaccgccctgccagggagggagggcgttcagagaaggcagccactcggtgctgcgcgggtgccaggaggagctcacggtgtgtaggggggacgcatgaacaggtgaacaaagccgttgcgggtgctgggtgggtggttgtctcaacgcccctcctccatttttatgcttagtattcattctaggtttaacacaggagagaggaaggttatatcccattccgtatcacattctctgtaaaattggaaattttatgtaattacaggaagggtaagtgaagcagttctgtgttctgcataagaaaatgtaacatccatcaggtgagatttcaggccctctcacttggctgcttcatccatctgttgcccaaatacgttgtcagtgtgtaagttttaatagtgttgattttgatagcatgaagtagaaaggcttttgtccatctatcagagtgtcgctttctcagttctgtaaattggttgtctcggagtggaatgatctgccctcatagagaatgaaaaacctggggttgggtccatggccaggccatgaagtctctgtgtagtcttggacgtgccgtgcatgaggactgattgtgcgaacccgaagctgtaggaggatggcgtcactgtgctgccagagcggggccagagatgcctcccctctttttgaggttggagccagctctagaaagaaaccttgaaatggatgttgggcccgttcccgtctccctttctgaccacacctacgtctgcttttctttccttccctcttgccatctcctaccctagctggtctcttggcaaacactcctggcatgcagccatgtacccgggtgaatgcccacttccgtttggcctgagcctacatcccgcctggccctttgcccactgcgtaagtaggaagggtagagaacagggcttggcacacttttctctgtaaaaagccagagagtaactattttccaccttgtgggccataaggtctgtgtcacagctccactgttttggttgcacagaagagctattgataaactggtggggctgggctctgtgcaacttaggtaaggacactgcgacttaaatttcttatcattttcacgtcgtgaaatattactctttttattttccccccaactgtttaaaaatagaaagacgttctttgttcatgggccatacaaagataggtggccaggttggatttggcccgcgggctgtagtttgcctctgggttggacaagaattttcagggtgaacacccctcatccaaaaatttgaaatccaaaatgctgcaaactctgaaactttttcagcaccaacgtgatgccacaagtggaaaatttctcacctaatctcacatgacaggttgcagtcaaaactccagaacaaaattatgtaaaatgttgtataaaatcacctttggactatgtgtataaggtacggatgaaacataaatgaatttagtgtttagactggggtcccatctgcaagatatctcattgtgtatgtgcagatgttccaaaatctgaaatccaaagcacttctcgtcccagggattttggataaatggtactcagcgtgtatttagttctactttgtagtttggttctactgactggctctgatgtatggtggtgggtgaggctggagcgaccccagtcatccagctgtcggggatgcaggctgtagaggctcttctggccgatggctccattgatgtccactgtggaggcttaaaaaatctaagaaataggcttacacgttttccagtttactcaacaccagcctaacattgcttcacctcaacccttcaagaatgtgtcccataactaagtgggttggacttttgggcccatacctgaagttgttggaacaaaattagttttgtgtgttcctgcatattccctgggaactcatgcgggtctggccctgaaagactcagctctgcagcgtggaccagctcttggtgtggtcagcacaggccagcctgtaggttgagttgggtgaagagttcacggagcattttcagatctgtcactccctcagcaacctctgagatgggcagagccgtgagaattactttgacggggctgttgtcaatgaaccacaaactgctgggtggtttgcacagtggaaaaggattgtcttacaggtcaggaggctggaagtccaagatgagtgtcagcagggctggttccttctgaggctgagggagaatcagttccagccctttctcccttagcatctgggggtttgcaggtagctgttggcttgtagaagcctcaccccccatcttagtcatcctgtcacctgtccctctctgtgtgcatgtctgttgaaactccccccttttataaagtcactgggtcatattggactggggcccaccctggtaatctcactttagcttgattgcaccttgaacactctgtctccaaataaggtcactttctgaggtactggtgatgcatacaaatttggggggatgcaattccatctataccattgggaaatggggtgaatagctgtcttggtgactgtcctggaatgaggatttaggacacagtggtcatctctgtgtgtgaatatagcttcctgtttggatgtggtagggtgaggaccatgagcctcatatcatttatccactcaccctcccagaccctctgaggtgggatcaactctctgcagatttgtcatcagctgagactgtcaaccattgttaaaacagctactcagatggacagagtgacataactgcccttctctctgcaccgtgggagaagacacttgtgttttgagctgctgaagacaacagaatcttgtcttcttggcattgtggtttttggagatttgccccaaatcatggttaatgacaacactgatgtttcttgaaacaactggagaataaggcatcctctagactttctgctaattccatccacccacgctaaaccgtgtggttttcttggggcccctgaagactgacgggtccacactggtgtctggtggtgcccacaggagaacagtgcttgactgaaagatcgtacccccctcttctcagcaaggcggtccttgtccagaggccttgggcctctggagaggttgatcaggagttggggaagtggaaaggggccagcggtcttgtccactgaatccatccactgggacctcccggacatgacaagccagattctctcctccctccactccagcactgaggggctagtggtgccacatgtgcacctgtccctgcccagggtccagttctggcgtctctgagccccctgtcagggcagctgggtccccccatacttaggcatgaggtatgagtttacccaatcatccccctgtccagggagcctgccgggctcagcttcaggaccacaaggctgttaagtaaagacgctgcctaaagaacctgccagaaggaaagctccagagggcttgcagggcccttatccaaaaatgtgaaaataatcagtgctgaaagccacagtgacggagggtgttgtcagcgcagcctctctttaaatagagaaaggagcacagcagctttttggagttggggcgaggtggcatctggagtttccagcgaagatttattttgtgccttggggggcaggagctgggcagcctggggagggctgggcagcagcgaggatggcgaggctgaggccctggaccacatgcaggtcgttttcttcggggtggctggagggcggctctccaggcagctccatggcctcagtagcccccatgaccaagtggagtgaagtgagctgggggaggagtgtcacaaggaggaaggcattgtgggcccctggagatggatgcgttcctgccatgtagctctgggtctggagcccctggagatggatgcattcctgctgtgtggctctaggtctggagcccctggagatggacacgttcctgctgcgtgtctctgggtctgggcagcacctggagatggacgcattcctgccgtgtggctctgggtctggagcccctggagatggacgcattcctgctgcgtggctctgggtctggagaccctggagatggacgcattcctgctgcgtggctctgggtctgggcagcacctggagatggatgcattcctgccatgtggctctgggtctgggcagcacctggagatggacacattcctgccgtgtggctctgcatcaggagcccctagagatggacacgttcctgccgtgtggctctgggtctgggcagcaccaggagatggacgcgttcctgccacgtggctctgggtctggagcccctggagatggacacattcctgccatgtggctctgggtctgggcagcacctggagatggatgtgttcctgccatgtgggctctgggtctgggcagcacctggcaggctttggagtaggccttgcccacagcctgggaggctggggagttcctgtgaagggagctgggtccttctggggagcgcccggtggggcttgttgtccctgccttgggcttgtctcaggaagtgcccccggcagagtgaggaggctgagatgagccccgggggtcggtttctcgaagcccccgtcagagctgatgttcgggccacacgttctcttggggtgatccgttctgtgtcactggactcgccccccgcctcatttcctcactggcccagtagtaactgcagccactggaggcggatacccactgaggctgttcccatctgtcctttatgacggcttgcgatggacccgcctgatgaaggggcccagcagtgccggtgcctgcctagaattcaggatggagattctgagaaccctgaccacggcataggggcttggggtacaaaggaaagaagaggcactaggttctcagagatgctggtgcagtggcttttagaatcagaaagaaaaaatgggaaatgcacgctcacggtagaggaaatgggagaagttgcggaagtctgaaaaaggcagggacatataccatgaagccagcctcattcgtagtttcacttcccccaggtttttttcagtgcccttttatgtcttttaagatgatgagattttcaactgttctgtcttgacatgactctttggagaacgagtactttgagagacattctgaagagctctgagcaacatggtagacccatttcaaaggagagggatggacggatggcggcgtcctgccttctctgccgagaatggggccgccttgtgattcctgtccagaaaatcagcttgggtgcaggtggctgtgttggagctgtggtggcacctgcagtcccgcctgtctcttcccaccctttgtttttgtcttctctggtttcagatcttttgtgtttgtgcatatattttgtcacattgttgcggcctttttcgtagcgttcattgattcttttcattttgcctgtgtgattttgcacatcgcttgtacccttagaaggtccgtgtctacgtagagatcaactatacaaccagattttctattacctattgggcggtttcctttcctccctccctcttcccctccacacccttctattgatctggaattcattttgtctttgggtgtgagttgaagccctgagaggggggatctgtgctctgaacaccagccagttgtcctagcatcacagggaatgattctttccttcttgggtgattgtgacgctccttttaattgcatgttaaatatttacatggatggaggtctgttctgggctgtctggttcctgcagaggatgagtggccatgattgagggaaggtgtccagaaggaagttcccactccttctttcacagtctgatgaggtcctggattcctctgaaggccccggggcccactctgttattcctgtggaggaagtcagcctgagggggagggcgtcgtggtggcacctgcagttccgtctgtcgcattgatgttggctggttctgctctcaaaggcgccggctctgtagtgatgtcagcgccgtgtgacttgaggaggagaccccactgctgcggtgtgtctggggttcatcttcagggcgcagctgataagatgcttctgttgcgctcacaatgccagtcattgcagcagaagtaatggcaggtgatgggagactcattgttggggtgagaaaaggcacaataagctattgtcacaggcagggctccctgtgaagcggaacgtgatgcagaggccactgggcaggacgtttaggtttgctggggagcacagcagcaggggaagaggacagtgaggctgggatgcagcctccatgcagcctgtcgctttctccacaggagctctggcctgggccagactgccgagtcaccctgattcaggagtagggtgaggggcaggctttgttaccccgcgctagtcactggcctggtcattgggtgcaggctggcccaggaagggggctgatgtggcctcaaaagggctctttccagtgagacagttctgggtggcccccggtgaaggtccttccgctggccactctccagagttggcttcagaaggggacctgggggccgcgtggcagcgtccaccaccatcctcacctgctgtggaaatgcactgcagagcccgtctgtcctccaggatgtgaaggggccctggcgggaagcaggcctgagttctgcgctggacaggactgaagctcactcgtgtttccttcttgtcttgcagcgtctcccttctctcctggacagaaggccgtgtcctgggacttctctgatggcgagaggctgcggctgtaccaggtaggcagtgcaggcatggtgtgagtgggttgccatacctggacccgctttaccatgtcatgaccaaggtgccggactcatggggacacaggccccaaacgtgtgcagagcagctgcaggagggagaatgcttctggaagcttctggtgacacttgacctttctcaggcactgcaggcctgtccctcatggcgctctcctcctgtcctcgaagcccacagtgttgtccccagtgtgggaaggtcatttgtcatcctggcatccagaagcccggccccggcgcattcccagaacagccccgtgtttctcttttcagcgaatccactttctgttgccacccgtggaacgttctcactcttccaagaagccaggctagcagctcccccaccccagcagccgcgggacagagcccaggttgggtggtgtgtacacaaaggagggattgttctcacgtcgccctgcgacgagatggggatggacccgcggttagaggtcaccctccctggggcgtcaggggagcatttgtccttgaaacacgctggcaaaaaatgttccaaggaagcctcagctggtgtttgtgaggaagagctggattaaatggtgttctggtaaaatgttcctggaggttttcttggctgttcttggcttttatactcctggttggcaatagaaggaacaccctcctttgtaaagtcggttggataggatcacctacctcatagggcgggcacagcctccagttttttagaaaagcaacatacaagtctttccccaccaagtagaaaggattggatctaagtaaacgctacgtttggatgctcaaggccaaagggggagttgagaagccgcagctcacagtgggattcctttctgggccacgttggaattttaaaagcccttctaaataaagcaggcagctacttgcactgtttcaggtttttctttaaatcctgtaaactgagggtagctgattggattttatttcaacttctccccccaccctttctgtcctgtctctttgttttccagtatctgcctgtgccttaggatggagagaaggtttgagatgttcaggaggaggctcagggcttttcatagtgacgtgaggaattcaggagttctctggtcccagggtcagtcctccgcccactggggcctcagcgacttgaaacacttcagcccaggcagaggccaccagcaggcctttccttataagtgcagcccctggccctggaggctgtggtctctttgggctgcggtgaaccctcctgaaaggcatccacattcctggcattctttctgcctggcattggtcagaaagcgggggtttctaaaatcaaaggcgagcactgcagcttggttcttgtctgtagataaactggagagacaccagggggttgtgcggcatggttctctttgggcccccacatggactggcctcgctggactttgcatttggggcatcgccagagcaggccccatcctgagcaaagcaggaggaggttaatgggggtccctctcgggctccagcagttccttgggcggcacgcatgtggtttgctttttctgaccctgtgccagagttactggggcagcaagacatctgggaagaggaacgggagggtgggacgggtgccgccatcccacagcggtgcccgcttgtctccgtggcgggcacacaggcttccgggagcccggtgagggaggtgcacccagacttgccctggatacagcgggcagagcgttgcatgtgcctctgggtggggtgtaggggtgcttgggggcgtgggtccccacagcagttagagaccatccacaggccaccacactttaagctgattttcgttttgccttgttttcccagaggcatacatgtagtgttttcttggtgcctctgaatagtcacagtctgatttgcctgggggtcagtgagagacacggctacccagggtttccatttccaggccccgagttttgtccgtggcaaatttcgtgatttgcacatagttcccacctcatgggttcaagttgttaacctgatcctgctcccactgtcatcaccatcagaggtagtttatcctggtgcctggtgtccttcaggatgaaggaggcagcagaaatgctccctgactcagttcctgagaccagaatgactgaggaaacaggaggcctgcagcagagcacggccgattgctcctccggggagtgtcagctaggggacggagccggtgcggagatcgaggccccacaaggcctgcccctgtggttgttcccactgtcccactgatggctgggaagggtgagctccagcccccggtggcttgaacaccctctgtagttgtgtctgctcaaggcctgggaacaccctgcctgtttcacagatgagaaactcatctcagagtactcagaaacccagaatacttcattcaagttcaagttcagagggtgattaagaagaatcagaagactgggtgcggtggctcatgcctgtaatcccagcactttgggaggccgaggtgggcggatcacgagatcaggagatcaagaccatcctgtctaacacggtgaaaccctgtctctactaaaaatacaaaaaaattagccgggcgtggtggtgggcgcctatagtcccagctacttgggaggctgaggcaggagaatcacctgaacccaggaggcggagattgcagtgagctgagattgcaccactgcactccagcctgggcgacagagcgagactccatctccaaaaaaaaataaaaaataaaaaagtctcggagcccagcctgcagaccggctgcatttgtgtgtcccctaaaccactcctctgttcctttagcttagctgggtgcctgggggggcacgtgaaccacgtgggctggtaccacaccccctctagactggccaatgggaataaatcatgagccacaaacaggagacgtaaaaatgaacaggtaaacataattttttttcttgggattgtaaattcacacgacagttgaaggtgcagtgaagaaatgggtggtagcggagtcacccactcttcgcagggcgactggccacgcaggctctgcctgcacacctcctgcctggaccatgtggaaagtcttcaggggtcacgtcagactgaggttctccaaagttcctatccctttgtgtgtttggtgagctttttgtttgttggttttggtttcgaggtgaaagtcacataacctccagctgaccgctgcagtgggcattgagtacattcttggtcctgtgtcaccaccgcctctctctcgtttcaaaacttcgtcatcaccctggaagagcaccctgtactcactacatgaccacacccgttgcccctgcccccgcctctggctaccactaattggtttacttttgaggtttgcattgggctatgtccccatggccttcgatctgtgacagagatcctggctttcatacatccttgggacagagaaactaaggccagcgtccttaatagcatgaccaggtctgcttggactgtcctttgaggtgtcctgcaggcactgattctgcacctgccaaggcctgacctccccgtaatcagcagataatccaatagaggagaagggcacttgaggccatgcagcggctgaacgggaagctgtgctcagcgtctctccaagcctctgcattccagtgacaacgtccgcagggcctcagtgaataaaccgctgcaaatgcacgttggtgaggccatcagctgccgaagggaagctggggaatctggacggaggagaaagaaacgtgagctgcactcccggcgacacattggactaagaacggcgcctgccttcttgagaggcttgttttgtggtgtcataactagcctgccttacacctttcttaaagcaagcatgttgtgagttcacaggagggatttttaacatacttgaggctttggggacaaaagacatcagtcaaagaaagattccgctattatttatttcaagagcctttgaatctcttgctgaaatctgctcccattttgaagaagcttcccatcaaatcagaaaagccctgattttcctgtctctgtgtttggaattgtcccccaccctgttgttagttcattccttaaagttgtctgggcagactgcaatttcggaagggcacctggatgcgtttcattcttgggtcagaaaaatacctatgcaaagagcttctgaccaagcatagacagatttcaattattggcacaatagcatgttacataaatcaatttccttgggcctcagttttctccttggtaaagatggaacctgggtctctgaaggttctcaaagactaaaaaggaatctaagacaccctcagacttgctcaagaagaaaacagggcaggattattggaatgatccagaaagagagcacagtgaatcttctcaaactttgagaaatgaattggtcatcaaaaattagactttcctctcacctgtgcagctggctctgtcacgcggcctctgctgctcaccaccagcacatacctggcccaggagtggctgccagtcaatgcgcagcagccctttgcaggacctgcccttgggctgcttttgagtttctgagcatccaagtctcagaagcagctggttgggccagctcaagctctgggtccgctgtggattgattcacctgtacctggtctccaccactgatccatctggagaggggtgaggccacaggggtttccaggctgggggtgtgcctgggccaggcagcgacagccactgggaaccccaggcaataggggaagtggcactcacttatcctcggctgggcttctctgcaggctccctccctccttcccttcttccttcctttcggaactccctacaaccctatcacgttaagcaagtcctgtagcctctctgggcctcacttctcctacctgcttatggagggcccccgagcctgggctgtgtggcttcactgttaacatgttattgatgtgactggggggttgcccctgtgcctgacgtttcattcatgccgttctcccatgcaggttgctctcctgatctgggccccgccctttggttccaggggatatgaaggtcagaggagggattagcatgatccactggccagagtcaataacacggggcccctccttccaagaggggcttagccagaaggggaagcctggatcttgggctcgggctctgatgctttgtctctgagccgctgacatggaggacgtcaagccgcgatgttcatgtccccattgcgtagaggtgggtcctgtagtcccacatgtggtgtgctctgaatctcctttccactctgttggagggtcagagggacttgaaagatcacagagcccagcctcgcatttggcagaagagaaagcagagacataaaggccagggacttgtgccgggtcctacccgctatctggtgccccacacactggggcctgtccccactgccagcagcctctgtgtgggttctgcctttttctgcactggtggtgtctccccatcgccccagctgcttgtgggcaggcgtcaccttgttctgacctctttccttcccccaggcagctctggactttgctctcagtaaacacaacttgattcttttccttcttaccttatcattgcccataaatcccgtttacacggtgcccacttttgtgtctgagctgggacgtacaacctcgtctctgcctccagtttttgagaaattaattataaacagtgttgacagaggctctggcttgacttggggcatctgctgctcttcccggccttggtcttctgaaggtagctgttatcagtaacagaacagatgtgtttatcctgggctcccgggcccttggcgtggccctttgagggggtctgtgaaacccctgaaactgcatgctaaactttacgggtggaggtagttttctaaagagagggtccagagactttgtcagattccttagaggatttgcaccctcaaaaaacgttaacaacctctgagctggaggaaggcctaagacaagcctatcgcacttggagataagataagccgaggcgggacctaatggggcctcaatgtcttggccagagtgcacagctgaaacggagatgacacttgacagaaaccagtgtaaaactctccttccctttatttagcttttatttcttgtgcttttcattaagtacagatactctttgcttgcttacagaacagggaagacctggcttctgaaaattatctttaggtttttcattgaatttggtcttattctgaacaatgcctgaacgtcgaaggtgctcccctagataggttaatagaaacccacagtccagggcaagaggccgcatccgggaagcctgtgtacaggtgactggagagatgagttctcacggaccgttcgggcaacttggtgttccggcctggacatttcagtgctgcatttgaagaggaattatgaattggctctcaaaggagggtgaggtgttttgttttttgttttttattttttttgacatggagtcttactctgttgtccaggctggagtgcggtggcgcaatctcacctcactgcaacctccgcctcccgggttcaagtgattctcctgcctcagactccagagtagctgggattacaggtgtgcgccaccacacctggctaatttttgtatttttagcagagacagcgtttcaccacgttggccaggctgatctcaaactcctgacctcaggcgacccgcccgcctcggcctccccagagtgctgggattacaggtgtgagccaccatgctgggctggagggtacatttttaaacgatgcaattctggggccatcgtcagatttggcgaagaggaagctgcgggagagaactgttactatacaggatttgaagaactctcctgcaggcttattttatatttaaattgtgcacagtggtttatagtttgccaagctgtcttgggtttgttatgttgcgtaatcttctgaaggacaggtgggttgagccaaatattcattagcagcctcgttttacagatgaggaaacttgtgcctcagagaagctgaagtcatcaaaccaaggtcaagctggatgcggtggctcatgactgtaatccaagggaggctgaagcgggcggatcacttgagtccaggagttcaagtccagcctgggcaacatagcaaaacctggtctctataaaaaatacaaaaaattagccagtcgtgctggtgacacttgtatccccaactactcaggaggctgaggtgggaggattgattgagcccagcaggtcaaggctgcagtgagctgtgatcacgccactgcactgcagcctgcatgacagagcgagaccctgtctcaaaaacaaaacaagtaaaacaaaaagggtcaggcatttggcagggatggaccccagtagaatcttctgatcccagtgccgtgacatagggtccccagagcagatgggctgggttcagataacggaaggccacacaagattctagaattgtcagcagagggaggagttgcctgacagcagcagattccagggagggcccggatgaacctccaacaggaatgctgattccgttctgcctttgatctcctgatttcaaaagaacttgaagtaacttgaacctggctgccatctgcccaggcatagatgtgtgccaggaggcaggtctgcctcttagttgctatgaaatagtttgcccaacttggatgctacgtttctttagaaaatcttcaagctatcacacgtgaataggcttctgatcgaataagcccagggcttcggtggatggggcatggctggcagcagggccagcgtggccctgtccttttggtcctctgtggcagggacccaggaagcagtacccaagggctggaaccagcgtgaccgaggagaactctcccctggccagggcctagctctcaaacaccagattctggggtggacttagatcctacaaacgcaggccactgaggccagggtaccaatgtattcatttgacaggaaaaaaggggatactttggaggtgcagataatgcatcctcactgtacaggtcggggcatgagagcagaatgagggtcattcgaaggatagagtgtctgtttactgttttatctgctgagaagcagattcccattttgccagcacctgtgtgtagcctggactctggaactaaactctctggtctgaggggtggagggggtcaaatcttggtgaggaacagttgcatggctctgctcactgacctctgttgggccttagtttgctcatctgtaaaacgggagtgagaagttgcagttatgggcgtgtgacaccttcccagtcacgctcctatgcagggagatgtggctctggcatacagaagctgaactcacagtgatggtgacagaggctggaggctggggggcttgcagtgtctgtatccagttggctccagggatggccccacccctgtcctcacctcggtgtgattttaggggccacagtctgttcctgttttttcttagctggtttgagttgggttttgagagtcctaaaacccacccaagatggccctaggtacctgccctctgtggggtacattgctccagtgggactgcaggctttggggctccccgttagcaccccaactgctcccggctcctggctgtcactcggtgaagtttgccacggcttcccctgttggtggcgtttttcctgtgcctgactgactaggtaccctcctaactcctaactaaacataggttttctttttctatgctttagtagttatttctcataacaaaaatatgctctcagtgtcacagttatttttaataaatgtatctttccagactgttctctgtgcatgtgcataatattttagcctcagatgggttcctcatgggcaccttcttaaggtgtcattgcctgtagtcgcctcggtggcactggacctctttagagtggctttgcttctttacagggtttcattattttttttaaaaagttttattgaaatgaagttcacataacatataatttaccattttgaaatgtcacaattctgtgctgtatagaatattcacaaagttgtgcaaccaccacctcttatcacatctccagaacattttttcaaccctaaagggcacccattagcagtcgctgcccctccttcccgcccctgacaaccactgctctgctttcggtttctatggattcctatggatttgtgtatcctggacatgacttataaatggaaccatacaataggtggcctttggtgactgtcttgttttcactgcagactgtttccagggttcatccacgtggcagcatgtgtcaaaatcccattcctttttatggctgcataatattccattgtatggctatgttacattttgtttacactttcattcgttgatggacatttgggtcgttgccaccttctggctgttgtgactggtgctactaggattcatgtatttgatggtctaattctgttctaagagctgtcttctctcatttccaagttcttggagagatccctggcttttgattccttctcctccaccccatgcctatccccaggattttatgaatctcccaggaggtagggcttggtatgttgttgaactcactgttggcatggaccagcaagggtcgctgtcacataaaggcctgtgttaggtgccatccgcctgcagatccccctgggtgttaacacaggactgcgaggaagcactgcttgtggagagcaggatagtcaacaacagacctaggccaggtgtttgcccaggtgtcacacaggaggcttgctgtggaaaggcagcttcctgggcatgccctgtgctggccatgtctgtctgtctgtctgtctgtccctcccagccctgctgtgctgttggcccagggagtggtctgaattggctgtaccccagggggctcccctgacttctggcttgcggtggagagggaggtgtcaggggagcccctcgcctggggctcactccggctcccctgactgggggtccctgtctcccccaggttccagtggaggcttcccccttccccacttccctggcgtcacttcccccaggggtcccttcactgttgtaaattgtccctttcctgttggggccttgagtgatgtctcagccctactgagtgaagatctccaaggcaggcccagaacctgcattttaacaaatcttcccctgacaccttgagcccctcagagctgctgaacccccgcctccgccaccctgcttagttgttgatcttggcttcctcgtgtccaggctacaggctgacctctcttgtgcttctgcctttcagagcttcaaaggaagcacatgtttgctgaaccctcccagggatccaggctttgcaggtttcacacacatcttacaaaatgcagtgggggcagaacgagaggagagccagagcatgctggctttgggaggggtggcccattgtaaacaagccagccctggccgtcccagggtcccaggcaggctggcttggttgggtctacacacagccaagcactcttagctcctgcaattggaatcccgctcttgcgtgcccgcctgtgttcctggctgtgggaggcgccagagggaggttttgatccctgggggagtaggaagccggcccagcccctgcagctgtctggccccagccactaatcctgggcaggagccgcctgtcctggcatggtgctgggctggctggagtggagtgacctgagaatggggcctgctttgtacccagagcacacgccggccacggcttttacgacctagcgagcaggacgggaaaaggccagcaggtgggagatgggagtcagccttggtctcctttgtctttgcgggctttgttccgcgaggattttttctttcctgcccttttcctttgggctgagcgtgagtgtgttcagaaaatctcagagcggccacttgctgccccagggggtatcatacgcatcatgggtttggtcaagagtggatccatcaaaaatctgtggggtagcattttttaggaaacgaagcatagtgccttttattcctaatggatttttagctgtgatataaaagcactcccggaaagaagccagcggatgaaggtcccgatggtgctgggctggctgcaggcgggaccacaggactctcagaagcagagggcctgtgctcccaagggcctgtgctctcaggggcctgtgctctcaggagtctgtggactcaggggcccccctcgctctgctttgccaggggccacccagcctagatttctgctgggccagcaccccttgggctctccgatgagactggcaaggccaagcatgtgaggcctgttcccaaatggaagcgtccgtctgtactactgcacggctgccaagaccctccagctctgaccctccatctgggttttgcctggggattcaaagaggggctgggttaggggagataaagggagggggactagggcaggacctccgtgacagcagcaacatggctgatgcacctggtgtttagtgaagaagattgggggtgccacgccgcatctgtgtgtccttagacaagttcattccccaaatccattccatttcctctactcatcggatctgcttcagagacttaaacgagctgacggaacatttagcacagggcctggccacgggtaaaggatgtcatcttcccccggtcagaatggaaatgaattccatttcctagggtcgggtgagcccacacctgtgaaatcaagtagaggggagggaggggagggagtggaggcagttgagtgggagagtccaggtgagacaggtgagtccctgcaggaaggcaggagcaggaggcacagaggggagctggtcagagatgtcagagatggagagatggcaggtggggtccagagcagctcctccctgcttcctccaggttgcagtggagaccaaatggcctgaaaagccccagatactgactctctgatcctttaccacagagcttctcacctggggcgaccttgcctctcccagccccccagggacacttggcaatgtctggagatttgtgattgtcaccacgcagggaggagggaggaggttccaaccggcatggagtgggtagagcctgaggacgctgctgcagatcgtgcagtgcccaggacagcccacacaaagatggatccggccccaaatgtcagcagtgataaggtggagaaatggttttccagagagtttgctgtttcacctagagaattgattgactggttttggaggaaggaggaatttaggatgagggatttctgggcgctgccagttgctaagtggggaagaagagaccaggcgtgcagtgcttgagaggctgcggccatcctgagcccgggctgcggccatcctgagcccgtgggggcagttatgggtagtgctgaggaggcagggtagagacacggtttggccatcagcagagatgcccctagccatgcccagggtggactcaggcacccgaggagaatgcgccagcgaggagaccagcagagcagggatgggcaccggagaggttggacgtcaagggcagtcaggggaggagaccctctgaaggaggccaagaaggaccagccgttgggggtggaggatgccgcgtgagctgcacccctgtgggaaagggagagtcgcagctgggtggcttggaggtttcagagctgtcaggaaagctgccctgggacttggccctctgtgtggccttcctctccagactgggtgggaacagtgtcgtgagccattaggtgggatctggtgcccggagaggtgtggcacagcttgaggggccaccgcaggatgtgtataagctgaaaggaaggaggcctgtttgccaccctgacctcccagctcagccagcctgaagccctgggttgggacagccccttggtgggagggaggccctttgatgcagctggggctctgtggtcgcctggcatgagctctgggctgcagcctccctgcagggcccaggagggccagagagaaaacgccaggaagaaccagccgaggcctactcaggaaccatggcgaaataaagcaggaggcggagaacgcttgaggtgctacctcttgtaccgcttctccttgtaggtggttattttctcctcattctctttttggtaccctttgtgtagaataatgctccttaggtactttctagttggagacaagaaagaagcttctccaagctccccttggttctggcagtgtcctctggctctggatcactcttggtgccctttccaagcacctctccctactcgctgtaaaaactccaaggcaaacaagctgtgaattatcaaaaggccaccggcctctggtgaactcattctcccgctaggaaacctgttgggtaggttttgttctattttatctccacctggtatgggcttgtagcagaggccctactgaaaaacggggtgattcacacactttgctcatttatgctttgctttaaaaaagaaagcaatgggagcagctggctgctgcctgcctgtttttgtctgactgtcctgtaagctctaccacaccagcacaacaccggggttccagctggcttacaggggctgggctgacatttgcccaagggacaggtggacggacagcttgtgttctctgggattgtctagaaatcagctgatttgcataagaatgtttccccatagctgagagcttaatgttcatcactgacccattggtgagtttgttgaaatagagatggttccgggtagaatatacttgcctcctagcacctgaaggactattacttgggataaccaggcttcccagagtgctctctgggccctcctgctgcccagctcccctctgagctctgcaggtgccatccggcctgcagtgtgtgtctgtctgccgtgggcctccactctgcaaaggcagttgtcccctccacttccaaggaacaaaactcagaggctcgctccagtatggtgggatggttgaaaggaccaaagtgtcactgaatgagccagagataagaggatcttaaaggagagtttgggagaggggccgtggtgtggtgtgcctgggaccctggaggacggagctcctaggtcattgtgtctaagagtgctttggggattcagctccttccgttggcctccattatttcttggcttctctgttgtgtctcttctctctctccttggcctctttctgcatctgtgtctgctctttgctagccggcctgcctttggtggtaactgttctctggggtcttgcccttgactcttgcctccttcccatatccttgatctggatctctctatggatctctccccaaatgtctattccagatctaatcaagatttacctctcactgccagagccatgtgtttgctcctcacgtgggtaccctatgttggcatgtccaggagaaaaccctctaccttcctttttctccatgctgcccacattcagcctattttggagatcccagctaagagcgtctttgtggtttccgctcgccacctccatgtcacccccaggaccttcctcttgctcctgggaaagtgtgttagtctctcctctcctcaaaccttccctgccgtggtatagatgctcagtcacctccttctggtgagtgctggagcttcctggagggtcttttttcagggttacctcctgcttgtctacccttcgtcccatccccgggatcccccaaactactgagggtgtatcatcccctccttggcagcctgacttgcagattagagacccctccccatggtgcacacggcccctatggctcccaccccaggttttctccataaaccttgagccagtataccttcatgcaccagaaatgatgggtgtttctgtgagccccctttgctctgtccctgggcccaccccacttcatctccagttgcctgtctgagtcctgtggcactgacctcccgtgctgggcccagcctgcttcatggggaggcccgcagggcaagatgcacacagtaggccccagaactactcggtccagctgtttggtggctggaaaaccttggacaagaggcttggcttctctgcatctcggtttcctcatttgtgaaatagaggtcataatccttatctgtctcatagggcacttgtgatacacaaatgaattaacacattgaaagcttttagaatggtgcctgacacacacccagcagccaatgaatgttgcagggcatactggttccctagggctgctgtaacacagtgccaaggactgcgtgccttaaagcagaaacacattctcacagtctggaggctggagcctgaaagcaagatgttggcagtactgtgtctctccaaagactctaggagaacccttccccgctctccaaggacaacccttcctccctctcctaggagaacccttcctccctctcctaggagaaaccttcctccctcttctagaacccttcctccctctcctaggagaacccttcctccctctcctaggagaaaccttcctccctcttctagaacccttcctccctctcctaggagagcccttcctccctcttctaggagaaccctttctctctctcctagaacccttcttccctcttctaggagaacccttcctgtctctcctagaacccttcctccctctcctgaaacccttcctccctcttctaggagaaaccttcctccctctcctaggagaacccttcctccctcttctagaacccttccttactctcctaggagaacccttcctccctctcctaggagaacccttcctccctctcctaggagaacccttcctccctctcctaggagaacccttcctccctctcctagaacccttcctctctctcctaggagaacccttcctctctctcctagcttctggtggtttttggcagtcttcgttagcttaaagccacgttccttcaaaaaatatctgccttcattgttatgtggccctcttctgtctgtgtctctgtactggatttaaatttccctcttataaggacaccagtgattggagttagagcccatcctaattccgtatgacctcatcttaacttcgtcacatctgcaaagactgtatttccaaatatggtaaaatgtacaggtaccaggagttaggacttgaacacatcttttggggtgactcagttccacccataacagtggctctcgctgtcttccctggatcgtagtctctatgatagctctcatctgtgtctttgtcatttccgtaaacctgctgagaacagcgacagtcttgcttttctttgtattcctggcaaaggctcagtacctgtgtatttagtgaatgtccttcctctcgacttacattaaggaagactccagttctgataactctctgtttgtcagaacatatgcctgtaccagctggaaatgagaaggatatgagcataagaagtcttgcttttgggaagcagccccattcatatacaaggagatggatgggagccaccctgaagccctccttgcagttgattagtgtccgttgagcggttgctgctgcattccaggctctgggtgggggatgggattctgagagacaggcatagcccttgctgacccggagcacacagcttggctggagagacacacaattcaataagctgttacaataaagtgattaggtcctattatagggaaagcatggggctggtgcccgcacactcagtgtggatgcagggagcagcttattggtttaaacactctggcatcttccctccagctgctcatgaatgttacggggcgctgacagtggctcagggtactggcagggacagccagcccagaggagacacaagaacggcaactgggatgggaagcgccctgacctcggcagaccatccctggggtccctgctgcacacagcacagttcagtgattgacagccacagccagtgacccagcgtcttcaccccacagacaggtcattgctgaccaggctccacttacacaggttgagaagggtggtggctacaaatgtgtcctgtaacgttctataaatgggagccgaggggacgcctgagttgtctgccaagttttcttcctggttgtcatgtttggatcattgtacatcccacctaaagaaagcacaccctgtgtctgagtggggacaataaccagccgcaccgcaagggagggctcttccttttactgccgggtgacctgtgtgcctgcaggcctggcctgaccccaagcctcgctcatagttccctcctttcacctgcctggccggctgggctgcagtgcctgcagggtgcaacagctcttgctatcacccaccttactcctcggagtgcattacgcacatctaaccctaaaatgcgtttccatctcggagtgcattacgcacttctaaccccaacatgcatttccaactcatgccgtgccattgtcccaacttagtccccactgtggtccaaggagcaggaggaaggagacagggatgagtttttaatattttaccaaggatcaggtgagaaagccaaggaccacaccagatgagtgcacaggcctccaggagcagggctggcctttctgcgcctaggctgtggggctggaggccggacgccgaatgtgcacgctccctaaatgcagatggtgacacagcttttctcccaggctgtggaaatttcagcccactcacaataaaaagaaatgtttccaaaacagcctttctgttccctggtcttttcccagaatgaatcttgcatcagcagaggtgagattcagttgtgagagaagacacattaaaaccctaagtgctgactcgcaaggcacatctggccagcgtgggaagggaggaggtcttcaggcctccgctgtccgagtggctttctccctggcctgtgtggttcgctgccagcccttcctcccttctgtgcagaaggtccagcccgtgttccccacaatcacgcaggaaccttgtgtatggagctgttcccccttctccagttgtctccggtgtctgggcagtccatgtgcttcccagcactcctgcaggctggggtctcccgcccttggctggttttcactcagctcctaccagctgctggaaatttctccttggagtttgatcttagagctgtgactagggatgggcactcatttgcattagtaattattttgttagttggtgcatataccgctgcagacgagttgggccccaccaggaggaacttgattttctggggagatcaacactgcctcaagagctcccaatgtaactgttggactgagggtaagggggttttgcctgcagtcgcttccagggtctccgttctgctctgtccttttattcccaagcctctccccccattttctaatggtttgagcgcattcctagttaattgcaatgttcagatagttccagtatcttagtgaaagttagtgtgaaagccccagtgatttggttgccatcaagaaatgcctttgcccagggtcacctggtgagtaagcggagtgtgaagattaacctctttgtgcctcagtttcctcagctataaaacagaatgataatattaaccccctcctaggattgatttcagatgcaaatgattactactatctaccatatataaacaatgtacttatagaatatatgtgtattatgtactattgttttctataaaattgttatttactaaaaggtttatcataatattattagctattaaagtatatgttaatcaacttaaaaaaaaaagaaatgcctttgcgtggctcttacggtgacatagcaggattttataaattgcacggtggatatagaggtgtaattacccgttgcctgccgacatcagcctgatccttcaggaatgtttggcgagcaggatcgggcgatgccggatactttgggctcttaggaaagtccactcagcgagcgtggaggctggccgagttttgtggtggaggcctcgtccctctttttggggagcttaccctctgtgtgctcttggagtctgcattgtgttagatgttggaggcgctggggaagaagtgcccacatggcattgggggaaatgagttctgagaataggggtgtgtcccagccttctcagttttagcctttagggaaatgtttgtttcctggggccaccataacaaagcaccaccagccaggtgtcttccccgtggacatctattctcagttcgggaagcctgatgtccacaatcaagtgtcagcagagctgttcctcccgaggctgtgagggagaatctgtcccattctccgctcctggcttccactccttggcatcccttcttggcttgcggttggtcaccttctcaccgggtcttcacatcacctttccttgtttgcatctctctgtgtccacatttcctctttgtataaatgaggatgccagtcctattggattagggccccccagtcacttcatcttaacttgatcatctgcaaagaccttctttccaaagacagtcacatttacagctactggggatgaggacttcagcatctttagaagggacaaagtgtaataaaacaatgggaacatagtgacttctcagtattatcctctccctgacctggtggcatttaggttttagccaaaaggtgcttgctcacaagcatttctgtgttatcctttaaccccttgtttgggccttaaatggctcaaacaaatgcaaataaggtgcagtgaatattgctaaaccttcactatgcgcagcccatagttgccacagctgtcagtggaggtaaaatttagtaattgatcagtagttaataaagaaatcatactacccaatttaatgaagcacctgttaacccaatctggtgtaattctttgcattccagaccacagtggaacacttgggaagcagcaaggctgagtaaaaataagagtatgtcaaacaaactttcacagactttgagctattattgaggaaaaatgtagggcctgggtgtgagctgggtcacgatgaacctctgcagaaggctcaacttctaacctctgcagagcatgccccaggcctgtgccacattatctcacatgggagccctcgctgctgttgtccctccctatggtcgatggggacagtgaggcacagaggtcagcgacttccccagatcatgtgactgataactgcagtgcttaggcatgactgcagggctctgtggggaatgcaaggatggtttgagtccagtgttagcctgaaggaccagcagtgagagggtttcagtgactgtgatgggtacagctcactctggtgagccagcgtttcccaggcgggtagaggaaggttgggaagaaagaggctgtgggcaggttcttgaagatctgagtggtggggttggccagaggatggggctggctgagaacagataaaggtgtgaaccatctgggaggctggttatttaatgtggtgcccagcctgtctcaagagtaacacgtcatccagggaagctccctctcaggtgtcctcctgcatggtattgccagaaagagaccacagccatgggcgccttgctagttgatcttgagagtggctgagctgggtcagtatgagaaaggtgcaaacgatgggcctcgtggggtcccctgtgctcatcagcatcagtcacatgggggtacgtggcagagatttgggggacacacatttggctgggattaagaagctcagattaaagcgatagttctgggagagttgcttccccacccagggatattaaataatgtctggagacatctttagatgtcacagcaaggggtggggggtggggggaggagaagtgaggggagaggggtagttaaggtggccactgcactgggcccaggggagcttgctgtgatggacgtaaccacatggacagagacctgggccaaaaacacgaggcacatctgaggaatgaaagtaagaggtgctttgttttctgctgcttctgtgtaagaagggatttggaaggccaggcaattttcctgtaagtcacctgagcatgtgttgtactgggtgtgctgcggtgttgtacttagaaagggaacactttcctctgtgactggaagtgtctggtgatgctgaatgctaagctgggcctggggagttgaccgccctcagcaccaccgcccattcactcgtcctttcttttcttttcttttttttctttttgagacagagtctcactctgtcaccaggctggagtacagtggcgtaatctcggctcactgcaacctctgccctcgtgagttcaagcgattctcctgcctcagcctcccaagtagctgggactacaggcgcacaccaccatgctcagctaatttttttgtatttttattagagatggggtttcaccatgttggccaggatggtctcgatcttctgacttcatgatccacccacctcggcctcccgaagtgctgggataacaggtgtgagccacctcaactcatcttttcattcacccttctatctgtctgtgcatccaaccatccatccatccatccatcccttccgagctaatgcagagatgcgggtttctgtctatgggggatggggatgccacttgacacttcccttgagagcaaaacacgttgacttcagaagatacagggaacacagagaaaattacaagcaacaacataaatcacccagatctcactttcggcagcgagtttctgtttgcctttcttttttttttttttttttttttttggtatatagccttctcatgtacccaaagaaaattgagactatgctatactattgtttggtaaaatactttaagacttaatatattcacatttctcgtattttaaaatcctctcctggctgggtgagatccagcactttaggaggccaaggtgggtggatcacgaggtcaggagttcaagaccagcctggccaagatggtgaaacctgtctctactaaaaatacaaaaattagccaagtgtggtggtgggcacctgtaatcccagctacttgggaggctgagccagagaattgcttgaacccaagaggcagaggttgcagtgagctgagatcgtgccactgcactccaacctgggcaacagagcgagactcagtctcaaaaaaaaaaaaaaaaaagaaatcctttcctaagccatattaatggctgcttggcattctgtcatccatagatcagactttaattaatcagtttcaccgtcatctgtggggttatcttgagcttttgtgtctggcttcccatctgtcttctcaggatgagtgactgggcataagttgctttatcgacatgagtgagcattgatatttctgcacacgtgcttatctctcctgccctccaggggcccagtgtcattcactgggtgccgtgtgtcaggccccctcccctgctttttcatatgggtgtagtgttatcagcattaaaatccctctcaggaaattagaggcagtgccacattaaatctgtaatgaattattttagaatgttggttttaggttgaacgacatcaaatggttgatattcaaccagtttttttggttcttcctgaaacgcagcaagactcttggtgggtccactggagcagaaagcactgtaggtacctagtgtcttgggtcctatcaacaccacctacataaacattctgtacggaagtgagacacaggccctaattctggggccctggcagatctccatggcccagggtgagcgggggcagacgagagcttacagggtcttggattacctgtgttcaagggtctaagtggcttatggtgtagccaaacccttggtgtggggcagggaggttgcaggaggaagaaagttggatgaggtgattgtttccatgtaacttgtatcagaccatggccctgagttcattctacagagtctgggtgcttgctgggagtgaggtgcagttccagaagccaggggattgggcagggggcttggtagagcaataaatcaaacaaaacagcagtccctgtgcctattttagtctcgtggggtacgggtacaggctgtccctcccaggccagtgtgcaatagccaggttcaggcctctgggcaggtgaataggaaaagctgccacttccctcttaaacaccaatgttagttaccacagcatctagcatgcttctggcataagcttgccttcagggaggctttattgaataggtaaatcattcttccacccctccatgatctttgcaagcaaacattcctgaaagttttgagcaaaaaagataggtattattacgagtaatttagatgactgttgtttccacagtgaagtacttctgggagaaagggaggcaggactggggtgctctgggggtcccctttggtgtgcaatgctgcctttgggttccagttacttttttaaacccattttcctgagtgactgagtcatacctggtgttgttctgggaatcggggcacatctgggaacggagtttgttcacggagcttaccttccagagggagccaggaaatagacaagacctaaagacaaagctgattgaggtaagtcatgtgccctcaagaaaacagcaaaacccgctgagcagggctgcagtggcgagtggtcagatagacctttctggagcagtgacactggcctgagatctgggtggcaaaagttatcagccaagtgacgttctggagcagtgcttgcctgccagagggaacagctagtgcaagggtcctggggcaggaacagttccgttgtgcaccaggaaggagcaaagtcaggcagggcctcggggcctagtcaagaggtgaaattttgttctgaatgcagcgagatgcccttggagagacttaatttgcagggtgccctaaggagaatggttttgttggtgggtgggtggagggagtggaaccagggagcccaggagggcgctgcagggcactcaggtgagtgatggtgcacacagccgggagcaggtaatagagagaggagatcagactggaatacactggcgatcacactgactggacacagtgggctggattgggggcagaagaaagggagagatgcagggaaagcctcttgtgtgaggatgatgggcttgacggtgggaagggcgaattttttttttttttttttttgagatggagtttcgattttgttgcccaggctagagtgcaatggcgcgatctcagctcactgccacctccgcctcctatgttcaagcgattctcctgcctcagcctcctgagtagctgggattacaggcatgcaccaccacacctggctaattttttacttttagtggagatggggtttcaccatgttggtcagtctggtctcgaactcctgacctcaggtgatctgcccgcctcagcctcttaaagtgctggcattacaggtgtgagccaccacgcctggccagggaagggtgagttctattgtcaccactgtttctgctgctgctaccttctcaatctagaaggtggtccattccattcctccttttccagatgagagatctgaggccagagttcccaaactatactctaaagattcttaaaaaaaaaaaaaaaaaaaaaaatctttaaaagagacaaaagcaagttacatgttctatatggaaatgtttttgtaaatgatatttgaattgattattgatcagattatgagaaagaaactcaagctggagcttgtggaccccccgagggagagccaccgaatctaggaagattcttctttgcgacataagagaaagaacgggaaaggcagtgaaacagacaccactgagctgggcagactctggcttgccctgaagcaggtttgtaggaatgggtgtctttaaaacaagattttagttactgaattgaaaatgcctagatatagaaataagtgacttcttgaccaggttcagtaactcatgcctataatcccagcactttgggaggccaaggcagcagatcacttgaggtcaggagttcaggatcagcctggacagcatggtgaaaccctgtctctgccaaaaaatacaaaaattagccaggcgtggtggcgcgtgcctgtaatcccatctactcaggagacaggggcaggagaattgcttgaacccaggaagcagaggttgcagtgagccgaaattgtaccactgcactctagcctgggtgacagagcaagaccctgtctggaaaaaaaagagcagaaaaaataagtgacttctcttttgcagcaataatctcctgaaaatataatcggaaaaggagacggcattcatggcgatgacaacatccaaacccaaatttaaaatatcataatgtattaaaaatgttttctgcaaagaaaacattttgagtcctcttccgactactgctgttactactacagctagtagttgttggtggtagtgctggtgttacccaacagttataacatcaaccctagaagaagtgctttttgtgtacctattatctcattgtgttttcattgtttccattttgcagctaaggagtcctttcaagggcaagtgatttttgtcctgagcctcccagctggtgattggtagtgccaaggccccaagtccatcagccagactctaggcagagtgtcccaccctcataatcttgacaccagggaggggcaaactgtagtctgcctcctattttttataaatacatttttgttggaacatgatcctactcatttatttgtatcatctacagctttttttggaccacaagggcagagctgagtctttgtgacagagaatatatggccccacaaagcttaatttactctctgtccctttacaggaaaagtttggccgtctctgccctacactgctctgggactcatatctaaatcaatggggacccaaccacatttgtggaagaaaagatggaatagtataaagatgtcacttcttgtaaagcagtacccaggaaatcccagtgggaatatgtttttgcacaaatgagatggtgggagacattttattaaattattctaaagtttatttggaagagggccgggtgtagtggctcactcctgtaatcccagcattttgggaggctgaggcatgtggatcacttgaggtcaggagtttgagaccagcctggccagcatggtgaaaccctgtctctactaaaaaaaaaaatacaaaaaatattagccagatatggtggcacatgcctgtaatcccagttaggaggctgaggcaggagaatcccttgaacttaggaggcagaggttgcagtgagccaagatcatgccactgtgctctagcctgggtgaaagagtgagactttgtctccaaaaaaaaaaaaaaaaatgataataataaagtttatttggaagaaaaaaaaggtaaaaataactgatgggactttgaaatagaatagtgcatagaagccagaccttccatgtagtccaacacagcagaactatcatggttaaataaaggttgatattgtggtaaatataggcaaactaatgacacagaacagccccgattcagaccctagtgtctgtacacatttaaaaatgcattaagatgacatcacatgagtcagaaggggacaaattgttcaggaattcatgcaggagtaattgctcatctgtttgctagttaattttgtaacatccctccccgagaagcaaaataaattctttgtacattaatgtcagtccacaaaccttttatttttaagtaaaggaaaatagatgtgaatgtttattgaatttgtcatcaagggaggcctttctgtgcatcaaggggaaatgacaaaggaaagattgatatgattaaataattgagactttatcaaattaccaaatggattagtgcaagcaagcacagagtgggggagatatttgcagccgacctgctgagattttaggatgtaattgagcagaaggtgcaaaatgataatccacaaggtaggacataagaagtagttgctacttggccgggtgtggtggctcacacttgtgatcccagcagtttcggaggccgaggcgggcagatcacttgaggtcaggggtttgagaccagcctggccaacatggtgaaaacccgtctctaataaaatacaaaaattagccaggtgtggtggcgcacacctgtggtcccagctactagggaggtggaggcggcagtgagccaagatcgtgccactgcattccagcctgggcgacagagcgagactctgtctccaaaaaaaaaaagtagtagttgatacttgaactatttctgactaatggtcaaaggagggtggattgaaatgttgaaagcgggtgaatcgagacattgacggcccatcccctcgttgtcagataagcaaggcttttcttgacctgctagttaggggtgagaactggacacccgccgctgttgagaggatggattgtcacagtcttccaggactgcttttggcaacccttcctactctacttgaaagcagtcctaagaaaataacccaaaatatggagtatgattagatacaaagatgatcactgctgtgccacttacactagcaaaaatgtggcagtcttgctgggaggagcagggtcagggtggtgctccctctgcagagttgcagttggggcctgatgggtctggttgggccccactccttgaccttgtccctcctcacatctttctagccagtagcccatgtctcctacttagtggagtaataaggccaggagaaataggtgtacctttattttcatgtaacggcaaaatgactttccccaaatcacagagctggagttgggaatcctggagttagatccaccaggattagtacacaattagaggtgctcagtcaagtatctgagagcgtccagaatcagctcagctggcctccttttcacttgctcgtagcatggccttacaaagttgcaaagacctgctggaatcaaggcctcatatttcagaataataatgggaattcaggctgggcacggtggctcacacctatactctcagcactttgagaggctgaggcgggtggatcacctgaggtcaggagttcaagaccagcctggccaacatagtgaaaccctgtctgtatttaaaatacaaaaaaataactggacatggtggtggagacctgtaatcccagctacttgggaggctgaggcaggaaattgcctgaacccgggtggtgggggttgcagtgagccgagatcgcatcactgcactccagcctgggtgacacagtgagactccatctcgggcggtggggtggggggtgagaagaatggaaattcattttataaaaagcgtttttgattgtagaaaaatcttaggaaaattaagaaaattttgaagaggaaaagagctctccatacacttgctacctagagataaagttagcattcagtgtggaatttactcttctttttctataaaaggtatttttttgaaaacaaagtagaagattttattatacaatctgtggatttaaatttttaaatattatgttgtatggattttccattctattaaatagcctaagaagaattgtaatggctgcacagctgtttctggagattcggtgccctcaagctctgtgtgaggaactaggttgctcccatctccatgtcaccaagcactttatctacgtctttgatttcctaaagacgggtatattgagggacagtgggaggggaggagggacaggaattctgtcccctctcattttcttaataaatattggtcaaggatggatttttcattgcttttttgctctagatatctcgattagtaattgatggacatgtgagctcttcagtaaggaaattcattcattcattcacaaattgtactcattgcttagaggccagattcttgataaactggtggttaaaactgcagttgctccctttctttgtggctgaaggtctggctgagaggcagaggctaaaacaataaactaacgagtgacaccttgcaaagtcatctctcctaagcgacgccctgagggcccatccacagtttgcatgcatggggttggcaggtcaggcatcctggggtgtgttggcgctttttcagcagatccactgggtgggctttgctttctgcttgtggctttttgcaacgactgtggcatcctcatggctgctttggcttcagggctccactcacgtcctcacagtatgaaattccttgagcctcagacatggcatgtgtgtgtcactaatgagaactgttggtagaatcaggaacagtattaaaccctagaagccgcctccccctctccagcctcttcagatccagcattttcatcagggaaagcccctttcaataaaagtgaggcctcagttttctcatctgtaagatgtatgtgtggggctggctagctctgcggttttcagaatggcacctaagatgcactttaaaacattcctttgagttaatgtgtactagaaaagatctatcaagttgtaaaaagcgggttgattgataaagaagtattaataacagttgatttttttttaaagaagatggtaagtcagtgagtagtgtttggagggcacaaatccttccagtgccgaagctttgcggtcttaagtggcaggtgggagccgggagtctgagtacaaccctctggccagccccagtcaaatgaatgggcctctctgcttgctgctcttaaaacgtcttcagagatagttgcactttttatttctggtcactggctggggaccagagcttggaagtatttctggtctgggctgatcacagggtcctgcttcacagcctgtttgctgtcagccatctgacacgggcgggccagccttcccatgtgattcaagggggctgacagcagcccattgccacaaatgtctgcctaaaccccaggcttgatgagcacttgacaggtacacactggtgtgtctgtgagctcttcatgattctcagcggcagggtgagggcggggaaggaagatgtaggtgaagagctttgacccaggagcgcactagggaagcgagccaaggtgtctgcggacttccagtcccatccacacccagaagacatggtgggggcccccacccctctcctgtggcattggtttcatgtgtgtgtctttccagcttaatgataagcagccgagggaaggtccgggtcctgctttcccttgtgtatttactggtcctgaatgcacgtgatgctgaattaatgtctgagcgcaacagtcatccgtgccacagatggcaccaagcaccaagcttcggaggcccccgcagtctgtgggagacaatccaagcttgggctgggcactgcgctcaatgctggaaaattataaagacagagcagccaagtcaccagctttcaaggaaacgagtgtagttagggaactaagaaaaaataacaagcacgatgaacagtgcgatgcctgggataaaagcagtaaatgcctagagatgatgacgggtgtccaggagagctaggaaaagaggtggacttccatttgcaaaggcaaaggcactgtttcagggggtcattctccaatcggtaggttttgatgttatagaaatggggagccctgttgggtcttcaagaaagtgggtgggaagaaaggcacaaggtctggagatgttttggaagaaacagtagctgtgtttggtgagtgcatgggatgtacggaggaaggtgtgaagaatctggaaagcttagaatgtctcccacagactgtgggggcctctgaagagtctgaagtaatggttgctttgaatgcaaggagattctgggatctgtgcagtgtgctgagaacaaccctacagaggggatgggggagggatggggccaggaatagaggaagcagaggagaggggaggcaggaaagggaggaggccaggtaagaagctcaggccttgaagagggattcacacgccctcccctcctcttcctgacctgtcgggggatccccagcctcagatgttctcagtctggccagtgaaaacatctggaatcatgactccagccgcgctagccatctcactttttacaataaaaactgagcaagcaaggaacacctagtgacgactcatggcccttgttttccccgcatctctggagtctgagtcaccagcttggcacccacagttaagccttgaatgtgtgcaagttataacccggtgtctggcacagagaaccttagcgctccttcccctccaggtcttccattcttttgttgatttgtctccaatacgggttccctcaaaaccaactctcttccatttatttctgtccctagttttgagcacagagcctcgttgctagagcctggcactccgtagatgttcactaaggtgacctctgtgcgtagtcccaggtagatgtggcacccaggatatgcccacctttctcaaactcagactggaacgtgtggtcctgccctcgttcctcattttttcaccctgtggcgtggtcttggctctgaataaccgctgctacctcctaaattgaactcagttgtttagggaaatgcacccagaggggcactgtgagtgagtctgatcggctggcgtgcctgtcggtggctgcccatgccttccgatgggccttgctgttttctcccccaggaagaggcagcccgcccgagccccaggcagcatgttcctcctgtgccctgggtgcattaggcgagatcaggcacgttcagggtgatatgacgatagacagtgctccaggagcattaggaaaggttctgctgatcaggcttctgtaacaggcggggcatctgctaaggtggcgggaaaggtttggatttcactgcacctgggctggtcctcgccctgagtcgtagccttgcattccctgccaagccacgcccagaagcatcctgggagggacaccagtcgggtgttgactctacttgggctgttgcccagaccagtcggatcaggactaggaggcagatttccgtgattttgcctttggagtgagagaggaggctggggtgttaaccccgtggtctcctcgtggtcccatcaagtgactctgtgaaagccaggagtccctcccacccaccccaggccccgaaggcttctccactatagcaacggggtccaaagctcggggtgctgggtgtcaggccgtcagtaacaggaggaccgacctgctggggcggaatgtctgtgggttttagggtcctccggaatgcactcttgctcgcggagggagatgagcagatgtgatgagtttccatcgacagagctggtgacagaaattacagagagcaggtggaatctcccgctttttgttttctaacccggaggaaatctgatgaaatcaacatgatactccagaaattatcatcaaacatggagaatgagtcattctaaacagggcacacagggaattggcaggggaggagcaagggcagcatttatgcctcgatcccctccaggccagctgctttccttctgcagcgttcaggttcgtggccgcaggagaacggaggagaacgtgaacagtctgtgcgctcagcctgaggtttccctaagaccttctccgccccagacatgctctcgttaggttggtttttctggattggtttgttctctaattgttccttggggtagatcattggcagaggccacagggagaatattctgtgatctggagtctatgcgtggcgtgacagcagccgtagcggagggggtgtgtgcggcttcttgagtttgccgccggaatctgtcagtgattccttctgtatgcagtgatgttgtctgttcagacgctgccctcttggttcctggggaggagccaagagcagcctcttttgtctctggatgaatcagcctttgcacagaaaaaggaaaaacttatcagttatgagctcaaatgcgccttcctgtcttcctagacctgaccccggctgggaggtgaagaggtgagatggagcctgctcttctagggggtcttgagatccagtggtggctgtcctgcccagggtgggccctgcaactgcaggctgtcctggagaagtgaccactgggacctgctgagtagacggtggtcaagcttgttgggctgtccaggtaaacccgaggtgcccaccaagggaacctgttggtgttttgagaatgtgtggcttaggtttcaggaacagagtagaattcctaaattcagtctcctgagtataatcctatcacatcagccatttggctcccttaaagattatcccagagatacctaccgagttacctctgaaacagtcatctttgttgaaaccgaattcgttcattcattcgggtttgagagccaaccatgcacatgacaggagcagaaaaagacaaacagatggtcttatgtcctgggaatgctcagattctcatggagaaattgggccagggacaagtctgtgcatggtgtgtctagcggtggtaaagggcagagaaagaggatggggtgagggccggttgtgttgacatttgagcaaagacctgaatgaagtgaggggatgagagcatctcgtgtctaggctggggccttctgggctgagagcactgcatgtgcaaaggccccgtggtgggaggggcttggtacctggggaacttcatggagaccagaagagtcaagtggaggaaggcagagaacagcaggaaatgggacaggggctgatgatgttgggcttctagggcactggaagctgctgatgagagcccaggagcctttggagggtttcaaacagagtctggagggtgtctgactgacttttcaaaatgttccggctgctaattgaggggtggactccaggccgcaggcaggcctgctggagaggagctgatgactgtaattgcatcgagagatgacggtggtgtggatgtgctggggagaggtcagccagaggttgtgttctgcaggtggagccaccaggagtgcatgagagagggacggggcagggaagacggagagggatgctgggcttcttggatggctggatggagctgccgtgcatggctgagatgggtgaggccaggggcaggggtttggggcaagctccagagttggctttggatccaggaaattcaagatgcaccttaggtactgaagggagcgcttggtgggcaggtgggtgtctgagtctgaggttcaggaaccacttgttaaaagaatgggaatgcagccatgtccacctgtgctttgagggggctcaggctgcctgggcatttgagttggtggctccttagcagttttcctagccaaggggagatagccacacccacaaacacaccattctctctcatggcacgtgcctgggaaggtagctaatgtatgtttcctaatattttctaatcttaaaaatgttttattgtgcacattttcatacaagtacataattttaggaaagatagcataatgaaccttcgggagctcattataaagtcaatcacagcattgtgccttttactccttttctaataaagcaaggaccagttcacgggtgcggcactcgggatgggcgagtcggatctgaggctctgggccgtgggctctgggctacctgtgctccacagtccatgcactgatgggtcactctaggacctcacagggctgggaatcagcggagctaagagatgaggagagagaagatgggcttcctggaagcttgggtgaggttgaaggaacaatgcagaggtggacggtgttgggccagctggagacacagcaagttccagcgaatgtggccagtgattgattgaagggttgagatcggcaatatgtaaccctggaggtacaggtggagactgagtagtgggggtcttttcatctcaggccaggggagagcagactgatttttttaaaagcggtgagcactgtccagaagtgttgtagcagggcagcagcatggctttgagaaaatcaagggctcaccagaggtggatggtgaggagcttgaggagctccaggggcccagcagccactggcagcgaaggcctgagcaactctgggcgtgggaagaaatagttagcaagactgggagcagagagtgttttgtcaggctcacatcttggctgcgttaccctgggcaagttgctttagtgatctctccaagcccgttttcatggaatctgtaaagtgcagccaagtctggtacctgctgcctagggcccttgaggacgcagtgggatggtgcctggtggagctatgagcgcagcctgtgctgtaaggggaggacacataaccgtcagcgtccacgtctgttgttagatgccgttagaatccatcgggggaagtgggtgatccaggggagattgagaggttatcacccagaggtggccagtgagcgtggccacaccaggctgagctgggaggaggaggaggggtgggaggggagaggattctgctgtaggaaagaggacagagctgacatcccagtgaggagcacacagggcagccctgggatgctggctgcattctccatcccgtgccagccccctgtagatgcagtggtgtctggaggagcagagcttccctttcagccctcggtgtgactccacctgctcaggaaggttttgggagtggagagccctctgcactcagtccacaccagggctggctgccctctttctgtactgtaaaaacggccccaagggtgcggacagggggcacctctgttactcacccctgaatgtctggatgggtgttacagctacactcaaggatggcctccctctggccctggggaggaagctgtcagtctggggatttacagagcattgaggaccacaggacacacgtctcccacctgctatgtggaggggagggctgcctgtgagtgagctcagtggtgcccgtgggaacatgatggcttctgggccctgggagtgggacttccctgcttggcttctctcggcctgaaaaggggagagggtggcagagtccacagttgttgactcgtcttccttgaatggtttcctctatggggagaggactgcagatctctttctagaactgcaaacactttagctttttgtctcatcactggttcaggggagtggccataccccatcatcaataataaacacacacactggtgcatctccagaaagcacgtgtgcagttctgtgacttctttcttctgctcccagggcgctggaggccatatgtcagtagttttcaaagaaaacgacattgctgcttccatcttgcccttttctacagccagagttctcctcctcaatcggaaagctgcagtggcttcccagggtctcctggacaagactgacccttcaccaccgcgttccgccagcttacctggcctcccgcctttgctgtgggctccaccacagcccctccatccctctagcccctccacacttgcagggccaggtcttcactgtgcccacctgttcttaggccttccacaggcctctgggcctcctccttctcactgaacactcactggcatctcaccctctatgggcagctctctgggccccactaggtggccagtcgtgctctccaggtaacagttcctgttaccgccctaggccccaccagggctggcgatgccctgagcagcctgcgtggagccccagatgcctgatgcccatctctgctgacagctttgcagagccaggacatgcctggaagcttttgggaatgcctccctcttgtgcccagatggactttttgttaaccctccatgaaataattcctcctggcatgaatgtgaaaccaggcaatgctatagtcatgaggcggcgcggtggccgaggtggccgaggcaaccctttcccttctgcaggagagttgtgggcccagtgggaagagcacacattggtgattaacaggagtcttcgtttggccactgtgacccagagcctcacccggcgcagtcctcggagtagctctggactggtgggggtgggagcaccccagtccctgacaggatgggcaggtgggctccagttgccctcacagctgacaccccctgatttttcctcctcctcgggtgcagtcagatggagactctcaggcaggaactgtcaccgtcacacgtgaaaggccacatggcaagtaccagttgtgggctggagattgtcctgaagctcctcccctcacccactcatgggtctcttcattttctttctgcatcgattctcttcagtaaatgatcccgcatttttgtatgggaaggatttttactcctcactcagcctattgaagtcaggctgctctggaggtggccatcactggggtctccacagtggcctccaagcagcccgggggcttgcacacgtggcccttgcatttcggggctgccgggctgcctggctgtggtagggtggtctctcacgtggcggcaagaccccttcatccagctctacacgcaggctgtgcattcagagctacttggtcactgcttctggtagggggcgagggtgctgtgccgtcagcgctgagcctcagcgtgccagaccccagcagaggggtggagtgtggggtggaaggaggcctcctcctggcatgagcaccgtcactgccagccagggagtctcggtccagggcgtccggggttctccccaaggcgtagttctcaggggccgggaatagggaataagcacacagacctgaccgtcgtaacttcatggggaaagatggaaacatctgtgaccacccagtttggggagaacagcttcattccttcctgtgaataactggcctgggtgagtgctggcctccactctgcccctccttacactgctgggtaggagagacggcggggctgggctcaggtaggtgttttttaagggaagggcccccagcagggcagctctgccgctccccagagaggtggccaccatgccctcctctcctgccgcctgctgcattcaagcaccacagccccggtggcccagcaagggaggctcatctctcacggttccagaggccggaagtcaaaagtcaaggctctggccaactctgttcctaggagggccctcttcctggcttcatgtgtcctcacgtggtagagggagagagaacggaagctctctggtgtctcaaataaaggcgctgatctgatcatgaggaccccaccttcatgatctcttctaactctaactactccccactgccccacctgccagtgccatcacattaggggacagaccttcaacataggagtttcgggaaacacagttcagtccgtaacacatgccttctctccagacagcgttcaggtgcagaatgcagccttctgaggccttgagatggaaaggacgcctcccttgagccactatccgccggtcactgggagctgggattgcagcttctgatgcagtggtgacagtggctgagacttggcagggttaaatattgaacacaagatggtccctatagcagcatgtggacacacgccttgctctgctcactgcacaggggctctccaagccatgctcactgcacatggagcctgggggaagagtggggatggtcagggctcccacccggctgctgcagaaacgttgcaaagggtggtgtcagggcctccgggtctctgcatggtaaaggcagcacactgggtcagaagctacattctcagctgtccctggatagaggaattgaggaaaaagggacctcagaccattgtatatgtgcccagttatataggggtgagatttgcctgctcagagctctaagtactgtggccagctgtgaaagtgtctgccagtttctcttggagagcacatgaaattcactgctttgaaatcggctcgctgctgttcctgtcccttctccctggaccctgctgaagggcctgctcagagccagtcacctcattcatatccagaaccccccacatgcttcagtcctgtctgtgcgcccttccagaaaaaaaaagcagaggccttaggggtgattcttgtggtctcttccacggaaagatctttcctgcttagtaacagtggttcagtaaatatgccctggtttcatctgcatacgttgcattgagaataccttatggccgctctgtgttgtgtttagaattgtttatttggggtgcagggggatttcaggagcggattgggtagggagcatcacccttggggcctctgctgggctgtgttcattgatggctgcttcccggggccgagtcaccatgatgactgcccctgcgctgggatcagccactctgaacaagcagaggccgatttttccttttccgagccctgcagctagcagcatgaactgtacagtcctgcgctgtcctcctctttgactgtaatgaatggactggccaggtgctggagcacatttcgcaaacacccttacgcccctaagaagagcaggtgcaaacagccggccagaaaacactgcttgggctgtgtgtgcccagtgtgccaatgagacaagcacaaagtgggcacagaggccaaggagcaagcgctgctctgctctgttgggccaggaaagatgaaatgggtctgtcctcattagaacagcctggaagaaagaggattcccacttcccataaaattaccattgaacccatgtttcgcttgcttaagggacttttttgttcctcctctactttcaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaaggtgagcttctggggaacaggactgtggctaagggagaacgttgggattttcaagttgggatccaagaacttttctgctttaaagattgccagtttagcattcagatagttaaagtttagttctttaaacttcatcatggtaatagatttagccctggaatcatagtcacttgtcttattttttggttcccccttattagtgaaaccccttcttaatacagggtatgtttctttttacttgataaaattcggtgacagtgtggtagggagcttggtggtacagaaacccaggggaacagagagtgtggcaagtagatgaaatattgagaaccactagagaagaaaaaaggtagcttcggggagaggtcagcaaaccttttctccaaacagtctgatgggaaatatttgaagctttgcaggccgtataccatctctgtcacaactattcattgctgcctcgttgcatgaaagcatccatgaagttaagtcattaaatagccagagtcgtgtttccaagacaactttttttttgcagacagccccatttggccccagggccgtgctttaccaacccctgatctagaaggtggttctaaagtttaataaccctgggtctctgggtttctccagtggcctcgtaaaattgagttcatgagaaaacctatcttttggacaccaaggtgaatactagcaggtcattttcttcctgcacatctgccctaacctaggccacgttcagtctctctcacatgctcctttggggcttggcagttgcggtgacagcaccatcatcatcaatatcatcatcccttggctttctcttagctgttgaaactgtcttgcctggagcacagctgaaaagtaggaacttgactttgaccatttgtatcctcggccccagcctaaagtcagtgctaagtaaatgtttcttgaactaaactgctatcccccagataaagttgtaatcctctaccctgatgtacaaaaattatatgcactgtgtttatgtctgtctaattgagtagcttctccttcccctttatcccaaacatcttctccctgcctctgattgatgctggcatccctgggcattgctgtaaatgttctttaaaagaaacgtctagcccgtgtgagattttatttgtaagagagcaacagtgattgggtgttgccataaataactgaagcatttatttttcagattctgttaatggacattttgttttttactttatagcccaactcatcagagtcaaagctggaacttgtgagcataaattgtgtgatttgggcagagtgttaaagtgaggagggcagagtcttaaagtgaggtgaatttttaaaaatgtcagtgggctgggcgcggtggctcacgcctgtaatcccagcactttaggaggccgaggcaggcggatcacgaggtcaggagttcgagaccagcctggccaacatggtgaaaccccgtctctactaaaaatacaaaaaattagccaggcatggtggagcgtgcctgtaatcccagctactcaggaggctgaggcaggagaatcacttgaacccaggaggcagaggttgcagtgagccgagatcacaccactgcactctgagactctatataaaaaataataataataataatgacagtgctctggaggaaatattggctgttatccctaaaagaatccctaatttagaggaggaagacaaacaagacagccttgaacgtgaggaggaggacagcctcaaacatgaaggggagggtgttttgagaatctgaggtggacagaaccatgggatctctggccttgcccagagattctggggaatctacctccgaggcgccacatgtgacccaggcagtttgctagccagaagcttcacgcacatcccagtgatagacagacttcaaggtgggaatttatttcagccaaagtatctgccatgaaaccttctactctgatgaatgttttgcctgcagaagaacgtaggcagacggataggaaatgtattattcagtacattgaacttcctaacacccagggagatttttgtattaaaatcaaggtggctgtgaatctgggtaacactcctcagaattcattaagatagaattcgttagggattctctggcatttgatgggatggaagcccttccccagtgtccccagctgcttggtggcagttgactgatggagggcctcatctagaagggggaatcacacaacagtccacctccctagggttctggaaaggaagagtggggtgatttcccttggctaagcctgatcccttgagtgagatctgtgaccatttctcttccaaggagagtgctgggaattttaagtaaaaccattcttattcttcagttggataaaactgaatgataattctcattgatacattctaggctatgcacaaagcattcttgattgctttggtttcttaattttgaaactactgtaagggaattattctgagggagcataataaggacataacctttgagggattctagcaagattttgatggccggcaagctctatttaattttcatttagttttcatctttatgtgacatttccagtagattgtgtcaaggagataaaatggtttatattcctggagatcatgactagcaaaacagaaatgagagagaagagcttctgtatcctctggcctcagcctgacccacatcaattcttcccacctctccatgaaagccattttctttcacaggttttggttcactcccatctcatattaaataatttgttggttttatgatttttttagagcacaagggcacagccagggggaattcagacactgctttcaccaacaccaggatccaatagcatagattatggcttctctgtgtcgtttacgcatgcacgatgatcattcattccacaaatactcattgagtccccgctacgcgccaggccttgtacgaggcccagggatacaacagcaaacaaaacaggctctaatggtgctgataccctaatggggagatggaggctcctcctgcaaaagaaacacacatacacacacacatacacatatttcatatatatatacacatatatataatatatatataaaggatatatgtattttatatatatattatatataatatatattatatataatatatattatatataatatatatattatatatatatattatatattatatatatattatatatagtatatatattttatatatatatatataatatatatacatatatatatatatatatatatatatatatatatatatatgaggtatgtagagaaggaaaaattcttagttcttggcttgggcccctataacaaaagacattaataagagaaaagcatgcaaacttacttaatatatgttatatgtatattacagatatataatttcttcataaggaaatgaagacttaaagaagtaattaaacctgagggatttgatgaggtgtggagagtcctggaaaaatgagatgggacaagaaaaagcataagcaagtgtcatgagctggaggacagcaaggcctgggcattgcagattccctgtgtccttggagataggatgctctgtcccccacatatagggagggcccctcccacttgagggtctatgacctgcttcagggggcaggcagggagtcctgcctgcacctgcggtttctcaaattcctccagcttaaaatatgtgtggtgctatattttggggtagcatgttctgaacctcatcaggtacatgatgtagtggttggtggtaagagctatggaaaaagataacattggggccaggagatgtctatttcacataacatcctgtgtgtcctcaagttgggtcaagcaatattatgacaagtgccttatctacgtctttgcattttgtcctctccaaagctcattgaggaaatacactttttgtccaccatgagtggagtcttaggctctggagatcacacagtttctaagggctccactcgagtctgggtttagtgatcccagagccgggttctctgagacacccagatagacgggcctgctgtaatttcacaggaggaggtaggtggggcttcaaggcccagggatgctcccagctaagcgcatctctgtaacccagttaatgtaaatgaatagaaactgtctacctgatttcctaacactttcccaaggaagtgtgattatttcctttcaaaggaaaaggaaactggcaggtgattttctggggtcgggggggcaatttgatagaatacgatgactgtggacttcatcacattagaaaagatgtaggtttagtttaactaaaaacggattcctttctttggtcatttgctttggcaacttaaaaaaaaaaaagaaagaaagaaagaaagaaacgtttcctttctttctttcaattgtttattacgggaagccagaatgtcagcagactccgtaagtgaggcagtttgggaggtgggggaggggagtcctggggagaagtatatgtgcttattttcttcagaaagagtgttcttcatcttctgaatatatcttctcatttaatcatatccattatttttcaaaacacaccacttgtttggctgacttatttttgctgtttcatttgccgtctacattggtaacatacagagttcaatggcaggagccatgaattaacttgattcactttttgaagggttggaatttttcagactgcttcaacacttgttcaatgatagtatgagctatgactaggcataatctctcattttcaaggtatgtagacagtctgttttcatgttgtgattttgaatgataatttaaaagaggttgggccaggcgcagtggctcacaccagtaatcccatcattttgggaggctgaggcgggaggatcacttgaggtcaggagtttgagaccagcctggtcaacatgatgaaaccccatttctactaaaaatacaaaaattagccaggcatggtggcacacacctgtaatctcagctactttggaggctgaggcaggagaatcacttgaatctgagcggctgaggttgcagtgagctgagatcatgtcaatacatgccagcctgggtggcggagtgagacactgtctcataaataaataaataaataagtaaaataagaataaaagaggttggaaggaactgacttcagaattcttactttatctgaggaaacagtttggtgaggaacaggttgagtttggaaatttaagaagcaggttgagggaagctttccatccagaggcagagcttggaatcagctcatacatgtcattgcgggagtttttggaatctgttcatttccagtccctgatcacatgcagtggtcacctaactcaccgtgtcaccgtgttttctaagttaatcacattcagtttctctttgtatctagtagcagttcttttaagaagaattttaacgttgcccaaaatgagatgtttagggcgtagggcatgttaaatattccattgcactgatttgcctttctgtgagtgatggagaggctcctctgtggtctttctgccggacataggctgtcgattttgaaggtgaccaagtagcaggaaccagttcgttggccaggtaaattacctactgaatttcactttggtttgtttctgttggtgacttgcctgggttattgtgcacctgtctgtttaccaccgtcctctctcctttgggaagctctccggacaccccgccggccttgccctcaccatctgttttctttgtgttttgcacagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggtgagtgctcagcaggtgcctgggcgttcaggggtgctgctcagcaaagcctttccgccttcccagtgcacatgggcgtgggccgtggtgtcgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgggatatacgtgtggggcttgaagtgtgcttgaagtggagatggggtttacgggggatcctggggggccccagacaacccaaggaccctgcaaagaagagcattccagttacttttcccaccgaatctgtgagctccaagagggtcccagaatggaccagatgcgggtgggggcagaaggcggcctgtgctctcgccattcagtttagatctcttgggagcagatgtggttcgttagattcccaacagggtctctgactccagagtcccacgaaccgctgccccaaagcctgtgttcattgtaatgtgagtttttcttgcctttgcttccttgaagcttctaacatctctgtattgtttccacttccccctctgtgttggtttgagttggggcgaggacagcatttgttttgccagcacaaccgtgaactggaatccaaagaaataaaagggggaagtaagcatcagactgtgggttacgccctggcccacgagccaaccggggagcatttgctcaacgctttcttagcactgctccccgcaggcagccccaccgtcagcagagctgggtcctggcggttaccttggctaggcttagccatatccgtgtcctggcatccccaggggtgtttgtggtggagagtccctgtggacttctccctgtgatagaacggagtccacccctatcctccggagaggggcgcattgctggtgttcattcctgtgggaaaaccctgtgaccttggcgtgtgccgctcttcctcgttcctctgagcccgcaggctttcttgcatcctagcttctgagaggcgtgcttcttggtgcccggcctttctgccacctccccggctcccctggattgagccctgtttgtctgggagagcccagagtgtcctgtagacacaggtgtgcaggcaagggtcacatgtggcacatacccggctcggctgcccatgttgagccaggagacagaagggacgcagcccggcaggagtggggcaggagtcgggtgagaccctctctgggtggcctgcagtcgtgtgcagtgccagaagcatggagccacgagattgcccaggggagggagatggaactggaagcggccgtcaggggggccaccttggcaaccaggaaatcactgcacttgggtggggaggaagcgaacaaacgcagcagggaagcctccgggcccccatgtggggtcacctgcagggaggggatggcctgcgtccctcccatcagccatcacccatgtgtgattcagagcacacctcctggctctccagaacctggtgccgggccgtggcctggtctcctcacgggtgcacccagcacagtggcagacaaagcgcctccatcccgtgagagcctctgtgcgggcggccccgagaccacagccgtggctgtgcatgctgtcgtggaacctgacagcattgctgagcccaggacactcacctcgacgttgcaccagaggtggaaaaatgacacaaccaggagtaccacaccagctgtggaaaataaccgccgagtaggtggcttttacactcattttcctgcttttttatctttttccaaaagacataaatgatcaaactctctcaattcgattggtgagcatctctgggaggggattttttggtgggcctccctgtccgctccagggaggggtgtgtcctctgtgcccgagtccttccgctacccagaaaggaggaagtgaaacttgcccttggccaggtcggctccctgaggcaaggttagattttgtggtgataaagtgaaactggttttgcagtgtccccacccgccccccacacctgtgtcagtcatcatcttggccaaacttatagaaaccacagacggatttctcccaggtcgtttattaggagaccctgaaaactggctgttctattccgcttgtcatcacagggctgccacgatttctgcggcctctgccaccgctttacctgcccctcccagagagtcacagccaggccaccccctgcctctcatttttagcatagctttcggtgtccttgttctgatgccttgggttggaaacagtgtttaaatgatggggaaaatgtgagagtttgagacagtcagtgtgcagggagatgggaaggaaaaaggagtcaaatgagacctgggttgttcctctctccactgcctttagaacggggtcagcctttgcccctgccccacaaagtcgtgtaagatctggccctacccatcccaaccctgggggccactgtgctctgtgcacccctgccctgaacacacccagctcgcccggcctccagctcctgcagatgctatgctgttcctcttcctggagctccctttcccagacctcctcatctccctcagctgccagctcaaatgccgtctctccaggacgtccttctctgcagccccgcgcactccatcatcctctgtctccatggtgtttcttgaatcagaagcggtttgttttggccaggcatggaggttcacacctgtaataccagcactttgggaggctgagacaggagaatcgcttgagcccgggaattcaagaccagcctgagcaacatagtgaggcttcatctctccaattttttttttttaaatcagccaggtgtgttggtgtgcacctgtagtcccagctacttgggaggctgaggtgggaggatcacttgagcccaggaggtcgaggctacactgagctatgatcgcagcactgcactccagcctggacaacagagtgaaaccctgtcttgaaaataaaggaagagaagaaaagaaacaagtttgtttatgttcttgtgcacttgtttctcattattactctaactgaacataggtcccatgagaggaagggccccggcacataagaatcactgaggtactagatggataagtgattgaatgaatgaatgatggatgaatgaatgaatgatgaatgaatgaatgaatgaatgcaggccttgggctgggctaagaatccaagcgggaggcattctcacgtggccataccatgcttctgttctgtggttccatttcctctttccattctttttgtgcctgtttttgatagagtccgtgtgtgaggcatccccgtacctctgcctgccccttcccagcagcatggctgtggctgcactcagagcacccctctgtcctggccacttctctcccaccagagcctctgtccgtgatggtgtcagctgaagaatgacaaggtttgttcatttggaaaggagagcctcattcctcataaagggttgcagcctgtgggtggctattctgacaggttgggaagcagagcctcctgccagaagccaaaaacagacacttcaagggaggggcaaaggcaacaagaatttatggatattggtggccaaatatacatattcaataagccgtagggggagtcatgagtatttatgaaaggagaaatgtgcacattcacatttaagccttgtgctccttcaggggtcccatgtacaaaaaatggtggcagtggcatgattcaagggtagggttttctttcagccccctgatgcgtcagaggcgaagcaggggacatgaaaccctcgctgtgcatcctctgtagactggccagaaacactgcgtggtcggtgggctcccgtcaggcaaagaggaggggcagcgtctggcagtggtagaggcctttgaaagggaacccagctttttaagaatcagaaaagtcattcagcagcgcccttttgatgcaagagactattcccaattctcgggatactgtcagcactcggcacatggtctctgttatggtggggaaggaaggggagtcagctggagatagccgtgggcagtggccatcagccatgggagcagaagcagcccacggtggcctcaggcccagggagaacttcctaaggggccagagtgagctgtcacaactggtcctggatccaccataagaacgaagccgtggggtgtggtgacctggagccgtcggtgatggctgtagcaggggcgttttggtcaagttgcgggaggtagggaaataggcgtgtcgggctctgtagagaagtttctatgagaaagggaaggagttgctgtgggatgcaaagcaagggagggtggttgttttgggagtggagtgggggccggaataaacccaaagagacttgaaaactaacagaaataaggaagctagcaagtgcatggggcgcattggggcgggaaagactggtgtggtgtgaagggactctctgtggattgggagaagacccactttaacctccagaagaggaggagttgatggacagtgtgcattggatggggtcctgagggattcctcccaggcagccccaaagccagagcctgtggctgttaatgtgggagagggaaggaggatgggcccattgtccagatgccatgtgcagaaggcttcccctcgagttttggggcatgttgggaaggaagcaggatggaataaacatgcagcaaaaaagcctaaattgtatttctttgtactttataagagtattttcccccgccccttttttgagaaaaggtctcgctctgtctcctaggcgggagtgcagtggtgtgatcacagctcactgcagcctcgaactcctgggctcaagcagtcctcccacctcagcctcccaagtagctgggactacaagcaggtgccaccacacccagctaatttttttttttttttgtctgtagtagagacaaggtttgattgtgttgcccaggccggtgtggaactcattgagctcaagctatcctcccacctcagcctaccaaaatgctggtattataggggtgagccaccatggctggacaagaatatctcttgaagcaagttcccagactctggccgccaggcccgctattcctgtcaatggcgttttgttggaactcagccacacccattcccatctgcatcgtctgtggctttcaggcttcgtgtgtcccacaaaggcaaaagtactatctgtccctttataaagttcagtcaccctgactgaaatcatggtgtactcactgtaacaaaattccagttgaaaccagggtagtgcagcagtccatcgagtgtttcctggtgtacctgtgtgcccataaaaagaggaagctgcaaggatcaagttcatagagctagagcctcctgctgtgaaatttttctattgctaagaattggttggcacccaaaatttgtcctttaaaaatatgcatcagttatgccttgttgatggtgtgggtggtttgtaacaaactaaaccagggctgggctcagtaaaagttgtgtaagtgagtgagggagagatgccttcattcttggtgttggaagtgccgacctctcctttcatctgggatccatggaaatgggaccttggctgcccctggatggagtccaggcgctctccttcccaggggccagagaacacctgtgtttcccaggaccttggggacctgtgcccagttcccctggggagagagcggttttgatcactcgcaccaggaatgactcgagtcagaagcaggtgactttgacctgttctgttacctagaaaatgaggccactttggagccaggcagctgtgcacacagccagattagcttggtgtgtgctgagtagccacgaaagagctgagttggggacattgagtgacttcgtgtcaaaccctgtggtggtccagcacaccttcccaggaccacagacgaggctgccaccacagcaagaaaattaggatctgacagcctaccagctaactacacaccctcctgacacgtgaatacacacgtgtatgcttttatcttctgaaacaaatctagtcaacatttaattttttaaaacaatttgttttgaatatatccaaattcaaatagaaacagaccttcttctgaaatatataaatagttgatatgaagcataatccagaccggtattacatttggttcaattcccaattccatgtggggctcatggaattgggaaggccgctggccgagtgctgagaagtttgcatatttgcctccacgcctgtcacttccagctgtgggacccgggacaagcctggggtctgcaggcttcctgtgcttatctgtagaacagatgccttgcggcccacacagcagggaggacctggggttgggtgcccagaggcagctctggctctggcatttctcggtgtgaaacccacttcccctctctcagcttcttctgtaaagtgggttgaactcagcctctgcttcatggggggctctggggagcggaggagctgagtgtctggctcacagcaagccctgggtttctttttttttcttttcttttttttgagacggagtctcgctctgtcccctaggctggagtgcagtggcgcgatctcagctcactacaagctccgcctcccgggttcacgccattctcctgcctcagcctcctgagtagctgggactacaggtgcccgccaccacacccggctaattttttttgtacttttagtagagacagggtttcactgtgttagccaggatggtctcgatctcctgacctcgtgatccacctgcctcagcctcccaaagtgctgggattacaggcgtgagccaccgctcctggcctagccctgggtttctagtagcttctacaaaaacaaacggccaccaggtcctcaaacccccttctggccagcctcgttggtagccagctgtcagcctctcatatctagggaggcatcagaatgatctgtcgctcctggttctttttaaattccatggattgagatgctgggggcccacctagaaggatcgtgagtcacctactctggctaatgcatgccacaagtcgccaaaaaggtcacctttttgtattgttagactccccccaggtaaacataaagtgtacattagaatgctcagtctaaaacagctgggctcgctttgaagtaagcagcccagccgaccgcatgagcactagcaagacgaccctgctatcggcacaaaatagttggccaaagagcgccggtaccagcggtgtggttggcgggggtggggggttgtttgttttttagcacactttggagtcctaaaatgacaacctcaggtgctgaaacagagcgtagagagaaagaacgccaggactggtgactttcctcttctcttagcaactcgcctgtccaggggctcacgggagcctcagaaaccgtctctgggctgcctcaggccactgtgccctggaagccaagcctttcccattgttggatgagagaaagctttaagggtgggggtgagctgtgccttctatggcagaggagactcagacaagaatcagacccagcatgcggctctcctgccttcctggtgacgtcatcctgactggctcagagccacacgctaaccatgtgtggcctcatttataattaggatggcgccagagtcgcttgcatgacacccagtggcagtcatgtgacttggcacagtgtacaggactagcaggcctgctgtcttgtgctagccaatttgatttgtttctttaaaccagaagtgtgagtttgaccccagcctggggtcccccagatatattagccatatgttcaatgcctgtcccatccagcccccgtttttaggagggaattgagtcccaaggcggccacgtggttgttccagcctcagctgggacttcactgtcccagcagggctgtctgtcctattacctcccctctgacttcctctgtggttagtaatccctgtcctaaagacacagtagaaagttcttgcagctttgacgtgggagcagtcccaccaattgtggaaaccgttttctcatgttgcacagtcctgggggaggtctgtgcatctcctggtcaccgtggttcttggtggtacaccctgtctctgaccagggcctcttctgttctctgtcttcttctccctgggtggtccctgcctgagtcccccagccttctacccgcggtgctctctaactggccaatgtcagcaccgcacactcagcaggtccagctcgccctccatccgtctcggcctcaggctatggtgtctatttggtgaaatgcattcgtttctctctggtgtccccagagagtgggagtggtgacaactctaatccatattcaccctgtctgttagcttcctggggctgccaagacaaatgaccacaaaccaagggacatcaaacaacagacacctgtcctgtcaccattcaggaggccacaggtctcagtcaggggtcccagggtggcctccgtctggaagcagtgggggagaaggggttgcaggcctgcctctcctaagccccactggctcaaccctccttcttttccttggcttgttgccgcatctgtcccgtctctgcctccgtcttcacacggccttcttctctctgcctctctgtctgctttctcttcttatgaagacgccagtccttggtgacttcctctaatccagagggacctcatcttaattctatctgcaaagaccccattttcaagtaaggtcacgttctgaggttctgggtggatgtgggctttggagggagacactggtgaacctggcacgctctgcacatcatctcttttctcccgtgaatcctggcagtgatcgatttcaggggacatttggtagtaggccagggaacatggagaatagagagcccatggccattcctgcgccgtctgctggaattctgcggggagcagagcctgccccactccctacactgtctcacgctgtgtgcctcttcctctgcaggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggtgagcagcggctgagcttcgagctcaccgagcccctctgtccctgggttccgtggacccatgcagtgcagccataaaaagtcttgcctcgcggcatttctgtgagggtgcaacaggtggaaatgtgcacgcatgtgcccagcactgggtgtgcctcactgagtgggagccatcctccggattggttgtcgtgagccctggctttaggatgtcaaggctgttccacacgacatgggaaggacaaacagaactgcctgtcccttgttcattttgatcttaaattaccatccgtagggttgaataatgcaataacacatacacagaggactttgtgagccgctctggactggagtgatacctggtatgttacataacttgggccaaagccggtgtggccgggctcttgctcagaggtcctttgtgttctcgcatgtttgtggagggcaccctagtaagcttcctggaagacggttcaggcttgcaagatccaggaagcaggaagtcccaaggacaaagctgtcttttatgaatgggatgaatttccaaacaaatggcacagagagaaagtgccataaagattgtaaggaaagagaagtcctttctgtttattcatttgttgcgcacctactcttgcacaaagccctgcttttccctctggaatgtgctgaccctggccccgagatggttccactgtttcttctgtgggcttgtctcactcgtgaaagagtgtcccaaatagtgactactgaagctgcaccaagtaataggaacaaatctcgttctgtctcctaatctttcttcctctctccctccttttgttttttacaactccacctcccaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacct

SEQ ID NO: 38766 - DNA, 238579 bp, Homo sapiens; identical to SEQ ID NO: 35686

SEQ ID NO: 38767 - DNA, 49193 bp, Homo sapiens; identical to SEQ ID NO: 37330

SEQ ID NO: 38768 - DNA, 27086 bp, Homo sapiens; identical to SEQ ID NO: 37318

SEQ ID NO: 38769 - DNA, 895651 bp, Homo sapiens; identical to SEQ ID NO: 36080

SEQ ID NO: 38770 - DNA, 91182 bp, Homo sapiens
ggccgggagctcgggagtcggccgccgcgccgaggttcgccccgttttgcagagagagccgagtcgggacctggaaagacttccccgcggggctccggccgccgcgcctccccgccggcgcctgccctgccctgcccgtcccagccccgcggttcggggcgtgcggccgggacgcgcggagccccggccctgacccgctgcgccgggacgggacgctcctaacgccgccgtaccggtccgtggttgcagggtcgctccgcgcctttccgtcagtgagggtcggaaccccagctccagggctagcgcagtgtggccccaggccctcgcctccggtgcacgggaccccggacccccccagcctctggcttcacgagaccccaaccttcagttggaacagcttggaacagcgcgagcgcccgggaagccctggccgggtcgtgcgctcggtgaggggtcctaggcgggcaggacagtcggaccgaaccgccgggctggtgccgcgagcccaggctgtcaccttcgtcccgcctcaggtgaggggttcagcgcctgccccgaagataacacaggggtccccttctgtcccggcggcctgcgagagccaaggctgcaggtgagagccccggatgcgcggcaggagcggtccccgaccccatcgcggcagcgcgggggccagcggagggagtgtcaggggaaacaagcagaggctggaactggctgggagggggcgcgggaaggggaggggaaagaaagaaaacgggtacttattgagcgcccattgtgtgcgggttcgcgccctgccccgccccgccccgcctaagcctcactgctactcctgaaataggtgttgtgtattattatcggcgcttgcagatggagaaactgaggcttaacggggctgagtgacctcctttcactgcggggaggagactggggaagcgggagaggatagagggggaagaggcagagcacttgagcgctgatgctaaagctgaggaagtggcttcttcttgcctcccgctccctggccatgtcacccgcgaggaaaggtgactcagagttgagggtagaggtgggaagcttcccagttccaaagcttctctccctgtgggcccaggatgtgagagcagcagctcctggcccttgtgtgtcagactccagggtctctaagacactctggaggtcctgagacgtgcttatctgttggtgaattcactgcagagatccccaagtaagggtctgtcagagctggagatgtagcccctctggggtggctggagatgtggctcacgtgactcacctccctcacattactaatggggacactgaggcccacccgaagggagtgccagttgtccgatcctaaagccagtgagtccttgagccacaagtagacttgagaaaaccttcctgagcatccttcaaggtatgcacactcctccccagttaggatcttctggataggtggctggggctttccctatcgctgatgtgagatctgggcgaccatgtatgaggctgtggtgagaattagtgtggttggttgctggggccccgaggaatgcctgcaaccgcattgcctttggcccaaatggaaggtccaacctcattttcttctgggcaggggaacctgcaggatacctctgcccaggaaggaagggacctgctcaaggtctcaaggctgggggctcccagggctggggcacagtcccaggtgtctttattcccaggcaggggatgcttctgctgcccccaaggcatgtagggagaggggtgttgtgaaagagcccttggcatggactctgtgggctcttattctgtgtggggacggggaggggatatggccttggtctgggccctgtggccttggctaggcctagttaaccctagagatgcccaactccctggagtcaaggggaaaccaccttggaaagcccctggaaggtggaggagcgtggtgagaggtctgtggaagtctgaagctcaatccctgggggtggaagggttaggggatcccaaaagacaaggtgactgaggggcttgggattccctctaccccagacctctgtctggggcttcaaatcctcgcaataatctctatgtctaaacaaagctctttgatgaaataatttcacacctgtgatctcctttcatgacgtggagagagcctggaacctagagtgaagcagaggagggttgcagagtcacttgtgacctcttgatgcatccatggttccaagtgccactttaaaataggttatggcaggctgtgtgttacctgctcagttagtggggccatcacatctggctgtcaagtgctaaggggcatgttgtacttgccaagactggggaggttattaatggcccagtctcgtgtgggcaactgaagctcagagaggtaaaaccacttccccagggcctttgagtttgcttgtagaactgtttgagtgccagctgcataccaggtgccctggaagttacccagacgggctaagcggcagcctcgagccacagtaactggtgaatcccagatagtggtaaatcagacagaccaggtgggcgtgagtctactgtgcctcccactagctgagtggcactgagcaaatcacttcatccctctgagcctataaaattagaatacctcctttagcaggttgttgcgaggattaaatgagctacaaagatgcagtgcctggccaaatatccgtttccatccctatgaagaaaaggaagcttgaagtttgaccaggaagtctggggaaattctcagacttgtcttcgattagaacgcaggatatggttgcagggcaggctcagagacctgaatttgctcagctcaggctgctgtgtgggtcacactcccctagtctcatagcctctagaatcagtctgcttggggacaccggcaaggggctctggattcttaccccctcccttggcttcctgctggcagggctgtggtgcctggagctggtgtccattccctcgggcccattgtctgacctccctaggcaccaaggtgcagtgaataattaatactcccctcagctgggggcaggctcagggaaatagctctatgttcagtgagcttctgaaccctaccagaggaggtgggggctcctgtctgtgctgttagcagtcttggatatgggggggcaggcaggataggacagggagaaagtgtcatctggcccccaacaggagagagctggggttgatgatgtcctgtctcttctgttgggggccagatggtcccacaggcaacactgggaaccaagctagctgagctaggatcaagtgggcctctgattccagagaggtggtgacggggaggagtaagggggagggtacagggcagaaaggggtggaggggaggcccttgaggactggagtaaccaggaaggctttgtcagggaggtggctgtctgggcaggagctagaggaaacttgctgcaaagacggggggtcctgacatccctccaagaaggaatcctggctgtgccaccgcctcactgagagcatgggaaagacacatgatcccatcaggcctccatttccccctttgtgaaatgacggttgtgatgtccacttctcaaggctgttaaggatcatcttgaggtcccatgtgtgaaacacacggcactttaggcactcaacaagggggtgcctcatcatgagtgtgagctagtgggctagtggcggggcaggtgggatagcgtggtaagccgagaggtagggagaacttggggcgaggaggatggcttggtggggttagtgaggggtgaatgcccatataggagagggccttgaatgttagacagaactcacatttcagaaagcttaatggagcccccatttagaagcctctgtggctccttacggcctgtaagatgaagaccaggccctagttatggcattcaggtccttggtcaccttagcctctgcccggccttctggctcattgctctgcactgtctcctaaacacaccacatgtggccccatcacagcccctttgtttgtggttcctcccatcagaaccgccatccctgcctctgctccacttacctccccacctgtcaagacctgactgaggtcataaattccctcagaaacattcctggattacccaaccctctggtcatgccccctctgaatctttaacattcagcagtaatagtaaaaaataatacctactatccataacattttgcagtttgtaaaatgtatccacacaatactacagtgatgatatcaacaacagctgatatcttgagtacttactatgagccagacaatgtgctaaatgttttatagacactcttgttcacacaaactccctgaggtagctactgttatcccctagaaactggggctcagagaggtacctgatcttgcccgaggtcacacagctcaaaggtagggagcagggagccaagctgcatctgtttgaattgtaaatctgtgcttagaagatgtcctgtctcctcacctccacccaagtaccttgaaagcatactttgtgtgtaaaaagcctggacaaggttttttctcaaggctaaggaagggcagtgttggactgagcatggggcccaggaaggacctgggccctaggccgtgcacaggctggctggttgtctgtgtgacctggggtgagtcggcccctctctggggtcccgtgtgtccatgtctatggggagcagggtgggttctgagctcccctgtagctccagctttctacatcgtctttcgtgaccctggagggaggaggaggagaccacagcaccagggccagaggatgtggtatgacgggcagctgtgatttttggcctggccactgtctgggccagcaggctgtgtgggtagctgcctcgcccaaaggagggtggtggcctgagctgcaggcagcatggtcattagctggcagaggagaccctgtgattgggaactggctgggccaggccaggccaagttggcgggactggaggcaggctggccgggccacagcggggtcactggcagggcagccagcttctcctccctttgccccctttggggtggtggcaaacacacactgggcaccagagctttgtaggccaaggcttaccctttctcctgctgtgaccatgggaaagagcagtaaggagttcaaccaggtccaaagatgctgcctgctataagcttccagtactcctcccatgcaggtgggatccaagcctcctctgctgctgattcatggccctctgcacactgactgtggtctgtggattggggttctgcttggtctgcttcccttgctggcttgtcaaaactagattctatgtgcccccaccgaatcctcccctccctctgagtgcctagcagtgtgcctggcacagagccacaccctccgggccaggggaggcagtgcaagctgccccatggacaacttgctcaacttttgcacctctgttttttccctgtacattggggctgataataactgttattaaatgagatgaaggaagtggggtgcctgtccaggcctggcacacaggtgggtactccatcagcatgagtcttcttgcccatcccctcgatggcttcgtgaacgagcaactcagtaagaagctgatggaagagtccagtgagtgatggctggagggagggcgtgccagatggcagggaggccttcccttagggggacttagctggggtttgcagattcacagttcccaccaccttccctgtgaacagtggtgtgtaagcaggtgctgttggcctggaagggtcccgagctaggttcaggggagggagcaggactgggatatctggggacttgggttttcttctcaggcctacgcagaagaaatgacccaggtgggagaagccgtctggcgtccagctagcagatgctgggcagagagtgtgagttcttccttaaagggaagcagcatttatttggtgctgctcacacacacatccaaccgaaatgtaacatggttggagattctggtctgtgggggaaacagcattagacaaggaaacacacagatgcaaaacttccaaattgtgagaagcaggctcctgaggcaggggccggtcccatcagtatctgtggctggtggcacagggtagggctaaatgacttgggcaagtgatttaacctctttgggctttagtttccccatatgtaaaatggggataattacagcatcttcatcatagagttgtgagggtgaaatgaattatacgtgtaaagcactcaaaaaaatgcccagcacataatgagcactcagtgcaggttagctgttatgatctgtatctccagcacctcacagaggatcttagagaaaacaggtgctcaggaaaggcgtttggaatgaatcccaggcaaagggcagctgctccgtggaatgaatgaatgaacagcctggtagggttgggaggacacagaagcagtgacaacacagaatgtgacagggaaggccaggggcctggggttgcccggcgctgggtggggaggggagtcagggaagccttcctggaggtggtgcccatgttgctgactttggacctctgtgagatcagcactgaatgagctgagagaggagtagctcctctccaaaggtagctggcaaggaggagagcttgggcagaccccaggaccagtggactccacaggcctctcacttcccaccaacccacaccatctctccatctgtgacattctgctttcagggcatgaggaaggcggaaaggcaggtggggaggaagtgtgggctgctggtctgacaggctcagctcttcccaggcttgtgaccaaatctcctgcagaaaaggataaacaggcctgctttgagttcttttatcttcttgctcccaaggcacaccagcaagcagagggggtcttccagcgttaatcctgcagctgtttagcttttgaacgagtggactctttaaaaaaaatgccacgaagaatgtctcactctctcacccaggaggctcaaagagaaacttctctcccactgacaagggagctggaacccccaagtgtcttaaagaagctcaccccaggggcagtctgaaatcaggggacccctcatgctgcctcgatttgttgctggctgtggggccttgaggacacccttatattttgcttggcttctgcccattttgtaaaatggggtcagggtaataaatcccttctttccttagaaaggcgtgtggcaggagagtttcagaggtgggaagggcagcagtgggcatccaagcccatggctttcaaactttgtttcacattagaatcatctgggaaacttttaaaagtcctgcaggccccacaatctctggggcatgacccaggcatcagtagttgatgaagctcccctggtgatttcagtttgagagccacctggctgccctctgcagcctacctcccacagtgtcccaagacaatacttgcacatccccaggacaaggagctcattccttccgaggctgcttcctccccccaggaccttcctgcctggagagatgaggggagtgggaagacttggtaatccagttaacctgggttccagcatgcagctgctccctgcgtgtcttctcggagcctcagtttcctcatctgaaaaatgacaataacgatctctctgaaagggccacagaggccagacgaggccacacatggcaagcacccaccccatacctgacgccgggctggactgagaccctgaactccctgccccagccacctgaggccaggtctctgagactggcgctggttagggtgggatcaacacccagcccgggggcccttcccactgtcccctttctctctaagagataagacaaggcagtaagcattttgttttgctcagttttgctttaatggtcaaagtgtcagactctccttaacaatgaagccttgtctgaatctgcttgtttttccaacccggacacccaactgcaccacctgcttggggcccctgtcccacctgggagaactgaagaatgtcagaggatttttttttttaatctaggggagggtgtccagggaacattggaggcctctgtgcaaatcctcaccgataattgaccccacttaagtcatccaactctgctgtgattgtgagccagttcactaaaattatttcaaggtagttactaggtgttgagctaaacccctatcagtgccagtgaggatggcaccaggctcaagaggccaaagaggagacccagagccagcgaatgagccatggggttttactacgggctcacacacaggggagagagtccagtggctgctggctggaccgaagaaccacaaccactcgcaggaagtgtgcagtttttttgtttttggttttggttttggtttttttttttgagacagagtttcgttcttattgcccaggctggagtgcaatggcgcgatcttcactcactgcagcctccgcctcccaggttcaagcgattctcctgcctcagcctcccaagtagctgggattacaggcaagtgccaccacacgcagctaattttgtatttttagtagagatggagtttcgctatgttggttaggctggtctcaaactcctgacttcaggtgatccgcctgcctcagcctcccaaagtgctgggattatagctgtgagctaccgccccccagcctaaaagcttgcaatttctatagcattttcacttagcacctcccccaacaacttccacctagcaacctccatttaccccaaaccacagacctcaatcctctgtttggcccgcaagttccataggatgggccaagagctcagatgttcctcatagataaggagtggatctccgggttggctactcccagattccttagcttagaaccaaactgcattgaggtgcgcctgccatacaaggtcattctcagggcttgctcaagtccaggtatcactgtccaacgtgtctaccatacagaagacagaaaacttatgttgatcctggctttgtcacttactggcaggatgaccctggaagaatcattttatctctttgagcacgagttgtttctcctataaaatgcatttgtaggaaggacttcctgggattacctgagaagcaaataaaattactggtatgtggagcacagtgcctaccgtaaactaagcactcaagagctgttggtgcatgcacttgctggggagctgacccctgcctcctgccccttccttcactggctggtccacgctccctgtctcccagtctgctccccttgccccaccaggcccaggctgagacagaggacagaggaggcctgcacatgtaatcatgggcatcccttcaaactgctcttctttaagaccagaggaggctctgaggactggacagaggaagactacaaaaggggccatcagtggcagtgcttggtctccttgcctgggcacagccagagagggtacatcaacccagagtgactggctcaggcattaggcgtgtgacaaatcaacacgggatagtgcagcaccgagggactagcagtggctgggagcagttaccactcagggctgaaggagcaagggaagtgggcagctatagggataggggctgtgggccatcagtacagggacccagtcaacccaggagacctcacaggggataaacttcaactatctttcctctttccttcagtcccccatttatgcttcctgttgggtgtacctctctgaaagccagcagcatggagcccattacattccacagaggtcagttcccagggccccaaacaaggtagagagtggctctggagaagcaaaccaaagacacttcctcactctgtccatcaaaagcccgggagtccactgaatacactgtccttaggacacagtttaaagatcatctgtttttaccataccccttaatgaaggggctctcagcccttaccccaaagatgaatcagcagccgagctgccacagacacctcggcgagaggagttttggaggtacccatctctccctctctgcctcctccaccaaagtaagctatagatggcttctggggtgaccctgccagggacaggggaacctctggagtggagcagaagtcacaggtaggctagtgtcaggcgagttcaggtgcacagagcagcggccccagccctgctgcgacttgcccatcccagagctggccatgatgtggccacttcacacaccttccttagagctgggcagtcattgccacagttctggggatagccctggacccagaacatgttcctcatgtccagggtgttaagagccatgccactctgagttcagagggtctcccaggagcctatgaatgtcaggtaagaggagcgtggggctgggcaggcctgggacaggccgtgcagcaagtgccaccaaatgctgccaggccttgtgatggggagtctgggtgtggagttaggtggggggtgtggttcttgccaggcagggagcaggaggcataatggtgccagagactgagccttgcccaagaggaggcatggtcagggagaggacagaagatatgacactttgcatggaaaccatgtgggaggcccccacggggtgttgtctgcaggggcacagccggcaggtctaggacacagagccctttacagctggctgccagcgagcactccctctccttcctgaaaggaatgcccctggcatctccaccagctcacacctaggcatctgaggtgacacagtgagatgcccatggcaggtgtggtaacacctggatcctcagagacttcctgagaagggaggtatgtgggcctcggagtcagaattctggcttggaatcctggctctgcctctcttgagtggaacttagaagacatgggcaagtcacttagcctctctgagcctcagttgctcacctataaaattagagcagcaacacttaccttccaggctggtttgaaagtaaaatgacataatgaatgagacagcatcctgtatttcagaggagatgctacagttgccctcatcatgccccccttctctgtatgctgttcatgcttaatgcctctgcaggaagttctttcttgagactaattgaagtccactctgctgcaattggagccttcttcctcttgctggggactctgcagaggcagactgagcccctcctctgtccagatgtgccctgtcagtgcctgcagtgagtgaagcagagaactgggtgaccaggtgttgattttcaccttggagcttgggggttcaactgtcaatggccagagcctcttgaccatggcaggatagggggtgcatcatcctaactcttcacactgttcttcctctctgtgcttaatgcatgctccaaaaggggtgactttgggcccgtgcagagagccctgggctgggcctaaaggcctgggtcctggcacctccgtctcactgtgtggcccaaggccagttagcaaccatttcgggccaccgtgggcctgcaaggatgtctgtgctctagggcccaggtccctccagtgaagacatatgtagttctgactgaagacccttctcctgcttctccccctctgggaccctagccaacctgggaagacagcagatagggtcctgctggtggctggcagtggtagcagctgagtccatctctcagaccaggactgccaagggcaggccgagaattcaaggttagatgggtgattcctggtaggtagggttttgcctccctcctcaaaacagagcctggtgctccccttcctacccactcagctgaactcacccagctcaagggcagtcatgtttgagtctctccttggagtggctcctttcccacatgagatccgctttcatccctcattttgcaggtgagaaacctcgggctcaggcaggtgaggtgactggcttgaggtcccacagcctgtcggtgggaagtggtgagggtccctgcggcagctcccatggcacctgggccaggccgtgccctctaggtcctcagcaggagtggagcacaggagagtcaggaggctactagccaggtggtctcctggtctaggaggaggccctatgggtgccaggggaaccctgctctgtgggccttgaggggtcatctggggctcctgggattgctgggtccctttccctgggaggaagttagccgaggaatgccagaggttgagagcgaggaacccaggagttctaggctgtgactagttctgagtgcccctgtaaacttcagtgtttagtttcacggagagtcaagactgactttttgttgactttggacacatgacagtttaactttacgaagcgctctgatatctgtgatgtcattgcatcctcacagcagtctgtgaggaggaagtgtgggacttgtttgggagggcaggagagtgtgggctctggaatcagacacaccggagcttacaccctgactcccaccggctctctgacctcaggcaagttggtaaccagccaagtctcagtttgctcatctgtgaaagggacaatttactccacaacaaattgttagcaacacctgccttgctggctgtgtgccttaagagaacatctgtaactgctgggtcagtgtctggtgccatgtaatagttttcatgatttttatcagacccactttatagaagggaagatggaggctgagagaaggaaggtgacttgtctgaggtcatgtaatgatttaaattggtcctccagacttcttgtctgtgaattttttctataaaacctccctctccatcctcaagtgacccgatacctcatttatccagaaccctccacgtgtgatgctgtctagacgtggcattgtgtccccagtgcccaacagcacttgcctggtacacagtatgtcctgtgcatagatgtgttgatgaattcatataaactgtaagaaacatttttccagaagaagcagctaaggcctgtgtcttgccctaaagacttctttctttctttcttttttgagacagagtttcgctcttgttgcccaggctgcaacctctgcctcccaggttcaagtgattctcctgcctcggcctcccacatagctgggattacaggtgcccgccaccacgcccagctaattttgtatttttagtagagacagggtttcatcatgttggtcagtctggtctggaactcctgacctcaggtgatccacctgcctcggcctcccaaagtgctgggattacaggagtgagccaccacacccagctctaaagacttctttctgctctctatcccattaaaaacaactctaacagttttggttggaaacctttgcaaaagagattgatcactttcttcctctgaacaatggcaacatggacgggttgagggacaggccttaggaaccccgcctgccttgctgagaatgccgacgcggcttgacccctgtgccagatgaccctgggctgctgcatgtgttcaactctggtttctggctcttcccaccctgtcggttcctttattctgctgcccacagacttgcctccagagcgctgcatctctttcctctcccctcgtgtgtgtgtgtgtgtgtgtgtgtgtgtgtgtgtgtgtgtgtgtccttcccaatttcatgcttctaccagttagggactaagaaatggaacaattgaccttactagaattggttcgtgtattcattcatacctattcaaccagtcagccattggtgagcctgtgtcacactggggattctgtctgtgcattcttccatgcatccatgtatccatccatccatctgtcctgattgaggacctctgcagtggcttgtgatcaatcaagacattaccacaccctcctggccatgcatgcagtaaaataatgatgcacacagcaaatgctggcacaggacttgacagtttgtaatctgcctctgcttgcattacctcaatcttcacaacagccctgagaatagcattatccccattttgcagatgatgaaaacaaagcttagcaggatggggtccccccgcccaatggccagcagtgagcacaaagtcacagttggaactcactcaggtctctggcccactctgttaccttctccctcctttgcgctacgtttggaggctgtctgatgccatgttcattatctgtctctgtcatgagctattggtggtggtggctgaggttggactttttgcctctgtcaaatggtcagtgcagggaagcatggccctggctgggtggcagccacagacacccttcaacctgcagaccttgtcccgcctggacccaggcgcactatctagtccacactccccaaactgtcccctgaggagccctagtcccgtggcatgggaatggattcaaggatgcatgagcatacagatttgggaaacgctaggtcacataaatccaaacaggccttctcagggtctttaatgtattaatacgaattagggaccccaatgggtggcagagtgtgcagccagcctttcctaagcttatttgaacatgcaactccttggtcaaagagcagggtctggacacaccgtcttgagaatgcagtgagaagatctcatgggcaaaccctgaccttgctgttttgtgcaaggaaacccccagccagagctagtttcctggcccaggactgcattttgagagagcatcacagggaatactctttagccccagaaaagattcagtgataatggtggaacttcaggcagcaggggcaagtggccgtggagatatttttattctttcatccaccaaaagaacatatctcagacatctactgtgtgccaggaacagagccagcacttggaaatgccaagacaatctaagtctcttccatttcatttttcccccacagtgctgcatctctttcctccgagggttttcaaagaaagacaagccttaaatacatgccttaaaaggaagaagtgatctgttaattgctctgggtcgttgctttgggtgggtgacacatttactcaattcagcggagctgtaccttcttagtcccaggtcctgaggggcagagagtgaggcaattccaggacccattaccctgggcagagtgcacagatgttgcaagggaggtcaagagcatggggaggcccggaggaggaggaggggggagggggagaagggagcgagcttcctcctggggtccatcagtctcagcttggggttggggggcacttaagtgaggctctgcgaagaagagatgggggagtgggggtggatgggctccaggtggctgggaagggcattcttccaacagctggagcagaggtgaaaggaggcagcacatgacactgtgtcatgaggaccctgtaaggagcctgtggatgtgggagcagagggaggaaaaggaggtcagacggggctggagaagtttctggggcagattttgagggtctgagctccagccaagtgggtgcttacctgatgaggagcctcttcagagctggtcacattcatcccagtgtccccagcacctggctggtgcccagtgggtgtttgtggactggctggactcttcctctgtaggcctcgggttcctcacatttgtggtcaggcgaggtcacctggcacctcccttcctactctgaagagctctcaggagttctggatgcttgtgcaggggaaggcctcaccactctccctgtctcctgcctcagggttctctgggttgccccagcagggctggggccatggtgccctgagtgggggacagccctcccgctgccagggaactttgcccctcgtgctttctcccttcagcagttggccccctgagcccagaaggacattccttggtgtcccgtgactgggagtggcagtggcattgagcgcatgctgcagcttagcacggggagggagctctgcttccatctatgtgaaaatgggcagccaggtgtggtagctcatgcctataatcccaacactttgggaggccgaggcgggcagatcacttgaggtcaggagttcgagaccagcctggccaacatggtgaaaccctgtctctactaaaaatacaaaaattagccgggcttggtggtgcgtgcctgtaatcccagctcctcgggaggctgaggcaggagaatcgctggaacccaggaggcggagattgcagtgagctgagatcgtgccactgcactccagcctgggcaacagagcaagactccatctcaaaaaagaaaaagaaaatgggcaagtgactcagcctctgagcctccgccttcttgtctgttaatagtaacttccacactggacttttatgaaggttcaacgagataaagtttgaacatggattataaactgacttactccacaaacaagtaaacagttcttggcattaacaatattcatttgtccaatttatattaatcccccaagcctctgggccactcacctcttttcaggaagtgctccctggcatcagctcactgttctctgtgcaagctgcccctgctggtacattttatccaggccagagcaataggagcctctgaattatgtacaagtcgcacacacaggccagaactgtgtgtctgcagccctgtctgtgtttgaacagaaagaaagatggtgctgtccttcctatctgctgggcccagggaccagataccgccccttccctggctgcaacccaggggtctcggcctctgaggaaggctgggagcacatgtcaagaacaccccccacacccaacttgtctgtcctgtttacagtctgggtctaacatgacctgcccacatacaggagcctctctgtgtcctgcatccctgggtggctggtgggcatagggcttgaggggcagaaaaagacagtcactccacatcccttccacttccctgttcatgccaggagctgtcagtcgggatgaccaagatcttcaatgtggacactgctttatttcagcagggcctcaggtaccccctctgggaggcctgcagcctgtcacagcatgctgagccaaagccacctgcccagggtaggtgctggagggacaaggctaggttgtgcccagcaccccttcgcctggaattctgggggtccctctcagtgcccttgttcctgagcagctccagatggtcctggccctatgtggggggagtaggggcagacagctggtgaggctggcacccagaggcatcacagatcctccctccgcttagattggcatgggggccacagtgggggaggcagagtggcaggcagggagaaagatatagtgggatattgatgtaaacctaagcagattatttttataagatcccagtgaacaaacgtcaatttacccctcctccaactctccccctgtcttaaaaagaccaagcaggaacacacctggcttcctgtcctggctccatccgtgtgcctgtgcaaccttgaatttgtgcctggggctctctgagccttagctggcctcattttaagatgctgatgataaggccaacgtcacaaggctggtgtgagatcaaatcaacccagtgggtggcacacccaggaaggcaccggatacatggcaggccaccgatttgcaaggcagatctaatgctaggccagagcaaagaaattggatgtttttagatacttgatctgtggtctctgtaaacaggagagaggaaattcttgtcaacttcctcaaaatgatcagtgcagcttagacacgtttttgtaccttgtgactccacgaaaaggacttcaaaattacccaggtatttgttgacctttcccctgggaccatgtaaagccactgggtgtgagtcctgactctgtcatattagccaggtgacgtgggcgagtcccttgtcctccctgtcctataaaatggagggaacaagtacctaattctcaggctcattgtgagcttcagatgagaaataatctataaaatcctactgtggaaaaaaaaaaagcaactgatagatagtgggtgctgggggtgggtgttgggggatgatggcccagagtgcgggtcaagggctcaggcagctgaggctgggtgtcctgtcctgatgactggcaggctctgtgatggtcaatgcgtgtgtagagcctgatttgctttccttaatgggacagctgcttaattagcctctgagtgttcctgacaagtgtccctgtgagtgtccccagcatctgacagggtcagctctctccagaccatgtgtgtgctccactggccagccttgggtgtgaagcattgacccactgtcctatcctctgattcttggcttgtcactcagatggcctcgtggggcaaccactgtgttggggactaagggaacaggagacagccctgccttaagaaccccggtctgggctttaaaggaggaatgtagagaaggctcagtggctgtgacccagtggggcttggaggcagccagtgccccccagcctgggaaagattctgcctggctctgccaccagttctctatgtgaccttgatcataggccctttctccctctgggcctcagttttcccctctaaatgaggatgttggaagaagtggtcccaggaagctgtggcctacagcaaagcagggtgaggggagcagtgatctctgaagccagcccagcctggggttcttggcccagctgctgcactttctggcctgtgaccttgggtagcccacccagcctccccatgtccgcctgacaggggtatgctggccctgctggcacagagcagacactgaacatcctgcccagcagcgtctggcattggtgggccccagggcagctttggcccttctcctctttctttccctgtttgtcctgcagtgcccagaagttccccagggagtcttgcgccagtggattaggggtggcgtaaaacaagtgttgctgacctcagtgccgagtccaccatgctgtctgtgctactcccctgcctggggaccacaggattgggatagagctggccatcctctgccacttaagggttggacagagaaggggaggggggcaggggcagggtgcacactctagagcccagcattccgtctttgttggcatcttggaaccttggtccttagaaccgtggactctttcagttcccaaatcttggaagcactggatcatggaaccatagaatctcggtgatatgaaatccagacttggaggaggcctaaggggtcacaatccaaaccttcatccagcccaggcagcccctctgcaggctccgtgaacactctggcaactggggagtcatctgtagccccctcaggtaggtctcagacttcggtcagatcacagggctgcccccaccctaccttgtggtcttgactggccgctgtgatggtgtgcctggggctggttagtgctaatggacagctgggatggaaccaggcctctgctcagctaagaatagaaggctttgtgcgatttaagtagcagccggatcatatcaggcctcccagccaggccctagggagcttattaagaggctaccctgggtcctcctaggtggaggggcagccactggacttccccggggttgctctcttgtgtttacctgatgatgaattttccttttcctatcaagtaagttcatccctcctccttcttcctccctggggctggctggggagcatcacccagtgttcctggggggagtgtcttctgggaagagcccaaacaaacaaagcgtccctgagaggaacaaacagatcgatgaaaacgtctttgtctggaaaggagagaacggatgatggcaaccttttattgagtgcctactgtgtgccaagcccttggctcagcattttgtgctcttgccatatctgaccctcccaaggggctctgggaagggtccttatccccatgatgcagatgaggacacagaggcccagctggtacttggcggagctgatattggaaccaaggactgccccgccccattccttctgagggagaaactaggggttcctgagagccaggggaaagaggcaagagtcagaattcttggagagaaacctaggcatggaggattttgtctctctgactgcagtgattcatgctttaccttatgttagagtcttttccacttttggcagcatggaataggagaaacggttctggactgagggaggaattatggccctatcacaaatatagtaggtgcaggcacatgttggttaagtttgaattaaaccaaatccacttgggtctcagatttcccttctgtgaagtgagtaaaggtcgcctggggcaggatcatgaggctgtggctccagattcctggtcttttgatcagagagtgtcctggtccccactctctgcaggtctctggtgcctcctgcctcccactcagagattattcccagtgtgagaattggaaggacacctaggaattgcaggtcattctctgatggtacagacaggaaaacaggggccccacaaggaaaaggactggcccaaggtcatgcagtgagtgggcctgggagcacatagtaggaaatcccttcttccttccaagccaatgcctgctctcctctggggcactgcttttaggtggtgatctggagggctgggggtggggctgggggccggaggcagctggatcctgagagggaggcaggggccaaaggtccaagcctctatctgtggtgccccaggcccatctgtgcttgcccaaatcctgtccagctcaaatgccccctcttctgtgaagccttcctggactccccttcctaataccctttctaatctccctatctacctcaagagtgagaggttttttttgttgtttttttttttctgagatggagtctcgctctgtcacccaagctggagtgcaatggcatgatctcggctcactgcaacctctgcctcccgggttcaagcagttctcctgcctcagcttcctgagtagctgggattacaggcatgcgcacacccggctaatttttgtatttttaatagagactgggtttcaccaagttggtcgggctggtctcgaactcctgacctcatgatccgcctgcctcggcctcccaaagtgctggaattacaggcgtgagccactgtgcctggccgagtgagagtatttttaaaaattgtattatttaagttaacaaacataaaatgcaccatcgtaaccatgttaaatacagttccgtatgttaactatattcacattcttgtgcaacagatctccagagctttttcatcttgcaaaactgagactctatacctattacacaactactccccatttctccctctttctctggcccctggcacccaccattccactttctgtttctgagtttgactattttagataccatatataagtggaagtgtacaatatttggcttatttcacttagcatagtgtcctcatggttcatccatgctgcagcatgtggctggatccccttctttgttcaggcggagtgctgctccattgtgtggctagaccacattctgtctgtccgttcacctgtcgatggacccttgggttgttccacttcttggctcttgtcacaagagtagggagttttgaagttggatgggcctgggttggaccctggcttttagcctcctttagctgaatctaaggccctcctcacctgccaccgtgcccagtgggattgctgcaaggagtagaaattgttcatgttgaaatgcttggcgtacagcagacttgcagtgagtagtaggtgggattcattctcgttttccgctttccctctagggacaggtcccttttgcccatggctataggacccacagctcacctgcacccatccatgagggcagctgagcatgtggtgaatctcagaatattggagctggagagcacctgtgcacagagaggggcagggactcattcaagttcacccagccagtcaatggccatgccaggattaaacttggctctccagcctggggaccttccccctccagtccctgagatccgcaagccttgtccttaggagggatcagctccccaggggcctatgtctaatcctgcagcattcagggctgggggaggcagggggctgggagatgaacatctcaggaggctcaagagatgagcatctgtagtgggtggaggccaatggcacctgctagtctcctctgatcgcctgactttccccagggctgtggacagcggagctgcttcagcaacaaggagactcacgtcagactcatttgcatggtgcaggctctctaaggtccttgccttgcacctgggagctcactctgcttttgctcactttcattcattcatttgcctattccttccttcgctcatttattcagcaaccactccctgaggcctgctgtgggctgggagaccaatcagaccttgcaggcagtcagtatggcatagcagtgaatagtgtggattctgaggctaaactgcctgggttcaaatcccagttctgccagttactacctctatgaccttgaacaagttgcttagcctctctgcctcagatccttctctgaagtgaggagaatgatagttcataatttatatttgttccagttactgttgtcacgtaacaaatgaccccaaaatttagtgactttatataggaacaatcatggctgggcgtggtggctcatgcctgtaatcccagcactttgggaggctgaggcaggcggatcacctgaggtcaggagttcgagaccagcctggccaacatgatgaaacccccatctctattaaaaatacaaaaattagctgggcatggtggtgcacacatgtaatcccagctacacaggagtctgaggcaggagaatcacttgaacccgggaggcagaggttgcagtgagctgagatgtcccactgcactccagcctgggcgataaagcgagactcagtctcaaaaaaagaaaaagaacaatcattatctcacagtttctgtaggccaggaatttaagttgagctcagccttgggctcagcccagtggctcttggtcagggtctcacttggtttctgtcaggtggcgtctagagtggggaggagctggggcacccggaggtttgcccagcttctctcactctttgcgtagtctcaggccttcttttctctctctgcaggcttgtttgagccttcccacagcaaggcagtctcagagcaatcacagtgtctacacggtggtgcagggctctagtaggagtgtcctggtgaaggaggcagaagctgcttcacactcaatgacctgtccctgaaagtgccgtagtgtcacctcagccattactcccaagccttctcagattcaagtggggggacagagacgccacttctctccatgggactggtgtcagcatcactttgtaagaagagggtgtaggatgggagacattgctgcagatgtctttggaaataccatctgctacagttgtgagagttagatgagtaaacacaggaaatgcctagaacaatgcctaggcatcatatataaatggtagctagataaagccaagggtgattttgaccatatgcaacttattcgtgatgtgctgaccttaggatgtgactgccactgtggaagccaatccactgaatagcagcatttcccatttgggtattgagggatctataggagttcaccaaactgaggcaagtggaaaggcattctacacagaagaaattaactttgcaaaagtgttgagctggagaagggagtccctggagcagggacttagctccaggtggcagggctgccctgaggtgaggagggaaggaaatgactggaaagtgagttgtgggcaggttgaaaaaagttttgcgtgtagggtttgtacttaatcctgtaggttccaggatgtccttctgtttctcaggcagcaatatgagaggcttgagtaccatcatgaggaagccatttctgagggcaaatcaacaggatctggggagatactggacttgggggtgtagggagaggtcaggactgatggggctcacacccaggtgtttggcgcgggtcatttacatcagttttgaatgtgatacacatacctaccctggcttgctttccctcctcttccagtaaattagaaacttcatgattgttctctgctcagattggctctttggtaggggagggtggaagtgtaactcccttggcagaggggtctggaggagcctagcagggccggtggcctcctcctctgcccccagccctgtctgtggagagcggctcctgctctctcaccctctcctctcccagcacccctccccactctgatcacagcctcagagtccaaatggaacaggccagactgttcaggtggctgttgccacgtctccctgagcccctgctctggagccccgagcaccagcctggagccctggcccagccaaaggcttcacccctggagcaggtgactctgagcgaggccatggcccgagtccctgtttccaggatgtttgtgtccctgtggacctgtctttgtatggctccatgtacttctgggagcctgtatgcttgcgccagtgtgcccactcatgtcacctgtgtctgtccgtgaatatgtgccctatgtctttttggatgtctctgtgtgttcgcatgtgtttgcacaagtatgaggtgggcctcttaggctctctcagggcccccatggttatcttgtcataaatggcagtcaggttagggtgctctgaaaggggctaagtgcgaggaggggccgagccagggtatagcccttgcccctgggggcctgtggtctgagggaagatccagacctcaccaatgtggcaaactcagcagaaatacaagttcccagatttgagaaacctctttgggacccctcatgctgcacttggcctcggtgttggggacccagggtcagatcagaccctgcccctaccttccagagccagcccaggcagtcagctatgcagttggacactagcgtggctgctgaatggatggctgtacagggcacaagaaaacaggtgaaggcatgcccaggcctgctggagagtcagggagggcttcctacaggaggagtttgagtggtgactacagagctgtttgggggatgagaggaaggagatagagaacagagctgggcttggcgtcagatggcactggcgggtttgaagaaaagggagatggggagggtgattctcatcttccaggcctggaggttggagggaatggaggtgtcttgaaatgcgtggaaaggaagaggagttcccatttggccactgtgggtatgagcttcctgtgggatgtccaggtgcagatgaccagagggttgcaggatacttgagtcttgaacttggtccagccagagatgggtggttgaaaccgtggggtggatgatactgccaagaaggatgtgatgggcaagggagggaaagggggcttaggattgagagcagcagcattcaggcctgggcagagaggatccagcgaaggggctggtgaggtggggccagaaagggggacaaacaaccaggcaatcagtggctgaggatggagaagtgccccatggatttacccacacagaagccattgttgaacttggtggcagcagagggtaatgggttttgcagtgggtgggacgaagtggagatatgggtgcagacaactctcagaagtttggatgagaagggaggagagaaagggaggagagctgggaaggggtgcaggggatgaactgcatgagccccaggcctgctcactgctgattggaaggagccagaagaggagagaggagaggccagagggaggagggagggtgaagtggtcatctgtagacacccgcctagtcctctgccaggggcagggagggtgcctggagggggtggtgctttctggaggaatggctgtggagggctgagggtgaaggaggtgcagtgctgggcaggcagccttcagtcttgccctgacctctgccagtcttcatatctgcagggtatggtggtagcagccaccctggggtgtggggaggatcccaggaggcagaagctccactagctcagagcatcctcgtaaaccaggttcaggtcaggagttgaagctcagggctgggcggggttggcctctggtggtttttgcatcttcagtgctcaccaaagctgtttcgtagacactgcaaacaagaaaggcctaggaaggtcaggacgtggatggcctgcttccaaagaggccacacccaaccccatctctgggcccagctctcaattacagggaagttcttcctttgggtctagcctaagtctttcccgctgtgtgttcccttctggtgaacttgttcaaccctgctccatggagccaagcctatcagctggccacttggagtggcggtcagtatttttacaacttgttttcatgaagatgatttgaagtctccttgcattcccagaatgtcagacccgccctgattcacaaggattgaccaaaacagggtctgagccaaccagaggaatttgaagacttagtcatcccccttggatcatctgcacattcttctcctttccttccagttaaaaaaaaaaaaaaaaaaaaaaaggaaaagaagaagaaagaaggaaagttagcctagatgaccagatgtccaggaagggacagtggcatttgggggtataaaccagctcagatgatgatggctgtggacaaaggggtgggacctgaggggaggggtcagtgcttggctttgcacctggcagacgtcaattcaagtgcatgttctgctgcttgcaagatggggatctttcacaggaaagatctgagcttcagtttcctcatctctgaaatggaagcattgatggcacccacctgagacacctgaagcagacctagaagcagaccctgagacaaggattcgtgtgacagtgactcattaggaagcttccctgctgagggaaacctgctaagggaataggaaacgtagaagcagaaagagaaggaggagaagcaagaggctatttccagccaagctccatagaaggaactttggctttgtcttccagagggacactgtaagtcataccctagggctgaccctccaggggcaaagatgctggagaattcatacctctccctcctgagtcaacagactcatgtaaggtgctgattgcccaggacctggcaccagcaagtgacagctgtgagaaaggggtgtgcagaagggggaatcccaggctgtgtggtcagcaaggggcagtgccttctgagagccccactgtgctccactgcttctctagccccaggtctttctctgtcagcttctagaggcaaaatcccacagagctcccgcccccattgttctcccagatgacttggctttgggcaatctctccaaccagtccaggtccctcccagccctagaggccctggtaacctgctgtagttctccctcccagcccacccacccagcccggagggcatcagtgacgagtaggaggtgggacaaggcttaagggcagaggttagttcaaggccatggaggcaccaaatgcccatagaggacatcaaagccactgtggcccatccccacctgagttgaatttggcttttcttcctagcccacccactctgtgtttccatagacggtgctcagggatcacttgggggaacttgcgttggtcaacacattccaggaacaaataaacaggttgcccttcctggctgtactgactaaatcctaagactctgactatgtgactctcactttcactggtgatgtcagcctgggttagccctcatgggatccacccttaactctctcctgtcccctgtgacatcacaagagatgttacccatgatctggcctccccactcaggcctctgggagtcagccccccctccaccagccccccacaacagaccatgacaggcctgggtgctagtccacactctgtcacctgctgtgtgaccttggccaagtcacctcctgtctctgagcctcagtgccctatgtttgtaacccattttgtatgtgctcaactaaaatcaggagattgtaacatggtgttaatccctgcttgacgcagtggatgcccagaaaggtgaagtgatttgccggtgatcacacagcaaaagagcagagagggccaggacctgctcccagccccatggccggttaagtgagcatcttactctttatcagctctgccctggcccactaacccctctttggttcagaacttgaattaagcccccagtggtcaggatgaactgagccaggcaccgaagtggtcagtcactgctgcaaactcattaactcatctgatacccatgtattgagtacctattgtataagggattctgtgctcagataagtacagttttactttcaccaggtttaacgtacaatccactgcagaggcctggggcacctgcaggcgccgagagagggtgcccttagggtggtggtcccagaggagaaagtggtctaaaaattccagagccccctcactgtccaggaggcaggcagggagtggctaggttggggaggtgaatgtcaggaaaacaagtttgttcactcctgggtattactgctgcctgtggtgggtccagcactgtgccaggctgggggtgaggccgggagacaactttgatccaccatcaaggcctccaccccttacgcgtcctgccacctttgttcacatgatgcgcttggtgtgtttgtctacacctttagctcatgggctcctccagcaggggctgcgtctgtctgctgggcacacaggagagctcaggaaatgtgcgttggtgactagatttttggtgtctagactggcttggtagtaagagtatgaattcaagagaccctaaaccctctcgagctctgtttaccatctataaaaaatatctactgcagccggacatggtggctcatgcctgtaatcctagcactttgggaggccaaggtggggagatcacttaagctcaggagttcaagaccagcctgggcaacatggcaaaaccccgtctctacaaaaaaaatacaaaaatttgccgggtatggtagcacatacctatagtcctagagactcaggaggctgaggcgggaggattgtttgagcctgggaggcggaggttgcagtgagctgtgatcgcgccactgcactccagcctgaataacagagcgagactccgtcacaaaaaaaaaaaaaaaaaaagaaagaaagaaaagaaaaaaaaagaaaaatagtctgcagcgggaggctaagaggcgtcagatagcgtacatagaaaccttggcctcgtacagagagtatgtccagcccttgtaaatgttgggcagtattacaatagatgggccctcggcactgtgccaggctgagcaggaaacatgagggagatggggtctggcccctgttacagccactgcacactgtacagtttacacagtcctgtcacgtcctgctcactggttctccctgtcatcccaagaggggatctgggcaggtcccagtgtccccatatgacataggaagatgttgacctgccttctagtggccaagccaggaagaaaagccaggtctcctggctctcagtctcctgctcactcctctgctcccccacctccccaacttgcttcctgctctctagaagctctttgtgaaacatgccaggaagagcagtgggcaaggaatgtggagatttgccagcccaggtgtcaggggctgaggaaaatagctatgggctacaggtcaccatgaccactgcccagctggatggcggggggcttctagcctggcgcagcagaggctgctgggccctcccagcctagccggctccctttccagggggatagtgtaacaagaactggggttggaagacccggggcaccctggctcccctgcaagatgctgttggagctgaagggactttaaggagtacagggtctgtggaagaggccagtcaagttgtgatcactgcccctgaggaaatttgagtgcttactgccctggaaatacagccccatgcacaaggcataagcataaggaccttccatgtggaaagcacttgtaaaaggcaaactggggaaggcagggctggctgacagacaagcagttgctcacagatgtgaagtcaccagcacagggggtctaggccccacaacatgagaggtggtgggtggggagtggacaggcctctcctaaatttggagcactgagagcaaaaatacaaatagagatccatgtatctttgtcagatattcgaagattgtaaagcaagccaggagactgttaaataaaatagatttgattttccctccttccctccttgacaaatataccttcacaatgtacattgaaatacgtacattgtgtacatatttacattgtgtaaagtttagttttatttgactgcgagtgataaaatatcaagaatgtctgaatttattgcacatctccgagtatattgttaagctgatgatgttcagatataaataataagacttaacaattcttttttttctttttttgagacagagtctgactctgtcacccaggctggagtgcagtgtggcacgatctcagctcactgcaacctctgcttctcaggttcaagtgattctccttcctcagcctcctgagtagctaggattatattgaatatatattcaaattatatatatatataaaattaaattcagacttatatatagtgtgtgtgtgtgtgtgtgacagagtgacagctctgtcactcaggctgaagtgcagtgggcgtaatcttggctcactgcaacctctaccttccgggttcaagcgactctcctggctcagcctcccaagtagctgagactacaggcacgtgccatcacacccggctaattttttgtatttttagtagagacggggtttcatcatgttagccagaatggtctcgagctcctgaccttgtgatctgcccgcctcggtctcccaaagtgctgagattacagacgtgagccaccatgtccagcctatatatatatattttgttgttgttgttgttgttgagatggagtctcactctgttgcccaggctggagtgcagtggcatgatggtagtgcactgcaacctctgcctgcctgattcaagcgattctcctgcctcagcctcctgaatagctgggattacaggcgcatgccaccacgcccagctattttttttatgtttagtagagacgggatttcaccatgttggccaggctggtctcgaactcccaacctcaggtgatctgcctgcctaggccctcaaagtgctgggattacaagcgtgagccaccgcatctggccatcaaattttatgtactttaaatacaatcacattttacttttagtcttttagattattgccatcaacagaacacaagtgatgaaaatcttgattataacaatataattagtgatcttgctaaagtaaagattttatggaataactaaaaatgaactgtggccacatgcagtggcttacacctgtaatctcagcactgaggctgaggcaggcagatcacttgaggtcaggagttcgagaccagcctggccaacatggtgaaagcccatctcttctaaaaatagaaaaatagttgggcatggtggcacatgcctgtaatcccagccacttgggaggctgaggcaggaaaataacttgaacctgggaggcggaggttgcagtgaatcaagatcttaccactgcactccagccttccagcctgggtgacagagcgagactctgtctcaaaaaaaaaaaaaaaaaaaagtaaacgaatgtaaatataaacataggaaaatttattgtatgttttcaagagtgtttttattccataaaatcatctattaaaattaaagctatacccatcacaattaatgaagatcagatttttaaataaaatctttaaatagacatgaaatattaattaaatttttgaaaattttatagaaatgaaactattcacagttctagtattcaatgtccatctagttgcaaatttaaagaattaataccagacttcatgttacattaatgtgagtaatgtgagttgcagaatgttgtaagatgttcctcagccaccatgtgcatttttgtgaatatcacactaattcatgagtacttttagaaccacaaattggagcaggaagaaatgccaaaataaaggatgcacagcaagaccggaatagagatgcttgcttatgcaagaaactggtgctcgctgctgtctgggaggaaggctttgacaagctaacttgtctccctcttatatatttttgccacttaggcccccccctgctgcactcctcccccaagcagcatccatctccctcctcagcagcaacacgacccatagaccttcacagcatcttaacagaatcaccttttgttcttcaagtttgagaaatggagaggcctggcgtggtagcatgcctgtagtcccagctactcgggaggctgaggtgggagggttgcttgagtccgggagttcaaacctgtagtctgccatgatttgcctgagaatagccactgcactccagcctgggcagcatagtgagacccagtccacaacgcatgccttaaaaaaataaaaaaataaaaaacagagaagagtttaactagggccttagaggtgttaggagcgaatgtttaggattacaggtcacatgagtataatgtgacagaggctcctgtgtactcttaatgaatttatttgtgtgtgtgtgtgtgtgtgtgtgtgtgtgtgtgagatgtgtgggggccccttttccctgtctaagggtgttcggggggtgggtcttcttgccaataaagagttctctatcatacaatgaacaatagacaaatgatagatcttacactgtagctagagttttatatctaggtatcttaatttactcgttcgtttcactcatgtgcatttgttcattcatttaaaaccctatatttgcaaggtgcagtggctcataactgtaatcccagcactttgggaggccaaggcgggtggatcatctgaggtcagaaattcaagaccagcctggccaacatggtgaaacctcgtctctactaaaaatacaaaaattagctgggtggggtgtgtgtctgtaatcgcagctactcgggaggctgaggcaagagaatcacttgaacccaagaggtggaggttgcagcaagccaagattacaccactgcattataacctgggcaacaagagcgaaactccgtctcaaaaataaaataaaaccctatattcacttgctccaacccttcatttcatgtggactaccaggttatagcagtcttttagtgcagtccatgatcctatgaatgaggatcagagagggtactgatgtacctaaggcatacagccagtccacagcagaaaagtcctcaggccaggcagcaaaaagtggagggtgagtcccaagtttgaatgtcaggtaaaatctgagtagatgttgctgtgtcccaatcagcttcccttccttcaccagcttccactactaagccatctgctccagggcactgggggatcctgcaggggttttctgcttgaagagccacttcctgtttggggccgagcacttccttcaggtgactcacaggctcccattggccccgtgctgggaaggcaaggtgggggtggagccagacccgggcgtgtcaccctctacctgagaccccagctgggtgacctgacacagggcagtgggcacaggctggaggtaggaggaggggaatggcaggaggatgtgagaccattctgcctcacccagcctattgggcaggatggagagagggcagagtggggatgggggcggcctccgcgtccagacaaccccacaggtagtttccagggcagccatgggcccaggtaaggctgacagcagagctgacagccctggggagactctgcggtactttccttcctgacaggcagtaaggtgtggtggaaggagcactgggatggagtcatggacttgtatttctcacaccaactttctggtggtcatttcagttttctgcccctctctggacctcaatatccatgtctgtctaatggggggaggggcttgatggctgtgacattttgtgccacttgtaggtttgagcttgaattctggctctgccgccttgctgagtgtgttcacttctcagaacctccatttcaaaatctgaaataatagtcactttaagtgttttacatatggtaactaatttaatccccacattgaccctatggggtaggttttattagtagtagtattttatacctaaggagattgaggcacagaaaggttaagtaatttgcccaaggtcacacagtaagagccaagattctaacttgtgtagttcgactccaggtcccatgctcttgactcattctggccttgctactcaaattgtggtccagggacctgcagcatcagcatcacctgggagcttatcagaaatgcagaatctcaggccccagcctagacttaactgagtcagaccacattttaacaagttccctaggtttccaaggtccaaggccccaggaaatataaagagaccatggcttctcaaacattaaagtttagaggagaagccactggtctatttatatttcctctgccacttaggccttaggatcattgtagggggcagaggaaataagtatgtttaataaactgtaaagtgctgtacattcagggcactgtgaggaacctggaggtgcagaagggcaggcctgggagtgtctcaagtgctgatctctctgtggctgtcatttccgagctgtctctgagtccagctctgtccacctctggttcacacacagaggtgtgtgtttggttatgtgtttcttgctggtgtgtggctctagaatccagttgggttggggagagttgttatattggcaccaggaggctcaggtcccagccctggctctgcctctatgtgatgtaggtaggcctccgtccttgcagcctcagtgtccctagtagacaaggtgtcagcatcctctgaagcctgcaatgctggtctgcagtctcctcctcacctctcctggcccctctgcttcccgtggcctgttggtaccatctcttttcccaattcctgggtggggggttgccctgctggctgcaggagctggcaatgggggaggtggtgcgtgagtcagagctcaggcatgtaattgtggtgccccagatcccacctccgggctaccgtccttcccttagcggctgctttagaagaacaagctggtttggcagctacctcagagaagcaggaccctgggcagcgtgaaagggcctctgcccccagggtggctgggctttggatcctggatccgtgggtcctggaggggcaggagtggttcaggaaacaggttatctgggtctgggcctggggctggtttgtgggcagcatgcgtggaggtggattgcatgtgctgggtttcatggctgggtattagatcacgtatgtcctgtcagcccatccaccagctttgtggcttccccagggcagggactcggtgtcacccatcactgggccccacacccagcacagggagggaacaggatgggtgctcactaagggtcacgtgggacagtagaaggcaggatggactgatgaatgaactcactggatttatccccttgtcctctcagctctcccagtgaagtgatatcactgcctctgtggacaagacacctccaggagcccagctcacagccaccggtaccttcttccaggtaaagagaaaaggagggaggaagaaaggagttcaagacagactgcagagggcagctgactgggttcttacacaatgtccacctcccccatgggggagtttatgaaaaaggcataaatgggattatcgtcccattttatggacaggaaaaaactgaagctctgagtagacttgtctcttgcttagtacagcgttccagatacttgtctgagagcccatgaggctgatgccatggttatccctgctttatagataaggaagctgaggtataaaggcatttagaaacttgctccattaaatacatgttagagctgggtttcaaacccaggcaggtcgccaggcatggtggcatgcacctgtagtcccagctacttgggaggctgaggcaggaagattgcttgagcccaggagttcgagctgcagtgagctatgattgtgccactacactccagcctgggcgacagagtgagactgtgtctctaaaaaaaaaaaaaaaatgaaaacccaggcaggctgacctcttcacaaaccctgtgatttactgcctctcaagagcccagcattaaactaagtttccttaacctccaatctgagggttgaatgggcttccacctccagagaagatttatattttaaaagagaatcctagagaaagtgatgcttcctccaaaggaatgaatgacaaatagtggatttggaggccttatatcatggaattagcatgaaccttcaaggtgggccagccagctcctgggactttcttcctcagcattcgagcaagctcggttttcattggtcaccaaggtgaaacctcgacatttgaaggaagggaggaaaagtttaggccccaggttctcggacctgcctggaagcagagactgctgttctttgcagaagactgtgaagagtagtgatgttcatgacagtgatgaaattagtatcctgtgccagatttgaggtcatcttacactagatatggtacagaaatgtgcaaatggatatcagaggtttaagaaaaatttgtgagagaaaagtacctaattgagtcttttttttgtaatttttttttctgtaaattgggaagaggctaattattattcagaggcagaattcaggctttcagaagtggctctgcagttgtgtggtgtaagatgctttgattggttctttttttccttccgtctcacatttaaccagctttttgactgacaactaaataggtacctccttggtgccaggcccagtgcaggggacataggtcctctatacagtgactcttctagcaaggacagggcctggcatatcttgtgtccccatcaccaggtgtggggctgcagacactataggtcttcagaaaagcttggccaagtggatcagaagtctgaacccggggaagctcccagtctggtgggtgaggcagccacggaagcagataattacagcgcactgaggcctgtgatcattctcaggagctctgccagatgatatgagcacaaaaaggaggaggcagtgggcttttgttggggggaatcagcccaagctttgcacagggtctgtttgttaagatggatgggatttggattgggatttggattgggatttggggagggctttcctggcagagggcccaacctgagtgaaggcatggaggtgggaaagctgggtaggtggtgtctttggagcacagtggtacaaggaggggtaggagaggacagagacaagattgctctgtacaagtctccactgtactcacgttcctcctcctcctccccctttcatttacttggtgtgccccactttcccactcccctctccctgggacttaggaagagccatcagaaaaagccaggctggcccctgcagctgaaccactgggctcctggaaggggcttgcacaagtcaaactgagggtgggggatgctgaaagtctctactacccccaaatagtagtcccggggccttcactggctctgcctgctccccagagaacctgtcagtgtcactgggggagaagggggtgggggcaggatctcttcttaggatggccttaatacagtcctggtggcttggagaaaactactcagccctccagggaggggagaggcctgtcactaggagtatgtgagtctagggaagccactgaccggtctggagaggctggagaaccaccagtaagagcagcacaggggatttctgaatggaaggggaggctggatggagtgcctccaggactttggtgctgatgttttgtgacttagcagtctgaaatccagggataatttgaagataccagttgaattattcaatgaggattccatgacactgtgagtcttgggtgaagtgattctagaggtccaatttggggcatttggagcctgagattttgagttctgagatgctaagctgtgccctctgggcaaggccaggtcacttttggtgactactcagcccaagctcatagccctgacctgggaaagagaagtcctttctgtaccaagagaacccaaggcccctgggcaggctcctgatttggggaagagctagtctaccttcgcctctgggccctgccagcctcctcccgagaggaatggcaatcagaggtctcttgggacagaagtgttgggtaaacaggaggccctggcatcaccgtggaaagagattaatagtgaccttaattatggcatgattgattcttggaggctctggctgagccccagcctcagccactgagtaacatttccccagagaatgaggaggcttgcagggcctgggtggcacaggccccacctgcctcttcacctcaaagcctctctccctgcctccttccaggcacctcctccccgagcctctccccactggcagctgcccctgtgacttagaattccttcctgcccctaggtctggttaccttctctgcagattccattagaatctagggctttctctgaggcccagagaggtggaacgacttccccaaggctgtacagtgagttggtggcagccggggatctctccattcaagccatcaaatgaggctatgcaatggaaaatagactgagtcttgagcaccccggaaaagctacctgcaggaggctggggccggagagcacagggcagggccggggataggtgggttccacatttcactggctgggctttttccagaatctttcctgtctcccccacctgcagccctcaccctggggccagagatttgttttgtgggtttgggtttagttgttttgttttgggaaacggtccacttggtgagctgtttgggatgccctctgccctgggagaagccccaatcactgccctccctgccacctaggcttccgctgtgctgtctccttacctaaaatgcccttccttctcccctttgtgctgcaaatcttttctcatttctgaattctgcatagatctcaccatctcctggaagcccctacacagtggtcaggaaacacagatttgtgggatccagaagagatagtgacccagtcaggaagggcttcctggaggaggggctacctgagctgagatgagcaggagtttgccaggcattgaggataggtggaggggctgcagggctaaggtggtttcataggcacagctgggttgggagcagggatggatgaagtggtgaggaaggaccacagaaaggccctggtcctgctccaaggccatgatcccggagccctatggaaaccatggccctgcacctttcatgcctggcattttactgtaagggaagtttggggtcaccactatttgtgagtcatctaggccacaatgtacctacaccttaatccctatcaaagatggtggaggcccttgggcagggccagagctctgccctggtgctcaggacgaccaggtgcctaaccttggtatgggccttcctgccactttcatccaagttttgaactgcgtcccaggagggtgactgtcaggatgcccagtgattagtcgtgggagcagagggggctcttccccagtcagaacagggagggatcagggattggccttcccttttcctcgagcagccccctctctgctttgctactgggggtgaggagagagcgggtagctaaagggttttagaagttgagtgctggaaaggcccttggagatcagccaagggtgctcaaaccctcccatgatacagatgggaaaactgaggccagaggcttggggcagtcactcagcctactggtgttccagttcagcctcagaccatcatcccagggctgggctggggttgaggccccgcgagggcagccacggccaaggagaaggggggtgtctctccatctgcatgcttgccccccttccccagggccctagcacaatgccaaaggtcggcctcccatccccaccagccctggcactgttgggggtttttcctttcctccccaatgttcctagactcattctgcctatgctttcctgataccaaccaaaatgttgagcttggccctttgaggtacaatttgcagttatacagatgctgcagctggcattgacgtggaaggtgatagaaacgtgaacaggcccgccctgtggggctgcaaccatggagagtctggactttagagtcaacagccccgggttcaaatcctccctcctccatgattagctgtttggccttgggtgaattacctaacctcttgggtgcgggtgcacacgtgtgtgtgtgtgtgtgtgtgtgtgtgtgtgtgtgtgtgtgtatttaatacactttttcaaaagcagttttaggtttacagtaaaattgattggaaagtacggagagtttccatataccctcctctgcctttctcctccccatagtctggcttattctttacatcttatattaatatggtacatttattacaactgatgaactaatattggttaattatgattgactaaagtccatgtttgcgctatagttccctccttgtgttgcacactctatggggtttgacacatgtccatcattactgtgtcatacagaagagcttcactgccctcaaaattccttgagcaccacttatttttcccttccccctgagtccttgacagccactgatctctttactacctccatagttttgccttttctagaacgtcacttagttggaattatacagtatatagctttccagattggcttctgtcacttagcaatatgttttcaaggtctctccattgctttttgtggctgggtagctgactcctttttattgccaaataatattcctcattgtgtgggatgcactgtggttggtttgcccattcgttcaggcccatgtttgcaatctgttaagaccattggcctttgctcaggaaggttgtcaaggggaggggacgcctatgcaatgctcagcacagtacccagcaatgacctggagtgcccacaccacccagcagcaagtgctagcacaacaaacagtaactattgtggctggtagtactcacaccgtacatatgttagctcagccagttctttttattattattatttatttttttagagatggaggtctcaccatgttgcccaggctggtcttgaactcctggcctcaagtgatcctcctgcctcggcttcctcaaagtgctaggattacaggcatgagccatggcacttgacctcaatcagttctggaacacatttattaagggcttaaaacctgttaaaagctggcaacacagtgaatatcctcataccaatcaaggtttgggattgcaaacaacagaaacaattcaggttaatttggcagaagagttccttggaaggaactagagttgtttccagaatctgaggggtctggagacccacgcctgggtaggagtggagagggcccaggtacagccaaggtttccaggctgttgtcccctctggtgcagctgctgctgacctcgcagcacctcacaactagtgcagacattcatgtgacttccagacctgggcacttaaacaaaaaaagttttatcgagataaagttcgcaaccatcaccactaattccaggacattttctttttttgtgggagggttggatggtggcgcacagggtctcactctcttgcccaggctggagtgcagtggcgccatctcagctcactgcaacctccgcctcctgggttcaagtgattctcctgcctcagcctcccaaatagctgggattacaggcgcctgccactactgcccagctaatttttgtatttttagtagggacggggtttcaccatgttggccaggctggtcttgaactcctgacctcaagtgatccaccctcctcggcctcccaaagtgctgggattacaggtgtgagccaccatgcctggccagggacattttcaccagcccaaaaagaaactccacacctattagcagtcactccgcctttcctccccaatcctcccagcccctggcattcactgagctactttctgtctcagtatttgcccattctggtcatttcttatacatggaatcatacaatatgtggccttttgtgaagttggcatgacgtcttcaagattcatgttgttgcctcaattcctttttattacagacctgagcacttccatgtattacctcatttagtcctcattccctgatgggtaaagtaaggctcagggaagaggtagtgacctgtccaaggtcacatagcaattcagttgagggtgaccaggctagaatccaggcacttcatgatcagaaaaggagctgagagcagtgcagtgcagtctggggggcacagcgtgggcctggcagttatgggagggagaaagggtaggggagcaggccagtgcgtcccgggatgtgaggatgagacaggacgccggaggtgcacgcccatcccagcatcctgcctctgctccatagtgcgtgtttattccatctcagtcatggactcttgcttttccctgtgcaagcaggaggctgtgcaagtacagggtaggggccaggaattctgacagaaaataggactttgggctggggaggggccttggacatcaggctcagaggtgagagcgttctcttgtcccagagccagcagtagctcttggcaggggatttcttgggaacttggctggtatcagcagccctgggacgtagcttggagaaatcgattggacctaagtaatgccattatccctggcaggaaggggaggggaggggatgggctggtgagggatggtggagagagtcccgtctcagagatcgtcccggcggccgagtgtggtgtaagtagcatgcctctgttagcagaacttctgggcacttctctgaagtatggtccaagaagtccctagtgcctcctgctcttgctgccctgtgttgctccctggggacatggggttaatgcagaccatcccatgggggaggcaggcatgtccacggtgctctcacagtgtgcccaggtaagagggagggacatgccagggatatgggaggctggggagacctctaaccaaaccgggcctccatggaggagggaacatctgacacttgaaggatcaggaggtgttcaccaggtgaagggaagcaaggctggaaaagcagtagtggtcagatcccggtcactgcctgttaggaagttcagtccagctgcaggtaagagtttggattggagggatggggctgaaagcaaggaatctggaggagtccccagccaggggagatgaggccttgaacaggggagtggctgtggggatggcgagaaaagggccttgagaaaagggtggtagagggcagtgtggctgaactgggtctgcaaggcctgggtgacaccgctggagacatccaggagctgctggctatctcgatcagaggcagagcctgggtggccttggcagcacctggtaactaaagccgtgagagtggacaagatggctgcagccaggagagcatacagaagagaaagaagaggtttgcctcccagagaatcccctacacttatgaacaggacaaaaatgcaccagggggagaggagactctgagagccagtatcagcgaagttctgggccgaggcatgacgcatgcacttctacttccctcttttccaggtttgaagtggaatttccattcctgggtgggttgtaatgtgcagtcgtggggacaggggaggggcggcagaggacatgtgggaattagtcccaggggcaggggggtcccgggaaaggagtgtgaaggcaggggaacctggggcgggctcccacgtgcattgcaggatgtccacctgttgtacctcagcattgcagtacctcctggcacttttccccctccctgcccccaattgtgtgtcctatagaagtcaaggcagcagctgttacctgcttttacagattcagaaaccaaggctcagggaagagcctgagtggccccagccacagagcaagtcaatgcgaggcagcatgaagctaggcttctttccacattgcacccgcctcctcccttcctggggaggcgggggcagatgtagtggctgacatgacagtagagaaccctgtctagggagtgcacagggtgagatctggctcccctggctgtggaccctggcctcccacccctgcgggaaggctgggaatgtgggggtgcctatgtgggcacgcagcactccccaaatctggagtatagtaaagctgagagcaccctacaccaacccccacccatggtctctctagccccatgggagccaagctgtgtccccaccccagcctgtcccccaggccctggctcagggaagccccagcagctgcaccatagtccacaggcctccccagggctccccggaacagaggctgcagcagtcaattcccagcactcaggagactctgggtcattcagtattcccagcaagcccctaatgcatcttccccctcagactgcaggctgtaatctccgcactgaggtgaagtcagcattgggtggtggtgttggagggataggcagaggccctgagtgaggcctggtggtagaagtagtgagtgggcctgaagcccagcgtgctcctacggtgcagcccctggggccttggagagtggcatcttaggagctcatctaccaagccttggctcagtgctgactccagggagcatactctgaccctccctgcactttggtcagtgcccacaggctccctttcctccctccatcatacactgcacttaccataaggctcgtgggccattagagcccagtcactgtaggagtctgcaaactttccctctaaagggccagacagtcagtattttaggctttgcaagccatatggtctctgtggcaactactcaacactgcagttacagttaaaacagccgtagacaatacataaatgaatgagcatggctgcgtccaatgaaatgttatttatggacactgaaatttgactttcatataattttcatatgtcacaagatatttttgttttgactcttcacaaccatttaaaaacataaagactattcttagcttttgggctgtacaaaaataggtggcagatcagatttggcaggcccatgggttagagcaaggtccctggagccaacctgcgtgggtatgaatcctggctctgctgggtgtcctttggtaagtgggtcaacctctctgtgcttcagagttctcatctataaaatggggatgatgatgatgatactttggggatgtaacatggtgcagtcacattggaaaagtttggcagttcctcaaaaggttaaacataaaagttaccatatgatccaggtgtggcagcacatacccgtagtcccagcaacgcaggaggatcacttgagccctggagtctgaggtggccatgagcgatgattgcactactgcacaccagcttgggcaacagagcaagaccttatctcaaaaacaaaagttaccatatgacacagcaattctttttttttttttttgagatggagatttgccctgtcaccctggctggagtgcagtggtgcgatcttgacaacctctgcctcccaggtttaagcgattttcttgcctcagcctcccgagtagctgggattacaggtgcccaccaccatgcccagctaatttttgtatttttagtagagatggggtttcaccatgttagtcaggctggtctcgaactcctgacctcaagtgatccacctgccttggcttcccaaagtgctgtgaccagcaattctatcccaaaagaaatgtgtacccaaaagaaatgaaaacacacgttcacacaaaaaactcattcacagaagcattatgtataacaacccaaaagtgataacaacccatatgtccatcagctgatcaatggataaacaaaatgtggtagatccatacaacagaatgttagacataaaaaggaatgaaatgctgatccatgctacaacatggatgagccttgagaacattatgccacgtgaaagaagcaagacacaaaaggtcacatattgtatgattccatttatacgaggtctctagaataggcaagtccatagagacagaaagtggatgagcagttgccagggccagaggagtgaagccagggtaaatagggagttacagtgcatgagaagggggtggggggttgttgggatggtgaaactgttttgggattagatagtggtgatggttgtacaacttgtgaatataccaaaaattgaatactgtatattaaatactgaattgtatactttaaaagggtaaattttatggcatgtgaattatatctccattttttaaatgcaaatccttccttccttcctagggctgctgttatagtttctgcatggaaagcacttggaacaatgcctggctgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggtttgtcatcggcaaaatggaataagaataactcacagtggtgtggaggactggatgacacctgatactcagggtgtgtgaggtgccccaagcccattgccacctggtcacactttaccaacactggcccccagaggccgaggctcccacagatatctccagggtgccaagcagggctggggcagtagcttctggcagccacacttcaaccctcaagacacctcttgctgctataccatcctcccacaggccccacccggtgagggagctccctgtgtctggagaatgaatactttggggcactagagcagttcctagattgactacagtccagttatgggacagcagccaggcattgctccttgttctctgagcctcagtttgttgaactgtcaaatgggtttaggacacagaacctgccacttcagatggttgtgctgatgagatggaacaatgaatgtaaagtatttacacggtgcctggtgtattttaagtgctcaacacatctcagcttatatgataatttcttctaaaatgtttattttgaaagtctgctatgtgctagacactgttcaagttactgggaatacagcagaaaatacaacagacaaaaatccttgccttcatgaaaactgcattatagtagggtagacagacaggaaaaataagcaagttatatttaaggacatgattgagaaaacaaagctgagaatgtgggaaggagcttagggaatgtgggaaggggctacagttttacagaaggtgatctgggacagtctcattgagtaaaggacatgtggccaggtgccatggctcacgcctgtcatcccagcactttgggaggctgaggcaggtggataacctgatgtcaggagttcgagaccagcctggcctacatggcaaaaccccagctctacaaaaatacgaaaattagccagatgtggtgggcacctgtaatcccagctacttgggaggctgaggcaagagaattgcttgaacccaggaggcagaggttgcagtgagccgagattgtgccacagcactccagcctgggtgacagagcaagactctgtctcaaaaagaaaagaaaaggacatttgagctaagacctgaagagaggaggggaaagagaaggaagccatgcaggtttctaagggaagagcattccaggcagagggaacagcagcatgctaggccagtgaagaacatggaagaggtcaggagtggctggaggggaaggagtagggaggatgagggcctgggtgggaggcagaggacaggtccttggggacctgcaggggtgggcctgtgactccaagtgagacggagccccactgcagtgctttgagcaggggtgaccctccctgacctaggctacaatgacttgctgtgtggtgcctgactcctcacccttcccctgcctcactgccctgtgcttcctcctgcaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccggtgagccaccctggaacagggtcagagggacccagtgagccccagcaagcctgaggggctgggggaggggtcttagctctgtctctgctgactcgctctggacaggccaatggcctttctgggtttcagtttctccctctgtaaaatgggcttatagtaattcctgaatctactgaccaggagggcatggaaggagtttgtcctgttgacaagttgttaactctcctctgacattgttgaggttgggctcctctagaagggaagggtcaccccaaggtgagcagaagttctcagcttcctggcagatcttgacaggcaggcaggcaggcaaacaggcaggtgctggaggagagggtgaggagatgggcctggccatcctggagcctgggagctggcagggccacggtctggcaccggggctcagtcacctgagccacaggcttgccagagctggcagcaggtgcacagccggataaagaaagcctccttcagtgctgggcttcccaggccagacctaagctgcactcctgtccctggggcgctgtcagccagtggatctagtttcttctctgaaggaacccaattcctgtgtggtgtttatctaaaagctttactgtctggagaacaactttcctcctccttcctgcttgtctgaacaaagaagccagcctctaaattcagccagccccagaagaggctggagtggccagggggtggcagggtgtgggccggggtgggggatggggagcggtggctgccgctgatgtcagaggcccagtaggcctggctgtctgtctggggaggtcggggaagcttatccacctgtctgccctcctctgcctgtgctgatgacggatagagccctagactgaggagcctgggttcgtcacctccaaatagtgaaaagcaggaactgccagggtgggcaccaggcctgattcattgccatctccccactcccggccacagaggagccaagtggccaaactgaggcaaaggagagggaagggcctgcccaaggccacagggcaggcccctggcaacgccaatactagagccccggtctctccactccaggcccctgctgggaagccctctgagataccatatgtcacagctttccctcttatgtggaggggtacagaccgtgggctctggagtcagatggattcaggttttggtggtgcatcctctacttgaatctagttgcctgtgagctccctcaacggtgaactggaggggagacacacccctctcaagttgccgctgggccatgacatgtgatgagggctgtaacgtgactggcacagtgccagctatgactagccattgagacaggtccttccagatgcccaagcctcagcctctccatctctgaaatgggagataggttgtgatcttggcttcagaatcccgtgaccactctaccgtgctccacactttgttctggatctggacctgggcaatggaggtccagcagccactggtgtgaatggggtggggagacagctgaggctaaggtgagaagaaggatggctgagctcccaggcaggaagccccttggccatcagggcagatgctggggaaggcgtatctcccagaagtctcatctccttggtgggcccaaggccagccagtcataggcatggagtcaggaagtgatgatcttggctgcagccagcacagggcccagagtggaggaagtgggctgaggctggttttgagctgactgagaaccagaacagaatgtgccctgcaaggctagggtctgggtcaccaatctgaggcaggggtctggggccaaggctggaggggcagcagggggccatgagctaggctaggagagggtatagggctttacagcagctctgggtggcagcgcctctgcagaaagggctgagctcacctcaggtgaccccaaactcacagctgaagatgagcatcctctgctcccccgcccctttctccctgcagtcgctcacttcgctccgccccctgtctcctcctacttcctggttcccagcctctgcccctcatcctttctctctctccccatttctcttttctctctctattccttcctgaggcagctgggtgagggcagcggtggggctggactctcacaacgaaggaatagcgacctagtgtctcaaagacagggctggtgcagggtaggggctccagaaatttcgctgaacaaatagaggtcttgcgtaagctctgcgggggctggtagggagaggagagctgcctgagttgaggggtggtggagacggctcttccagtgagcctggtttgtctccttattctcaccacccccgccccaggggggattctccccctgtatctcccaactcagagaagcctgggttcaactcctgtgaaacccgatctccctgagtctcatctgtgaaatgggctgaaaggtgggagagtcacgaggcattttattctcattctcaggctggaaaatgaagtatgaaagtaatagtatctgttaacatttattgagtacctactgtatgcagggagcaaacagtttacatgcattgccctagtcattgttgtaacatctccatgggccatgtttaattgtgtgcccattttacagatggagaaatcagtcacacaggctgatgatagatttgcagcctaaactgctggagactagggaagatagcgtgtgttgaagatgtgggtttaagtgagagtttgctggaagaagaaaggcaaggggacttgggaagttgcctgatggaggagaaagagcactggaccaggagcatttgggacaagatggggagtggccttgaatgccaggcttggaatcctcagtgtttccctggttatgatccagccctgggccctgaagtggatcctgggagtggagagggtgcgtggagagagcctgggaagggccccttcctctccatccacgctggtctccctccttcctgccccccagcctgacacattcccacctcttccaagcctttgccccccagtcccccaggatacacgcttaacaaataaagaagcaggaaaccaaggaccagagaggtgaaatggcctcttctcttgcccccagttctgaggagtggaggagcctggcagcaggaggccaggctcactcaacagccaggaaggggaagtagagctttttataactggggataattaattggttgttgtctgtgactcattactctaatactgccaattaaggacttggtaggacagaagactgttctcaggccatccccacagggtcccctgaagactgtgtctgcaaaaggcagtgtcaaaaccagcttctctatagagagggatataggtcagatgcctggaggaacttcccagccagagacattgaaagagacagactaccatagccgattcttgcacttctgtagtacatttaccttttgaaggctgctataatcttaattgatttcctccaggaagagcaagggagttattcaggccaaggggctgagggcacagcctgcactgaccccactcacacccccaggcctgtgccttctcatctgttccacaccaaacagtcttgtctggggtgccctgattacttattcaatcaacaaacctgtcctgctacctgctctggggtcataagtatatcagacctggttttcccctcccttgaagggccggcccccaggcttgtgggggaacagacaagatcagacacacctggaccacccaggtcgatcattttggaggcctggggaaaccctgggggcagggaaggcttgcccgagctggcctctgggagtatcggccccatctccacagaccagggaagtgttcagggtagggggaactgtgtgcacaagagagtgtcttgtgttcaggaactgaaaggaattcagtccaccggctcaggtgcagggacggggaagggtgctgctcagtgggcctgagcctgaagctgtattaaggagtctaggcttcatcctgggcagcgggggcctgagccaggctcgggctgtgtgaggaacactgtggtcaaattgtggaggatgctgagggccctcaggtggaggtgggagggccagtgaggcctcaggtgtctatgtggggagtgaggaggtatacacagggatgcaggctggggaggcattccagagacacctagaaggtatcaacggactggctgtggactgaggtgcagaggaaggagtgtctgacagtgaatcccatcctcccatcctcccatgatgcccagcgtgggtggatggaggcccatcctggagatgggaacacatgctgtgccccaggagcgagtgagagtacagcgttctcagtagagtccaggaatagcacaggaagggtgggcagaacagacaaataagcctccctaaccccagttgcctgccttctatgatgagatatgatgagagccccccatcaccctaccctggcaggaagacactcggtgtagggaaatccatccccagctcctctgccccttcccctccatgctcgtccacgccagccaccctgagcttctccgcatccacaggataacctcacccttcacagcactgggcctttgctcctgccattccctctgcttggaatgccctgtctttctcctccctgccccttaagactcattgcaaatccccctccatgcccccaacttctgccaaaaaatagccctcctccttcctttctctcctcactgctctctctccccaccttcctcactcccctggggttccacagcaggttgacctgtgctggccatgtggattgtgattttttgtttcccactggactctttaggatagcgtctgggcctgcacactccagggacctgactcagaggaggtcctcggacaagatttactgaatgaacaactggaaggaggattgagcatatgtgttcatgagtgagtgaggaagcggttaggggatgtgactgccatcttgctgaccaggtggggcagccggacccctaatgagctgtcagagaatgtaggcgtacatgtgcggacgggtgtgtgctgtgttcttggtgctgcctcctgtgctcctggtggtggttggcagtggagggtgctgcctcagccagagggacctcccagatcaccctgggagctgggattgggctctgccagtgcacaagagggaggaagagatgagtttcccagctggcccccactttttgtcctgtcagccatgtggatttgtgtccaggatatggagctggaaagaatggatcccactcaggaaatcagggcaggcttcagggatgaagcagccttgagatgggctccagggtgtggctggattgagccagatgccactgggcattcctggcaagggagctgcagcctgaacttgaccctgcctcccagtgactgagtgtgtgatctcaggtcaggcccagaccctctctgggcctgagcttgcttgtgggttaagtggaggtacacatctatgtcctacagatacaattagatcatggataggaatgtgcctcctgtcttgtaccaaagagaccattgttccaaccctgcagaaaacgtgccctccctacaaactttcaaagtgatggctttctctccttcagcgctttgaggaaaagagacccggcaggggtgagagagaggccctctgagctttatttttcccacttctaaaactgcaggattcctataaggataagaaactaggagatgatattattacatccacaagagagagagaggaggggctggtttgttgcagcatgaggaggtggggatttatcgctgcaataaagccatgctgtctcttgccttaggaaacccccacaccctgcctagctcctcttggaatagcaccaagggcacctggcatgaccacgtcacgctccaggggaagtggctaagtcttgttgatgacactctatgaacaccttgagcaagggtggggcaggagatggggcattaccaggggactatcaccacccaccctgtgacgtggtcagggtcctatgtagggatctgggatggttcttcctaagggcccctcagcccttctgctcatgtctccccaaggggctgatgccagccaagggataggctgggagagacagggtgccccaggcaggacttaattgcattctcctgcctaatgaaccactctgagtgcaatgcaccccagcagaagcaaggacagaggcctgattgcccagctctctgtagtccagaaaaataaatccagcctcttaggctgtcaggagccggctgggggtggggattctaatccctttccctgctcggccctaatgctgcaatatctcttcaacctccccaggccaccacctcccccaaatctcccggatcagggccagggtaatcctgccatagcctgcccatctctcccttttgggagctccctgcaccctttccagctgacatttcccaggctttcccgtgcatcagtcccctcatttggaacttggtgaaggtggaacaggctgaccattggaagagctgaggtgcccaagatttggcttgcaggtggcagattcaggagtaggcactcttcagtctctccctcttggtctctgtaggaccgtgtgctgagggtgcagctgggctctgggacctcaaagaagagctggaaccactggggagagggcttggctgagcagaaaggagctgtgccaggcagagcccgcacaagggggaaagggctgccttgggccaggttggaaaacctggaaacacaaccacaggcatctgagaactcactgtgtggtgaacaaatgtagaaattactaccagtatcacaaatgatgtagggacagctgaagcatccatttggtgaaagtaaaattagatccctgccttttacttcacaccaaaataaattccagatggattaagatgtatttttttctatttttaaaatttttttcccattttgaaggcatacatttgttgaaaaaatttaaacaacttggaaagatgtaaaagaaattctagtcttcatgctttagagataaggcttttaaacctctctccgcacacgtgacatccatatggaactatatatagatggatgtcgatggatgggtggattgcagattgaaatgtaagcaatgaagccgagaaatcgtgggtgtaaaatattacttaaatatatgatattgggccacccttcttaaatccaataccaaaggcaaaatgtataaaggaaaagagggatagatttgactacataaaaatttaaatttctgcacagaaagcatgataaataaaattaattcaaatgatatataagaaaaaatatacagtgtgtacgaaggctaattctcttacataaggaaagcttttataagcccataaagagccagttccccaaaataaagcctgctttgctctgtgccttcacgccctctgctccttttctctgtctggcttgaggtttcccaaccttgttctctcaataagtcctttccttccactttgctgcaggtgtcttctcctccaggaaggcttctagctcacccctcctcctataactgacaatgttaaggatccgggctctgagctcctaagcaacctgtgtttgccctgctcaccacaccaattcccaggagtggagctatttgctgccagtcttggctcagggtggcctgatttatctctgagtgtctaagggctcaacacgtgtacgtagatgactggaagagaagggtggtgaggatgtagaggagagacacagatttagtttggtacggggtgtgaggcaggggtctaattacagttgttaccaaatatccagatgtcccaacaccataagttgaattccccatcatttttccactaatatgctaatgtcctaatctcttgcccacatttccaggccattctccttctttagatcgaagtatcaccacttcttagttggatctttaggagatgaggcgagataatctctggcatcttagttaactctgaaatcccagggtccctgctctggcgcagcctgtgactcaaagtgtgaccttgggcaaggccctgtccctctgagcctgtttccaccttggtcagacaaggataatttacatttcctgctccttgttgccccgagacagctggggacactggaggtacacagacctggttgtgaattgtggttccaccattatgtgtgccctttgtgactttgggcaagtcccttccttcctctgtgacttggtctcctctgctttgcagaactgtggggatgatgagatggagcaagtaaagggctcttaggattaccatccccacccacccccaatgccatggtgagctcacacaggactctgttccccacagcccgggatgcagcctgtgagtgagattgggcagctaccatgccagggtcttcttcctctattggtgctggttcccagggccacagcctacagagccaggcctggcctctgcatctggctgaccatggcacccgccctgggttgggggaaggcaatcaacctggctgtcctcagcagctggagagatgtggtgtagagcagggaggaaaggtttgatcactgtcttcacataattaaagggctgtcagacgcgaaatgataattacaggaacgatcctggatttggcgacttacagcttacatctgtaatcgtgctggggcctggcagtcctcctgtgaggtggtggtgatgtcattctgtgaacagaggaggaagctgaggtcagaggtcctgagcgattggcctacagccacacagccggtgggaaaagggcctgggtgaaaatccagctcttttgtgtattctccactctgtggtcatttgaccccaatatttcttaccctttggctggccttgttctgtgtggtatcagagaaccagctgcaggggagcagtggaggaggcagatttcagctccacctcccggggggggggcgtcgggggagggcagtaactcccctgcctggaaggtcagcctcaccagatgccgtgcatgggaggttttagtggtctgggcagcatgccgatactgtccccattttacagagcaggaagctggggcacagagaaggtaaatgtcttccccaaggtcactcagtcgtggccagtctgggattcaaacccagtattgccagactccctcaacccagccttccgttgtcaggctccatgtcttggaaggaagaattttgagtccacagaaggactaggcagcatctggaaggagaagccccttcccaggagccagtggagtagagtagggtgagctcgtgtcctggaggctgcagacacgctcgctgcctcagggcaaggggacaggcaggggagctctgcgattctgaaattctgtaacattcagagtgatgtgtgcagacttcagaccccatgttctgttaagggaccaaggggaggtgctccataaccttcaggatccctagtagtgggaggggcagctgtgtgcattttggcctggggctgcagtctacagtggcaggggcctgtagccagtggcaaaaggcagcagcagagccatcccaccccagcggccatgcccatgcttcctgtgtggggctgggtttgcggctgcagtcgtgctctgtgactgtatgagcccccgctgctaatgaggtctttctctatgttcttctctgaacacagagggctctggggtgggaggaacaggacagagacaaagaagggtgaagagaagacatgaccatcctcaggagacagtgaggagaaggactggccttcagggaaattgacccacaattgcccagattgctacggaggggctcctgtttctggagggttagggtaataatggaaggagatgcagtggcctctgggttggagcctccaggattctccatcacagcagcccccacctcagcctccatcccctcgggcaggaatcagcatcctaccccatccacagccaggggccactcctgccccagctgctcgccctgtctggtccctccttaggcagtctccagcacactcctcctggtgcctaccccaggagccagctgctccctcagccccagcccactcagcttttctcctgctccctgagggtaagtctggggcttgcacgatggccctgcccactggtggccctgagcacccctctgttgccctgtctcacatccatacctccttctatccctcacgccataggtgaccaccaccttgtgcccggcgtgatgctgggcccaggagacatagagacagctcaggccatccctgccctgagggagctcgcagcccagtgagccaccctcattatgcgcccactgtgtgccacttgaagcccttcagctcatttaacagcctccctccgagggaagggctgttattcccatttacaacgaggagaccgaggctcagaggggccaagtgacgtgctgagtggcagagccagctctttagagcccgtgctctttccatctccacaattacaatttgattgagggtcacagtggtgggtgccaagagtctgtgcaggatggtcagggaggggagaccttttgagccctggagggatggaaaggcttcctgaaggagcatcaggtctggcctaggggtcagagagttggaggagagaaatccagggaactaggctgggcctgggatcgccatactgggtcccagagggcaaggtgggttttgaggggagctgttcaggctgcctcccaagggggcctgcagagtccagtcagtatgcctgggttcaaatcttatccccactcctcccctacctgctgacccctctgactcccctccactcacccgtgttgagcctttatgcaaattagcaaaaagcacccattttctaggacacacccgcccgccatgtgccagcaaatcgtcataatatgcacattgatggtcaccatgatgtgagtggcacttcttagggggcagtgcacaacttgctcagccatatgtggtggcccttctctgagcttctgtgcaatgggggtagatacccctaaataaacaacccctagtgttatgcagactgtgagagatgaaggagggccgtggccggggcattgaggcagcgatcactgctccacgtctctgggagcagggccagattggcttgctaatgggtggagcgggcaggcctctctctgctgtaatgtgccctgacaaggaccattagtgctattggggcctctttatcagtggagctgctccccaggccacttcctctggctacttcctcaccttccccttcccttccttccagtccctgccattcagtgttttcctctgattgttcttagagtgacccccgctgcctgcctccctctgtgctggggcctcttcatccccatctacaggctcactgtggcctccggcttcagctcccagggctttaatccctaggttgccccaaccccagctcatgcactagttctgatcatggggttcctggctccttgttgcttaggccctgcctgcattccttccatgcctggatgcctcacccccaaccaccaccagctctggtcttggctggttcccaggagtgggaggtgcagcccctcattcctgccctgccttgctccactgtaaggatctggacacttgaggacaatggcctttagggcataggaccctggctgccatgggccctcccggcccctgtggtcttcctggccccctgtcagccttgcccctgggccctgcatcaccccggtcacaggtcgtcttcccagcgcctacaggaggtgctttaccttcccgcctccaggctacttgcctgggaccagacccatcctaggccgaggctcacccctcgcctaggtccctctcagaaccttctctgctggtcagaggcacacaggccttgcccctgaggaggcaaagtggtctctgtggacagacagccatctaacactgccagcgtgggctctatagaagactaggtacttttttgtgggaactgggtgttaagcctcaggggaatctctcctgggtgggtgtactcatgccagggtaggagaaagggtgtttcctcacctatcatttcattatcaaatcttttcaagttcctgtgccatctggaacacgaaaactgcccagatctcaaggcatttatgtatagcagggagaccgacatgtatagagacagttctagaactgtggggtctgagccataggtgagatggctgcatgggttacggagctctgaggagatgggattcaccctgtgagacaggggagtcttcagggaggaggcactctggaaggagtagtttgcctcatggagcagagaaaggttgctttctagatggaggctccagctgtgtgaaggcttggggtctgaagagcctgtttggggaaccgtatgtaattctgtgcatggggcataaagcacagagctggcctgggccagacagagtgggccctgacatctactgagaagctcttgccagtgggactctcaagctggggtatgacgtgaccagatgggtgtcagtctaaagacatggttcaccctttgggagactcagatgtttaagctggcctgggactcaccagctgcactctgcagggaatgaaggctgttatgagcaaataagaatttgaggtggcaagacggattctgagaaggactagtcctggggtgctggctggagggtggtggagagacggtcatgtgcagacccagactgcctccatgggaggcaggactgagtctagggactcagccattctctgggtggcagctcctagggttcgattgctctagaagggcacatgtcctgccctgctcctagccagggtttccctattcctgaccaaggctgggctttgctgtgcctggaactggagcttgtgccattctgtgtccagctggggcagacacaagtggcctactctctgagaagccaccacctccccaagcctaaacctgctagaaatactgggcctcagggtgtcgtcacctttgcatctctgtttatgtacgaagtgaggctaagcaaggcagtcgggctctgcacatgacaaggagtggtggcagctgctcacccaaacatgagtcgcccaactgaagtgacccacctgggacaggagggtcacccaggcaccagccctcttgcccagggcgaggcacggagcaggcccttagtgggtatggagtcatggaccattagggtgtgaaggcctttcctacgttctggagaggcagaggatgtcacagatacactggtagtgtgctgagtgctcaccaagccacctgacttgtattatctcatttaattctccatcaaccccatggcataagtactagtattgccctcatttcatagaggtgaaaactgagtcacagaaagaatgagtactttgcccagagttacacagcttgtaagtggtgacagggatctgaggttcctgggcagactgatggtatctttgcatggtgtgggatggaaggattctggacagtgagaagactttccctccttcctgcccaatcctgcatgtggtcataaagtactagtagagtggaagtcggctcagtctctgtccttgcagaacccacacttgtctgggggacacagtgagcaggtcatggtgtgcagagcgtgagtttagacagagggatgccaatgctgcgggcgcaccgcggcaggcacgagggtagcagggtgaatccagggaggcttcacagaagcagtgatatttgagctgacttgaaaggtgagtgggaatgttcagggaacaagcccagaggcagtggcccttccaggttgcaggaactggttgtgtaggtcgaagctggagaggtcagggggccacactcctgcttggctatcagtaaggagccatgaagaggttaaactgggatggtttagaaacatagcagggagctcagacgtagggctgcctctgtgactttacaccctcaagggaaatgtagtcttggttcttcctcacactgacctcccctcaagggctgttgacttgttctgatgatctcagcagtttcccgggatgcaggatattccaagctttttgtgcttccaagataaggggacggatgaaagcagggagaaattggagggccaggaggaagtgcctgcagacgcctgagctggcccctcaggaaacagcagtggtggtgtcagtgtcccccgccaccccacttccacctggctggagacaggggtatctggcccagtggaggcagcagaacatggcacttctgtacttcttccttaatcctctgctaacttgctgtgtgacctgggcaagtcacttggcctctctgggcctcagtgtttttctcggtagcacggggtagaggtggagaagaagagtgcctgctttgtaggcatgtgtgtgagggatgtgacttcacagactgccgatcactgtgccagcgccaagggagccgtccccagaatagggagagcagtacacgatggaaaggctgcagaccacagtaaaaagagcacagccccagggggggaggccctgactgcccctggctctccacctttctgtgactttgggcttggtgatggtggacaggtcacttcccctctctgaacctcagtttctcccagggtaaagagggcaggaattcctgcctggcaggtttggctacaaagtgggagggaggaggacacattctggtgggaggcagcctaaggggctggcccctgacccacttaatcccctcctcctctgctcttccagtgggagcgcctctggttcctgctcctcaccttcacctttggcctcacgctcacctggctttacttctggtgggaagtccacaatgactatgatgaattcaactggtgagtaggggcagtgggtgggggaggaaggggcccagagctgggtatccagtagctgggacctgggggctggagttagagcctgtctcccaggttggccctctgagctctgccaccagctctctgtgtggccctgggcagggcctactccctgggagcctctgtcctgctcacctccagggctttggtgaggaggctggtgtgggactatagtgggaagtgccagaggtatgggtgaggattgtatcgcagactggcaagaaagaggaggaggaaacagagagatccatgccccgaggggagtcctactgcgaactcagggaaagcttcctggaggaggaggcatgggaactgggccttaaagaatgactgggattgaaacctggggaactttagctgctggtcttggagaccccttggtgcttgcattgatgattcagcctgcattcctggcctcctgaagaggtggaggggagcctcaaagaacaaaggcttacaggagccaaagcccactggggagacacagggcattccttcccggtgctgtgaccatggacaataggaacataaggctgggccagggctcaaccggggcagggccctttggttaccccctttgtatacaagaaatctacagctcagagagaccaaggtctctgcagaggagatagccctggatcctaggcctcctaactcccttagctaggccctgggcagggctggcagatgagtttggggacagctcaaggtcctttgtgggtacctcagatccaaaggcagggccgtctgagccacttacctgggtacaggaggggcacctgttttttcctcttcgccattccatcgcctgccttttgctaagcagtggagaggtcatgggaggagggcaaggacccagggttctactgacagataaggaaacaggcccaggtcacacagccagttggggacagctggggcttggaagcctggctcctcactccccatccattgctgttccttccttttgatcagatgttcaggtcagcatggcgatgagcaagtctctggtgctctctaagcctctccttctgtaaaatggggtaactctgacctcatcaggtctttctgaggatgaactgagatgatggacacaacagggctcaaagctctacctaaacatgagggctgcttcctaggagaccacatctctagccggaaggcagcatgatgttagcatttgggattttcaggaccctgggcttctgacaggctgtggtgttaggattctgtgatgatcctgggactctgctcatggagctgggtgtccacttttccccgtatggcaccaggctgtgcctctcttattaatgagcacaatcaagaatatgctgcggtcccacccctgccctgcggcagccaagcaagatgagccggagccctggcagagtcccagaggtggcctctggcctttattaaatgccataaatcaattattcatctttgcagatgtccaaagcatgggcactgtcatgagtaaatgggaacgttccctactggccctcaactgcagacccagacagttcctcggaactggagtctgctgcctagaagatcatcaagtctacccccatcatgtacagatggggaaatggaggcccagagagggtgaagactcattcatggtcacacaaccagttagtgccaaaaacatgaattgaggacagactgaagagaccaaggcttagagaggttaagtagcctttccagcgtcacacagcaagaagcagacagatctgggaccgggacttcagcctgcctgactgtgtcatgtccatggagctacccactctacccagagagtgagctccctgtcactgggagtttcaagcagaggatgggttcccgccctgttggggtggtggcaaggggaggcctgcctggcacttagggatgcctggagacctgcagctccttcagcctgtcgcctcagtttcttggagtcagtgctggggttcaggatgccccggcccagtcctgatagtctcaagagtctctggggaccgggcacaatgactcatgcctgtaatctcagcacgttgggaggccaaggcgggcagatcatgtgagtccaggtgttcaagaccagcctggacaacatgaaaaaaccccatctctacaaaaactacaaaaaattagccaggtgtggtggcatatgcctgtggtcccagctactcgggaggctgaggtgggaagattgcttgagcctgggaggtggaggttgcagtgcagtgagccgagatcacattttaccccattctgtaaaatggggtaactctaacctcatcaggtctttctgaggatgcaatgagatgatgaacataagagggctcaaagctctacctaaacatgagggttgcttcctgggagaccacatctctagctgggagaccactgcactccaggctgggcaacagagtgagactctgtctcaaaaaaaaaagaatctctgggaataattcaattcatacagtaagaggatgtgagtgacagccagggatcagcactggatgaggagggccagggagggccgtcttggctgttgctgtcctcaaggactccctgctaaaagtggtcacacttgagagacaaatggaaccagaacatctttcaggaatagttatcaggagcaagtcttgcccctcttcaggcctcagtttcccaacggtatggtaaggtgagtgcattcagtgatctgccaggcagtagattttcccctggactctgaggatgagggccagggagggcagatgccccatgggttcctcccggtgtcccttcccagctgtctggcaaggtcccagatgacagcaggctgaagctgcccagcgctcagattttctgatgaccttgaacaagttgctgcctcttttgagcctcagtttccccctttgtacaaggaggatgtgagtagttcattcttttttttttttttttttgagacagtctcgctctgtcacccaggctggagtgcagtggtatgatctcagctcactgcaagctccgcctcccaggttcacgccattctcctgcctcagcctcccaagtagctggaactacaggtgtctgccaccactcctggctaattttttgtatttttagtagagacggggtttcaccgtggtcttgatctcctgacctcgtgatctgcccgcctcagcctcccaaagtgctgggattacaggcgtgagccaccgcgcccagccggatgtgggtagttcattctttctggagagcatctaagcagtatctatcatgccccttaaaaatttcaatcccaccagccacagtggtatgtgcctatagtcccaggtactggggaggctgagatgggaggattgcttgagcccaggaattcaagttcaccctgggcaacatagcaagaccctgtctcaaaaaaaaaaaaaaaaaattcattctctttgaccctataattgtatctgtaggaatctatcctaaggaagtaatcaaaaatacagaaagatatgtataaaaatttcatttttatgttaatttataattgtgaagaattagaaactatttcatgccactagtaggaagctggctacatatggtacattaattcagtggaaaaccacgtggctattttaaaaatcacattttctcaggatttttactggcataagtaaatgcttgtgttgagaagacagttggccaggtgtggtggctcacgcctataatcccagcactttgggaggctgaggtaggaggatcacctgagctcaggagtttgagatcagcctgggaaacatggcaagaccctgcctctacaaaaaatacaaaaaaaattagcccgatattttggtgggtgcctatggtcccagctgaggtaggaggattgcttgagcccaggaggtcaaagcttcagtgagccatgttcgcatccctgcactccagcctcagtgacagagaccctgtctcaaacaaacaaacaaaaacaaagagagtttattgagtagttaccatgcatctcacctcacttcatcctcatgagaccccatgaaaggcactttttatttatttattttatttatttatttatttatttatttttgagacagagtctcacactgtcgcccaggctggagtgtagtactgcgatctctgctcattgcaagctctgcctcccaggttcaccccattctcctgcctcggcctcccgagtagctgggactacagacgcctgccacaacgcccggctaattttttgtatttttagtagagatggggtttcaccatgttagccaggatggtctcgatctcctgacctcgtgatccgcccgcctcagcctcccaagtgctgggattacaggcgtgagccaccacacctggcttcaaaaggcactttcttatccccatcctataggtgaggaaactaaggctcagagaagtcaagtattacattcgatcaattctaagacccccaattttcacatcttaacattgaagttgagatgacagtgacaatcgatggcatcttagaatcagtgaagcctgtcctccacaaggtcctacaagacagtgaaaagcagagacgagaggggatgtgaatccagcctgtgtgcctcactccaaagcctgtgctcctgaccgtgttgctttgtgcagcggggtcctggctttgctgtttatacaaacatataggcatgggggcgggggaacccacaggaggaagatccagcacagccttggtaatgattacttctggccaataggattatggggcattattttctcctttacatttcttggtccccgggtggctgccatgagcaggcatggtagagcatcaggcagacgctgagccttattgctaggtgggcacagcctggtcactgagcccagcctgtcgtctgtgtggaggctcagaccatcctgattcctgggccaggtagtggcctggtggaggtctgacccctgccccctctcctcctggcaggtacctctacaaccgcatgggctactggagcgactggcccgtacccatccttgtgaccacagctgctgccttcgcatacatcgctggcctcctggtacatggggctgttttggagggcaggtggccctgctcccaggggaagggatactggccctgtgctgggctgatggagggtcccaccctggtataaaggggaaagctgtatttgtaggaatattgtatttgtaggaatgtatcctaaggaagtaatcaaaaatacagaaagatatgtataacattttcatttttatcttaatttataatagcgactaatcagaagctatttcatgccactagtaggaagttggctacatatggcacattaattcagattttgcccagggcctctcgggctgctgcacctgaggcctgggtcccccaaagcaggaggtcctcttgcttttgcccgtctctctaggctgccccttcctggaatgtttgccccggacccagtgagagctgtcctggccgagagggcccactgcaggcttcctcttccaggagcctctgcttcaggctcttgctcccgatattccactcactgagatgcaggtggatcccccatgctggactgggggctccttggggacaggctcaagtctgtttcagaatcccggggactggaactcccaaaatgtttgatgaatgaagttgagtagtccaagtacagcagcacccagtgacctcttgacggggaatcacacagaggaagagcctagaggcctggaatcatctgggaggaggccaggctcaggctggctagtctgggctgggctggggagggcagcgcattcccatcgcctggagggaggttcgctgcctctgcccagggtcaggcccagagccgcagtggggagcagggtgtctgagaaactggcaaagccttcccgcccacacgggcctgacaatcaccctgtgggtccctcctcaggtcctggcactatgtcacattgccgtggggcagcagatgaacctgcactggctgcacaaggtaagggccgcctcggccggggctgggagagagcaagggaagctggaggcagcagcagcagaggaagggcctggccaccatgtccctcccctggatcaccgttagaattgttctcatagctaaggctgagcactcactatgcgccaagcacttttctcacaacctcacccgtcttcattcacttaacccttacagcaaccttgtgatgtaggtactgttatcattccattttgtggttggggaaactgaagtacaaagaggttaagtgatttgcctaaggtctcccagtttaaacatggaagatccagggtcccgcagtcatgtgattaaccagcagagctcacagctcatactgtggcacccaccctctgggggccctgcctcgggtctcacctgcctcttccttctttggtgagctcttttgaaaaccctgatctggcgatggcattccccaacttaaagcctttccaccactcccaccgctcccaggatgacccaaacttccctacctggcatgatctggcccctgctgatctcccaacccatcatgggacagtcaccctcagcttctgctacatgagacatctcatgctctcccagcatgtctgcctccttcccccgtttagcactttgctcttgccctccctttttctctcggaccccttcctcagtacctcccctacatacacaggattctctcccgggacttcctcagcccctgcagcctcccctgctacatgtctgaacagctatgtttttgtgttttcagtattcgtctggctccctgaccccgacccacccagtcaaggtgctctttgcaggccagagttaacctccatctccctgttcccagtgccccccctcagggctgggcccaaagcagacaggcttcacccattccggagccttaactctctgccttacgtccattgcaggcatagtgctgaagtgtgtttctgatgcctggccttcttggggccctggtgggcacagagtggtaccgagctgaccaaggcagagcccctccctcccaggaacatctggatcgtctccctttccccagagcctggctccccgtgggcctgccatttaggaaagggcagaaatgttcagaaactaccatgagcccatgagatggggccagaatgactccaaggggaggggctcacttctagctagaagacggatgtggaataggaaaggaagaggggacagcatgagcctgggttgggctgtgtggagtgggaggtgcctgtgagcatccagggaggcaccgaggccggtttgttacatgggcctggagcttgggagtcagaccccagagactgaagtcttagagtggtaggagccgtgagcagcccctggtccccccaccttcctcctgccctcactctactcacaggcctcctctgggcttccactatcccctctgtgagggagtttcttctcctggctgcaaagctggcatttgaaagaactgcaccagctggcaccccgggtggggctggcacatgctgtggtcaccttctggggccatgcctggctctcagcaggtaaggtcacacatgcttgattctagtggagaggcctatagagccgctgagccagctggagctggcagatcaatgcaaggaagcagatcccattgtccatgctggtgccagctcccagggtgccttcctctgccctctgccccctatgtgagatcgcagcatgagcagggtcctttcaggtggagctgacccagagctcgacccgccccaccaggagggagttccccagagctcagagtgttccagcagggcctggaaattctcttctgtttctaagattctgccatttgattctaaaattctaaggactctttattcttttttgtttgctttaattaacttttgaccatgtaatacatcgacatgattcaaaatacaaaaagcacaaaaaagtatacaaagaaagtctcctcactatctttccagacagattttaagcacatgcacatgtacatatgcatttcctttttcttttttctttaaacacaaacagtcgcctactccaccctctgttccgcaccttaacagaattcttggagctccttcttcgctgcattaaagcatccctgttggtatccatcccttgctcctgctccctggtctggatattccctgattccctaggcgtctagccagttccctgttgatagaccggatcgacatcccagctgctttctgtcttttgccaggacgatgtggtggtgacctgggagaggaatttctgggtgaagaatgtgtactttcatcattttgatcttgccaaatggcctccttgccaagtgcctccgattcatgctctcttagcaatggatagttgttctataaaaacacccttgcccataaagcatcagctgatttattggcttttgtcagcctgatgggtgaaaagtggtaccttgctgtagttttcatttgcatttcccttcgggtgagttagattcggcatttttcacatgtttgagtaacttgtgttttcttttctataaaactgtctcttcatatcttttgccatttttgccattgctttttgcttattcatttgcaggaactctttatagatgtgggaaattagccatttggctaacaaactgcaaataattcttcctagtttgtcattcatccttggactttgctcattgcgtttttaccatggggatatatatttttttattcttacatacttgaatctgtcatctcttgatgactccttggttttgtgtcagactcagaaaggtctttcccactccaagattataaaaatttttctatggtgtcacttggtaattatatatttccacgtttttaacatttaattttttctctttttggaagctattttggggtatagtgtgatcttactctgttctttttagatggcttcccaacgtttccaactctctctactgagaatttgtcctttattcatttgagatgctatttttatcatatactaaattttctttatgtatttggatctatttatgaattttttgcttattttcatttatctatctggtcttacatcagcaacatagcactctaaagaccacagttttatagtatgtttgtatttttttttttttttttagagacagtcttgctgtgtcgcccaggctggagtgcagtggcacgatcttggctcactgcaagctccacctcctgggttcaccccattctcctgcctcagcctcccgagtagctgggactacaggcaccggccaccagcccagctaatttttttgtatttttagtagagacgaggtttcaccgtgttagctagggtggtcttgatctcctgacctcgtgatccgcccacctcggcctcccaaagtgctgggactacaggcatgatccaccatgcctggcctatagtatgttttaatcatgaagtttgagagtctctggttcccctgggtcctgaggaggggaggacagagatgctcaggacagggtgagagggagccattcacagcaggctgggtgctgagtagatctggtgcttatgtggggaccttcctcctcctccccagtctgccaaaatctcctgtttcccagaaatctctcccaggtgagtgttcaggagaaattgaggtacccaggaggtgagggagcaggctgaagggttcttgggagctttacagtaaacaggaggccctttccctgagatgccccccttcctgccccacccaccgccctctgtgaggtgttttggtcacagctcacacctccccaggctgccctgagcacactgcactgctcttctgtcctcgcctgactcccctgcctcagtggcagcagcccccagcccaggacctgcacagaggaggcgtctgtcagcgacccaacctgagccccagagaggagcactgggtaccacacagccccaaggcaagttactggctgggctggggctggggcttctgcctcctaccaaggctccatcagcctctacctgccatctgctatgtctacttcatcacctctcctggtgaattcagacttctctccatgcactggccccagctttatggtttttcctggtgtccagcctctgtccctccagcagcagcttaaggaaggcgcattcactgagcacctcctgtgtgtgccaggcactgcgttcaccataacagcagtaaccatcctttattgggtgctgaccacatgtgtcaggcacctttcactcagaatttcacagtcatttcactcctcacaataatcctgttcccatatcatgctcactttttaaaatgatatcactgagatttagtaagcattttcttctggccagccgttgtactaagcatttcacttgcatttcctcactgatcttccccaacccccttccaggtaggtactcactatccctatttcacagctctggaaaggtccctggagaggatgtggaaagatccccagtaggtagcagagccaggattcgactgaagaccgtgattcaagtgaggctcttaaccctgggccagctgtctgccatttggactgcaaaacccagaggccagatacccctaagaggccagctgttgcacctctgcaaggcggggttccacctcctctcgggtcccggcacctaggccagactcatcgaatgaatgaaagactctgttgtatcccctgtacccaccatggctatcacaagccacagtcccatgaagacagagaacccaaggccactttctcagaggaggacggtgatctgtctctgggcctctagggtgggattcatccttctcagtcagatttcaggagcgatggtggttgcgtttttgggtgtcagtgctattgctataacttaatgatgcaaggtagggaagtcccacagacactgaacatgcagtgatgctgctgagtgtgttgattagcaccaaagcaactgtggaactcagagataataacatttttaattgtattagggtttggggaatcagttttattgcaagtcgtttccattaataggtattgtgatgagatgctcctggaaaccatccttaactcactgtgtgcagggccacctcccacgatggccacaagggggagctgcgcgccgggggcagccgggagaaggggcctgagtgccgagggcggggttctcaggggttcggaggcgcagctgggcctcccagagactgcgcagcctctctgacaccagcgtgctgtctgtccgagaaagcgcacacccccttaccccctgagatgggcagaaggtgttcgtttctggttctgccccttcaaagctccgtgacccagccagctgttcctctccccgaacctcgcttcccgtgtgtgagatgaggatgctcgtgcctccgcggaaccaacctggggaccacgcgaagcgcccccacaggcccaggcacgcccatgcctcttcccgccccgagcccccatgtcacagcccttccagctcctcacctgcctcgctcaggtctcttgggggaacatttgtttccaggctgatgggctggaatgaaaagcctccaaagggaaacttcatcccaggcgagactcagcattccccgccggcgagtgaaggtccctgggtagggagcggagatgctggccaccgccccaccctcatcgtctagaaatgccactgtccctgctcggcatcagagggccctggccgctgctgcctctgggaaaggttgcctcgggagaaagggggtgaaggccctgccagcagctagaacggctccagggaggcagggcggccggcagtgctgtgggagaaggacaggcctttggagggagatgggagacgagtctggagaaactagggggacggaggtggcggctttgactgacccttccagagactgggatctgcgggaggctttggaggagagccacaacctgggcttcggggaggcacgcctgggggtgtggaggggggtgggtggagtgagatccacggctaggggcgaggggctgggggccgaggagccgaaaacctctgccgagcttcacgtggttaaagatttcaggtcttacctgtcaccagagatctctgtcccgtagaggtgccacctcatcctccatgagagctgtgctttgctttcttctggaggctgcaaggaggatggcccccatcacggcggacctagatgctgggagtccgggagagggcaggccgtggagatggggcaggtggcgatgtgtttcaccacccactcccgcctgaagtgccactgtgagcccagcccagggtgccaggctgggctgcactccaggctcctgcagcagacccagttcctcagcctccttcccctgaggcctgggcatggcctggacaagtgggtttcctcctctgctgtgccatgctgaggtggcagggaggctgggcgggaccttggatgtgactaacctgccaggcccagggaggtcccccttactgaatgtcctccctcctcacagttccctcctcctcctgtccccatcctcccttccatttctcgctgtcccttcctcgctgggtctgccggcctcctgctgcctcctcctgcctcagtctctccctgccgtgtctatctgccggcctctagtttcctggcagcccatgcctgtctctttcctccctcccctctgccctgctccatcggcctctcctgccctctctgtctctccctctggctcctctctcagacacactgggaaccctcccacccgctctgagcctctgtccggtgactcttccccctccagatcgggctggtggtcatcctggcttccacggtggtggccatgtcggccgtggcccagctgtgggaggacgagtgggaggtgctgctgatctccctgcaggtgagtgaggagggtcccccaggaccctcacaacaagagcctttctgtcacttccctttctccagaccaaggcccaaagaagggcagggaggcgcccagggtcacagagcaggtcagaactagggaggacaccagggtcctgaggctcccagtgtccccagttggcagatggagacagggttgcctgcctcataggtagaagtaggaggctggtgacacagggtctgggcagagctgggcgttactggtctcccttccctctccctgcaaacagggcacagcgccattcctgcatgtgggggctgtggcagcagtcaccatgctctcctggatcgtggcaggacagttcgcccgcgcagagcggacctgtgagtagaactgtgaagggcctgcccctccaatccctgcaggtgccaagaccagctggtgctgccccgacctgggctttccctgggggtggcctggggatggggtggggcccctgcactcagtgagggggattctggctcagagtggcccacagagtccacggagggtcacagcttcagtcggcctcacactgtattcctcctccatgtctctctctctgcatgtatgcacctgtgtctgtgtgagttagaggcggggttcatcttcccagcaagaataagggcttccccctagagcacctggatcctgacaggtcgggggtagaggggtccagcattgcaccccaacctgcccagggctcaccaggcagcactcacggccccttatctgcagcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatggtgagtgccacctcagggtcctaacagccccgttggggtggggtgcgatgggggggaccttcttgggaaatggatatatgtaatggtagcaaccatttgtagctttttgaggggaggtacatgggaaggactggcaaaaaggccgggagtgctgggatggaagcacatcttgaagcgtcctgaaggcatcttgctaaaaagatttcagttttgtcctaagtgccctgcaaagatgcaggagggttttaggcccaggctagacccaggtgccagttaggaaggcccaggagatggatgctgagtgtggggcctggggtctgccaccaggcatcaggagaaccctccaggagagctgggaggcagctcagagcccactgtgacagtgagtacggctgaaccgacgtgagttggagaaagacgaagggatcaaagtcagcgccgcattctgccaccagtgcactccatagccctgcaggagagcttcggtgagagggcaggctccagagccatgttgcctgagttagcatcccagcacagctcctcaccagctgtgggaggcccaacagtttccatctctttgcctggttcccccatcttgtaccatgggactagtgagagcacctgctgtggggctatgaggagcaggagttagcatgtgtgcagtgcccaaatatgcacatggtgcacagaaagtaagaggcagacactgctgttaccttgggcagggccatctctctggagcagggtctcctgctccatgaaagccttgaacccaggcttcttagcagaggtagtacacacccccaccctgccaagtgggggtgtgtgtgagcacttcctgagggcttggcttcctggtgttccaggctgttgtgggacctcagggtagtaagggggtctcacataactgctttggaaggaggtgctgggtctgccgggctgccactcactctggaagtctggccccctgcatgtggtgggtattattttctcgataagactccagcccctgagccagactccagtgctgaccccagtccctcccagaggcagccagtggggatctggatctggtgtccagtttggccacatgctgcctgtgcatcttggaggggtcaccagtcccctctgtgcctcaaaggtatggatgcccatgctgctggttattgtgaggaccaattggagcccagccttcccagtgggggcaggggaactcttctgaggggcttaaaacgatggcccctcctgtctccatgactcagattaccatctcctgggctccctccagcagccaggggacataagtggtatgctgaagcaggaaggtggccccagcgaggatggttttctttagtagaaaaaggtcaaatatatgcagaagtggagaaaagcatataatgactcacataatgaagaaggatgtaatgaatccaatcccatacttatctacgtttggccattcttgcttcatctgttccctacttttttttctggggtagtaaagcaaatcttaggcatcgcatcgtcttacccataggcacttcaggatgtatctgtaacacatgaggacttcagaaagatgcatagcaacaatgctgttattacacccagccaatattaaggataatgattccttaatattatctaaaatggaatccatgttcaatttccttttattgtctcgaaaatatctttttacagtttagttgttaaaaatcaggatccaaatgtggtccacagcacgcatctggttggcgtgtctcctgagtgccttttgatttgtaacaatcccccggctgggctcagtggctcatgcttgtaatcccagcactttgggaggccaaggcaggcagatcacctgaggtcaggagttcgagaccagcctgatcaacatggagaaaccccatctctactaaaaatacaacattagctggatgtggtggtacatgcctgtaatcccagctacttgggaggctgagacaggagaattgcttgaatccgggaggcggaggttgcagcgagccgagattgcgccattgcactccagcctgggcaacaagagtgaaattccgtctcaaaaaaaaaaagttccccgtcccttttttcccttaagctgtttatttgtcctgagaaatggagtcatttgtcctgtgggatttttcacattctgcatctgactgatcatgccctggtggtagtttttgaggggctggcaagggtcccctctgtgtgtccctgtgcattgccttggggggctctgactctgggtccacatgtctgtgtgtggtgagcccaagtgcacatctctgtcttggagactgtctgtgtgtccctggatgtgttgttcctatgcagatgtggcctgtccctctgtgcatgtgtgtacgtgtactttaatatttgattgcactaactctgaagctaagactcttttttaatagtactttgagttgctgttttataaatctgggtctcttaaccatagtgtcccacccacctgagtaaccaccacccccctatgcacaccctcctgacaacagaaccccacttggactggcctgaggcaggtgcgagctctgagacggggactaagaattcaccccagcaacgtgtatgcttctggggccttcctggagtcctgagcctggccagggagggccaggtttccatatctctttctccaggaggtcagcacctaacccagagagaacttaactgtgtctaaaagcttccaaaaaagactttccccttcccaaacacttcctctgccctgagggtcttcgcaaccccttccaagcttctgccttctgcagccccagcccatgcagcagggagcgtggacccctgtcaagtggtccctgatggaaggcctggccgcaggatattcagagatgggtgggattccactgagtccttgcctctctctccatgcctttgtagtcctgcttcccctgggagtgcctcacacaacccactggactgggagacaggtaacatgtcctccaagagtgctgtatgccagggacaggagaagaaagaaactcattactgagaccctgctgtgtgccaggtcctgggctagggtctgtgacttttgttatctcacctgtgaggttgataatgttagcccattttacagctaaagaaactgaggccccagctctgtgtctgggaagtgaaattgcacctttttagtccgttccaaagccctcaccactccctggctccccagtgctaggctgtgtcacaaaagaggggagtggctggggaacatcgtggccagagggagagaaggtgggaacaggattgtcttcagtgggaatgaatgagatcagccatgggaatccttcccacctcacctcttcactgacagagcagggcagggggatcgggggtgtcctccctccctccttccctccgaccatccctcatggacctggtcttcgcccaatccttggtttggtgctgacccccagtggcagcaacgggtatgacagtcctcagatgagacccaactagggaggcttgaatcccaactgtcctaagcataaagaccctcatgagtacacatctctaaggggcacatggggaaactgagacccacagagaaatatacccaaagtcaggacaatagttaatggcagagtcaaggctagaaccagagctgggtgtggtggcatgcacctgtagtcccagctatttgggaagttgaagcgggaagattgcttgagcccaggagtttgaggctgttgtgagctgtgattgtgtcactgcactacagcctgggtgacagcaagaccttgtctcttaaaaaaatgctagaaccaggatcatgtaaggggaaaacagttgctatttattaagcacttactgtgtatatcaagcagtgtgctagaggcttttaattcacgtaacagtccagggagggaaataatgctgtcatgtttatatagatgaggaaactggtcccgcactgaaactctaccatcccatctaccctctcttccaggtctcccccctggacttgtctcagggtataacccttggtataaccaagggtataacctgaatttcacattcagccccagcccaagactgccagagagccacagaggactgtaaaaaagccctccagccccagtgtctagctcagtgcctgggatagagcaatgataacatagtgaccatagctaccatgtgtcaagtgctagctacatgtcaggcatttatatgcatcaacactaaccagccctgcctcccccgcccccagtaaaaccaatgaggtaggcatgatttaatagatgaggaagctgaacttcagagaagctgagtgggtgcccagggtcacacagctactctgtggaggggccagaattagaaccaggcctagcccagcctcccaacatgaaagactttccattggctggggagggtacatcagctgaatcttggctctcccttcaccaccccttcttccccagctggctccagagcacacgctcatgtccttccggaaggccctcgagcagaagctgtacgggctccaggctgacattaccatcaggtaggtgtagcggaggggagatagttcctctacccctcccacacgcttcggcatccacctgggtctctgctgggggaacctctggtctcagagcctctgagatgggaggaggaagacttagattatccacagcagggcaggcaccctgttcctgcagactccaggatgtaaaatagaggaaagaacaaatgctcttggtgcaagcaggagcactgccacagagccacttgaagggaaaaatagatgatagagctacaacactctcatgagggaaataaagcaagttgcagagtgatacattcactgtgactccagttacgttttaaaataccacaaaaaagtgacatatacactttctccatgtacatatataagtagatattagtataaatggcaggaagaatccatactaatctcataacagaggttatctgagaagggaagaagggcagaactgtcatatatagttgtacaggttgcatactgaacaagggcatcacataaatgaggacattgttcccagtatagacatagaattgtgtgtttatcacaactttctagcagatggtggtaaaatgccttgaggaacagagggcacaggtaccttttactgtttcacactaaggcaccatatgagctatttgcaaccctggtagagtagacaaggattggggttgggtggaatttgccaaagaggtctacatttgcactgttctcatcatagcatcacagggatttggttccaaactgggttccaccacttacaggctgtggaccttgagctagatacttccctctctcagcctcagtttctccattgtcaaatgaggcagcacctaccttccaaggttgctaagagagtaggtccagatttttcccagccctccctccttggcagtccccacccccatctgaccctcacagagagccagaaggcattggaccttcagggtcacccaccagcccactgtcttccctgtgcagatggggagactgaggcccagagaggggcagagccagccgggatcctgtgctgggtggggaggactgtgtggggtgacgatcattggtgggcaggtaaaggatctggggggtcactgactcggtggccccaccctccctgcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaaggtctggctgcacctgatcccaatcttaggcatggaaaacaccagcagggactgcaaggagtgagaggtgcaagggtggccatcagcttcgagacccccactctcagagctttcgcgacctccacccaagctgcttagtggcctcctaggctcctgccactgctgccagactcatggttgtcactgcttgttctgggtccatttccctcactagaaaaggttgacagggatgagagcagtgaatagaattcttaactctgtaaaactctagagaggggttggctctctgatctgaaatgctctagaaggagaaatgctgtgggtctgggagcgattccaagcaagccgtcctccgtcctcttggtaagcagggtgtggggtagaaaggttagggctggggcctcctacagcctccacatggccacagccatcaatctgcctgaccccagcagactctggcagcccaggggtctccacgcttggttgccagaagggtatgtgggggcccccaaagggctgatgatgcagccatgtgtgtgtccctgtccctgccagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtgaggccctgcaacgcagctctgcccccgggagccctggcctggctagagccctgctgctgcatagcctttccctgttgcactccggacttcagctttcccatttgtaaaatggggatcacacactgctcacttccctggcagggtcatcatgggacaagaggggaacaagaaaacactttaaaatgtataaaggtccaggcggtcaagttatttcagtgaagtgttgccctgtcgtttggtgtaataatctgggaccagagaaatctgacatcagtttaggacggcacactaggtgctagtggccatgtgcagagtagtggctgtttgggttttccctcccgtactgacagcaggccagaagcgaagtttcctgagttgctgccagtgcactttgcagccttggctgggactgagtcctgccctgctaatgacttcatctaagctttcaccgcctgccaggtcctgtctcttaaccccacaggtgctctaggaggagtaggtactcttacgcatcgtgcagaagagaagtctgaggctgcctctcttctgcctgcaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcaggtgcctgccctgccctgggctcctccaggagagggtgggactgagtctctcccagtcctgccaccaccaccccccaacacacacacacacacacacacacacggtcgggcagagggatgggcacacagaggaatcaggcacacatggttcaaagacaagagggtgagcgtgtcgggcagacccgggcttgtcccggagcttggccctctggagccaatgttccttgccccgggcatggctgtgaggtcgtgaacaggacgtgctttaccagccccgacactgggcctggagctgccagggtccgcatgctgacctgcctctcccctgccccacagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatggtgagttggggggcagagggcccctggggggcagtgctggagctgcctatagcctgccctgaccactcggcaagctctgtgcttggagctgtccctgggaggtctctagcatggtggggagtccatggtgggcgtgcaggcttgaggcatgagggtttcatggcatctgggatctgcactaaggtgctgggaggaccctgggcctcatccacagggagaaaagcatcactaagggctctaaagaagtaaagagctgcttgggtttctttgctttggagggtaacaaggacaggaataggaagcattgaccgggcgtggggctcacgcctataatcccagcattttgggaagcagaggcaggatgatcactggagcccaggggtacaagactaacctgggcaaccctgtctctacaaaaaaaaataataataattaattaatttgctggccaaggtggcacacgcctgtagtcctagctactcggtaggctgaagtgggaggattgcttgagcccagcaggtcaaagctgcagtgagctgtgatcactccagcctggatgacaaagtgagatcctgtctcaaaaaataaaaataaaaaagaataggaaacaattaaaatctgctcagagaacagcaaataaagcaatattttagctggttgactgggcacctgcagataggtggtggctccactgtcaccctgagcatgcagaaggcaggtggagggtatccttatggctgagagaatgcagtgccaatgaatcagacctaagctgtggatggttctatgggagaggagggtgaagggaaggcagcctggggaaagggtcgagaccgatggatgagagtcggcagcggggggcggcaaagccattgtctttcagtatctggctcctgctttgaggaccctagacacacagaccctgcaggcctagcacacaacccctctgccctgagcaccatacagtcccctcctaccctgagagtgcacacgtgtgcacacacacgccccggcccccaggcccacagcgcctggagcctacacctgcaaaatgtcatcttcagcccccagaccctctcagggtcctcccttgcccttccccagtggccatgtggggtcctttggtccacggaccctcagtctggagcctcagtctggactggccatgactggaagttggcctcgggccgtctgtccacagcccccggacgagtactgtctcatgtgggtcactgccgacctggtctccttcaccctcatcgtgggcatcttcgtgctccagaagtgagtaggatctgaccacttccgtggctgtccctaccctgcagcaggcccagcccccaccccagccaggtgaaccctctcctgagccctgggcctcagccaggagcaggcctgaccagggaagaaggacggactccggtggccccatcctccctcagacagaggctgggtgacttctggaatgaacatgcagctgggatcccagagccaagctctgccttgggtggctatgtgggcttaggtgaatttcagctcctcaccgggctggcctgctcatctgttagccagggcatgggttcccaccagccctcagcaagatagctggggtgtgctcgcagtggggaggtgtggttggtcccagggagggtctagggccagcctggggcccccacccagccaggaaccaaggggctgggattttattcttgactgatgttctctctctgtcccatcctgctctgatcggcgcatgtccctcctctctccccctccccctctctctgctgcactctggcatctcacagctatcacttgatcaggtaattctggtgtggtcttcctcctccttctgttcctctttctccctcttgccatcccttctccagttctgtctaaaaacccaccgtgcaccaagccctgtgcccgggccacctcgcagacagcgcgctcgcctgaagcctcccttacccccgcaatcctcttttctgctcctcccgtcccactgccgtgtgtgtccctctgctccctgttcccacggccgtttctgcaggtggggaccagcgtttccttgacagcttcctgacctggcccctctctgcaccaaagtgtctccctgggggaggggaccctgcctgggtacccccatccccctgcctctggcacttacaggggccttcaccacttgcccagggcagaccctaccaagtttctgcctctctcttcccatcttctccctccctggctctgcctctcccactgttcactcttcctgtttacctttctctgcctctcccatctctttctctctcttctttacattctatctctaacacccatccctgctttgctccccgcaacacacagccttttcctcattcccctcagaggaccccacagtggctgagcttcctgttctggatatgcctggccgagagaccctggcctgacactgtccttctgggtttcaacatgaatttccaggatgggacctagagcttagggacccacgtctccctccgtctagtgccttagcccctcctgggtcaggcagcttcaccaatcagcttctaggaggagatgctgtccctggctatgggacattccttgagtcattcctgtgtccgcccagttgaccaacatccacatacactggttgctgatgctgtctgcagcaggagttgggccttctcacatggagccccagggtgctggggaggccaccccatggtgattcagtggctggcacagacacgctgggtctgctcagacacagccagggcagtgtcattgtctcctggggatcaggagaggcctggtggaggaaggtaccctgggggacaaggccgggggaggatactctttccctgtgggccttattcttccattcattcactcaacaagtacaggtcaggctcccgggacacggcaggcactgatggtactggggcacagcgatgaacagagagagatttgctcactgccctcaatgattcatagggcagccagcctcgccagggtgtccgtgccaccccccgcctcctgctttccccttgtctgcctgctctgttcatccatccatccgcctgtccatctgtctgtccacttctgctgcgctgaccccatctagtaactcacagttggtttcttgtggagtcttggctctctccatcccccaagcagggttcagtccctgaggcagttgggttcttgttcccaagttgatcaccccctcctcctggtggggacaggggtgagagtccagtgatccttctgcctagatcccaggaaaggtctaagttcagaggccagggactggggctagttcagaggaatgacaatagtgaagacagtggcctgggctgggcacagaaacctgagtcctttccacttagtgcctggtcccttcatgccctgtgcatgctccacctcccagcccactcttgagtaattttacccccaccttgcacctgtctcagccatcagagggattcatgctctgacctccctccgcattaggactgccaggacagagcagcagttggccccactccaagtcactctaacccccttgccttgggaacctgtgcagaccagctctgggcaaagccccctaccacctggccccacccccctgctttccttccctccctctcaaggggtctccccaatggcttcacttagtctggtcatgatggtggagctataagagacatcagctgggactccctgagattggtgtgtgccccagcttaggtcaacagagtcgtgcctactaagctcctcctgctcccaaatctgtcccattcaaagagagccaggtgcattactggggacacctgagacagaactaaccaaccctagtcctgggccagggctgctgactggcggctctggaggtaagagggaggccagggagccctggccgagagtcagtaggctctgattcaagccccaactctgccctctctgggcctatttccccattgtacagtgggacaagagtcctgctggtctcttgggccacatccagagaggctctggaagtaggcagggtctctgctccaagggagggctgaggagagacctgatgcccacggggccatctctgcaggtggcgcctgggtggcatacggagctacaaccctgagcagatcatgctgagtgctgcggtgcgccggaccagccgggacgtcagcatcatgaaggagaagcttattttctcaggtacacagccctgcagacaggtggaggcaggccctgggcccagctttctgcacccccacatgcaaacagatgtgtatgcacacacattcacatgtggcacatatgggtagggacaagggcacagacgtacataaacccaccgggattatacccacagacatacaaaggcataagtacacgtgtgaaaacacacacccccacacacacagtcatccaccctgtcatccaccatggcttggtgtcagtgccatggttggtgggcaggggtggggtagggagaggagtctgttttgaaggcccatccccctttgcctggttcgtacttggatcctacaatgttggcctcacccttgctctttgccagtccctgtcaacattcccagtctgatggaagcagcagctacgtatataaacagtggcagggaaagtcgagttcctgcgatgggagtgccgggcggggggcgggaggacgtggtcagagctgcctgggcagtgaggaaggctttgggcgcctgatacactgagatggggaggatgcagaggaggtgctttggtaatggcttcaagatgagggccgagtgagctgagggaaggaagggcattccaggtgggcacggcatgtgtgcagaggtggcaagggagcaccgcttgcctgggcaccaagaatgaagtgtccctctatatggccgaactccactcagcagagctttcttgagcctctgctctgtgtccagcactctaccaggccctggggacatagatgcccagaacccaccctggtccttgaggtattttgggggcccaggcagcaaccatacagaatatggccagggcagaaggaagcagggtctggagttgccatgaggaggccctaactcggcccagggctccgatgaggttcccaggaggctgagtgacagatgagaagacttgagccagactgtaggaaaaggaggtgttgttggggcagtcactcctaagagaggggctgacacatgcaaaggccctgaggagagtggacacatgggtgccaagctcaggggcacaggtggttttctgtggctgcagagtcccaggggacagcagatgaaggcgaagctagagtgctcagcagacaccaaaggggccttgagtgccaggctcaatgtcgacctgagcccagtggtttcatcagcctccaagtgccccgctgggtggtgcagccttcctgccccatctgtcacccatcctcacgactgcctcctccccgactcacattctgtctccctctggcccagcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttg

SEQ ID NO: 38771 - DNA, 14281 bp, Homo sapiens
cgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgaggcaaggccgggggccgccgggaggggccggggaaccgccgcgccgcttccgcttccctaactttcttctgggcttccctccttcctgccccgcccgtcccgccccgctccggggctccggggagagcgcgcctgggccggcggcaggcacaggagggggtcccggagtcagggggtcccggagtcacggggtcaaggagccggcgtcacagtgcccagcaccccaccccccgccctggccccgggcgtctacaccggtttcggcctccgccgcgtccctgcagcccggcgtggggttccgggggtggagcagctttcggagagaaagggggccggtccgcgctgggagaggctcagccctgcttcctgagcggggaaaccgaggccggggcggcggggacttgccccagggctattgatcagggcgcacgacggcgtgggggcacccctcggcctccctccgaccccctcctgactgtccgcccggtgatgggcgcacctgtggggcgggttcccctttctctccctttcctcttcgcagggaggtgggggacccggaggggacctgcttccgtgctggggagcgcgcccctggcctacagctccgggggcccagcttccaagcgaagggaaggaagagttaggactagggttcggcggggctgaaattttcccctggacgccttccagaaggtgggagcttggttttgccaggctggggttgggggccagaggtcagactgggctgccaaagacggcgggggctgcctgctcctgggcggggtggctgctggagaaggctcttgcctgccccctctccctgttagccgtccccaggctgttgctacatttctccctgccctgtttggactgcccagccagtggcttttgcaatggcctggggtgggggcattgtggccccagaggcccccttccccgtggttccaggggcagtgggtgagggtttgctagctccctgcactcgctgtccttgccagccctgggagggcactgaggctgctggaacgggcctacagtcatggcttccaacggagccccagaagctccaggaatatgaaggaggaccctgggcctgatggtgagcatggagagtccgagaagggcctgctggctgctcagccagacgtgtgtgaccagtggtgatgtgggccaggtggcccaggccggggtcccggggagcgcacactccagggctggcccaggtggtgactggcgctgacgtccccagtggagcacccttcagcgaggaaggcagtttgcagaaacagggagttcctgggggctgggctctgggcacctgtgctggaatctgtgaaggcctcacctgtggttctggccctgggatcccctgtaggcaggggtctctgtgaggggcccccctcagcccctggggtgcttcagagtaggggcgagggtgcggctttcccagctgaggaggggccagtctgtgggttccttggggtgccccccaccccgaggaaatggcttgtgtggttctgatgcctgcagggcatcctgtgctgggcgtgtcctggggtgtggacaggggacggggtcctgttcttttggcagaaatgatggggcacctgacttaggagaccctggagcagaccccactactgagccaggccacaggccacgggcctcttcatcggcggcctcctcgtgtgagaaagcctggcttgttctgcaggggcctctgcctggacttcctagctgttttccagggaccaaatcacagttcacctgctgccctttctatggacctggcaggctgggttggctggcactggccctgctgccccactgggccctgtccccatctcagcttggagattctggctaacctgggtgtcctcgggacctggggcctctgatggtgcttggatgggaccctcctgccgccctcacctctccagggcagcacccaggctcaggcctgtggagtagtggcttccgggacactggctactaacagcaggtgctttgttcctgctttggtccctgaagagaagggagggccagagggcagggcagtctggaggagaggcctggggctccatggctaccttcccccacacctctgcacgtgctccccaggccccagggtccctgatgacttccaagactcccagcaatggctaagagtggggctgttgcgaacgtgcgttccctccgtgggggccgtcgggaggggtgagaaaggcagatgaagagcaggcgctttgtcactccagggaagggacccggggggctggaagggaaggaggggatactcggcctctgttcctgctgtacgccacgggtgcctccagcctcaggaacagggattcgcgtgtgctctgtgttacaaataaggacactgaggctgagataagcaacttgaaactggggcagggtccccaagccaggatggggtggaactggggttcgaacccactgacagtgactccagagtacctgcttttccctttccccttgttcccagcccagcgcttggggctggtgaggcagccctgcggcaggcctgagctctgggaggggcgctccatcttgcccctgagcaatggctgccctggctgaggcccagcccctccccacggggttccaggcggcacccaagagacccccaccgtctacaccgtagttctgagcgtgtgagggacagtgatgggactagaacctctgaggcagccttcgttcccaccgggcttggggctgagaccacggaccccttccaggcagggggtgtcccctgagcccttccctgtgtgcgcagttacggtggagctgcaggggacgtttcctcaccaggggccgatgccctggtacatccattcgacagaggaaagcaaagcccagagcggctccgtgtcctacagctgggttcagctacaggatcagaaaaccctcaagacagcagcttaatccacagagaagtttactttttcatacagcaaaggagaccagatgggcagcctagggaaacagcagttagtttccggctcctttgacctctattcccaccattttcagggtcccagacagaaaaggggtgctcttcctcttaaggatgctccccgaattgaaccccacgctctgctggtatctggaggccgggacctagtggttgtggcagctcctggctgcagggcaggctcctgtccccatggagcacgtgcccacaccacacgcccagtgtggggagaacgcacaggggacttgggatgtcgggcaaggtttgacccagatttgccggccagtgcatggtcccgggtcctctgacagatgtccggtgatgacagatgccatcgggggccctgtgtcaccacagcactggggtcttagtcccaagggagaccgtgaccttggtcctccagagcgctccaggtgtctctgtgcaggcccagaaattggagctgtcctgactgagggatgggagggcttctctggccccacctccttcccgcccgccacacctgcactcctacacatccgctttgaggagtcacggggaccccccacatccgggtgtttgtgtgggctggaccccgcacccctatggacccatcccgccttgtgctgcagcttggatgacacttgtcggaaaacaccagattcctcactggggtccctgtccccggtggccccagcgagccccagcagagggggagggggctgccctgaatgagctcacgcagctgaagatgggcaagtcctggctcagagagctgctgggtctcctgggagtgtcccagcccaggaccaaggcaagggtcagcgagtggccttccacgaggacagcctggccagtggcctgggccctgacctagaaccgcctcccagctgcctgagccaggtgctggtgggattgggggcttaggcacattgaggggccttttgcttcgatttactttggacttttttttttattttttgagacaaggtctcgctctgttgcccaggttggtcttaaacccctgagctcaagtgatccgtctgcctcagcctcccaaagtgctggggtcacaggcatgagccaccgtgcccggccccacccattttggattcttccccccctcccccccaccccctagtcatccccatcacagccactgttggtggaggtcctgccctggcccgatggtgccccgggtgtctccgcctcatagaatgtaagcctgcacacccttccacaagagcctgggaggtcaaatgctttgcccgaggccatagctgggaagaagggaaatgggatccaaatccccgtcaggcccagagcctgagtgtgggagcagcccaggtgcctgggggctgagctcaggcggtctgaggaggctgggttcctgcagaccccagaggggtctcttacggggcttcgctcgaggccagtggactccagtctgagggctcctgaaaaagactgaggcagcacctgggctttccctcagcaggagcccactgctccgatgccaccagaagggcccagtctgggctcagcctcacttagttttgggtgctgggctgctccctgggcctcctgccttgctgggcaaagctggcacaagtcacccgcctggcagtggccagcagggctccctgagctccaggcttccggcaaccttggctttgcccctgctccccggggaggcaaggagtccaggacctggatttggggtccgtgtgactgtgtcctggtctggcacagcgacacctgccccaggctttgaggaaaggacagggcagcccctcgtccgcctgtggttggtgggaggggagtttgagtgaggcagggtgtttggcacaggacagggactgggctgggcaagctggtgggggaagcctggggacagtggctgctctgagcttcctgctgggggaggccggagcaagctcccagccctgctgaggggttgaggggactgcggagcccgggggagggagggagcctcaggatgagctcctagagtcctactgggggcccgcgccgccccagcacgactctgccagctccgaagcagggttccgaggggggctcaggcctgttctggcttccctgctgtgtggccttggggaagtcacttaactttgctgaaccttgaacctcgcattcctcatctgaagaggggggttatgatcgtacctaccctggggggttactgtcagaacaaaaggaggtgactcatgtagagcccttgtctcgaggctttgcacacaggaggtgcagggggcctctgtgcttagaaggcgatttttctctgcttgggttcccgggggtgtcctcggccgcaggagcctctgcagggcttagttcagtcccttcctctctgaggaaacactttttttgtgtgtgtgagatgaagtcttgctctgtcacccaggctggagtacaatggcaccatctcggctcaacgcaacctcctcctccctggttcgggtgattctcccgcctcagcctcccgagtagctgggattacaggcagctgccaccacgtctggctgatttttgtattgttaatagagacgggatttcaccatggtggccaggctggtcttgaactcctgacctcaggtgatctgcccgccttggcctcccaaagtcctgggattacaggcgtgagccacccgcccatccaggaaccgcttgtaaagtgagtctagactttcccaccagctttcagaaagctctgaactatgtacgggacaccgcgggggaagtgcggtggcctcacgtggctggtgcagatggccctttgtccccttgaggacatcaacttcaactttcttccacccccagggtatacctttctcccccagccacactgtgggctgcagagttctagagagccacagcctcccgctggcctggggcagcctccgtccgtccatctgtctggcctgaggaccaggggccggtggtgggcggcgggacacagcgcctgctcagcaccgcctgctgggcgggggtttgtaccccgtgtctttcacagctgagagaagtatcagtgcacgatccaacccctaagcagcttagattaaaaaaaaaaaaaaaaggaaaagttttggagctagagggtggtgctggccacacggcagtgaatgcgccgagtgccacggaaccgtgtgctgagaaatgggtacaattatattgtttaggtggtgcgtgttataccacaatcaaaacagaggagggctcggcgcgctggctccttcctgtcatcccagcactttgggaggccgaggcgggcggatcatgaggtcaggagtttgagaccagcctggccgacatggtgaaaccccgtctctactaaaaatacaaaaattagccgggtgtggtggcgcacaccagtagtcccaactacttgctaggctgaggcaggagaatcgcttgccgggaggtggaaatggcagtgagctgagatctcgccactgcactccagcctaggtgacagcaagactccgtctcaaaaaaaataaaaaataaatgaagatcttattttttaataatttcagatttacagagaagttgcaaagatattacgggggaccccatgtggccctcaccagtttcctcccttgttaacatcttacatcaccaagatgcagttgttaacactaagaaactagctggccgggcgcggtggctcacacctgtaatcccagcactttgggaggccgaggtgggaggatcacctgaggtcaggagttcgagaccagcctggccaacatggtgaaaccccgtctctactaaaaatacaaaaactagccaggcctggtggcaggcacctgtaatcccagctactcaggaggctgaggcaggagaattgcttgaacccgggaggcagaggttgcagtgagctgagatcacaccactgcactccagtctgggtgacagagtgagaccctgtctcaaaaataaaaaagtaaataaaagatggaactggccaatgtcactaccagagggaaccaatgtccctttcagatgtggcccgagcctcctgcaggcagctagctttggaattgcaggtgtgtcttggctgctgctagaaatcatacacatgtccttcacaggagatgagtgtggacctgtcctgttctttccccgcgccccagctgtctgtgaaatggaccctaatttactttccctctttctactggtggctatttaagcattttcaggttttcctaattcactgcacacttcagcaccacaggcttctcactccagccgtcgggcgaattcctggaagattctgagaggggaggggccaggtttcctcagggctctggccgggcctgccaacctgccctccacagaagtatcttgtctgtgcgactcctcactcctgccagccgctgggcctgttcccaacaccctggctggcacctcctgttatcaggcgttttaatctgtgccagggggaaggatgaggacagtctcttgtttccatttgcgcttctttgattggcgacacggccgtcttgctagcaccagacagttctgtgtttcctgttggtgaactgccggcttttgcctcctcgtcttcttggagcgtcacaggggtccgggaagctggattgcgcaaatgagtgtggaggcaaaacagccctgcagttcccctgagtgtgcgggtgctaccagcccgggtgtgccttctgggtgggaggggacggtggccggcgcggcctggagaggagatatctagagttggctgaggaaggcagatctgaggaggccccaggcttccaagtccagggacggacggctggactcatcaccagaattaaccattaggccccccttgactcagtttccccatctgcaacagggggtcatgagcattgccccatcagcctgaggtggtgctgccgcaggcctgggctcacacatggaagggcagagtgccagggctggggaggggacaggggtttgtgtcgcatgggaacagacgtcagccagagaaggtggagagttctggagatagagggaggagatggctgctagacaccgaatgtgcccagcgcccatgaactgtgcacccggaaaaggccaaggagatacattttatgttacgtgtattttaccacaatttttttttaaaggccgggcgagttggctcaggcctgtaagcccagcactttgggaggccgaggtcggcaggttgtttgagcctaggagttcgagaccagcctggccagagatggtgaaagcccatctgtaccaaaaatacaaaaactagcgaggtgtggtggctcacgtctgtggtcccagctagtcaggagcctgaggtgggaggagcccaggaggtggaggctggagtgagcccagattgtgacactgcacaatgtgacacattgtgtcacagagcaagacagagcaaggggagcctgggtgacagagcaagaccctgttaaaacaacaaaaatccccaccagtatggctttgagagaaggccccggctttgaatctctgctctgtggcctggggcagttactcagactcatctgtagaaagtgtggggcccttaggactgctgggggatcaaatggtggggggcactagtctgcatggagaggggagcagcactggcagccccccagtcagcgctggcacagccttgccccggccatccacccctgctggagcttcggagtggagctccgtcctcctggctccatccccgccggctgccctgtgatggggtgccctatctggggtgtgcccagagcttcctggcagcacagcagggcagaggttgggacgctcggagctggtcagagtcttcgggtaccccttggacatccctggtcccaaccatgacgggctgcttggacaaggccacctcacatttgcaggtgctccaagggcagcccccagtgggctgggcccctgccagagtgggggctgctgtggccagggctcaggtggcccagaccctggctctgctgctgctcctggtgtgacctcagacaagccccgagcccctcgccgcctcttcacggggaaagggaaccggcctgattctgtagggtaggggtgagagagggtctcggtctcggctcttttctggaagaacctttcggaggtcgtttcagaggtctccactggcgccgacactttcttcctgatgtggccctgccttgaggggccagtgaccttccccagggtgtgtggggccccatttcctctgctggggtgcagaggctgctctccccgacgtgggtccttcatagcggacgtgagagccagtgccagttcctttccggctgggtcccctgtggggtggatgagggctgggtgggccctggatgtggatttggaagtgggcgccttcccatgctcctagcatccgagttccagaggctctgggttttcctctgttgctggggagacggaggcagggcagccgtccaggtgggtgagccgggcccgggactctgtccgcttcaggggctccctcccctgtgtctcccggtctcctgccccgtgccaggagggcccctccccagcctcctccacaccccacccccaggccttcgcgccccagcctcggctgcgggatctgtgggacccgtgttcatggtggcctcccctgcagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggtaggccgggcctcgggggtggcttctggggtttgagtggggccggctgagctggggctgtgtggggctgggtcccggggacgaggacacagggctgcctgtgcctgggcgagctcggcctcagtacctccctcagggccagacacagaggctcggaggccacacgacccgtccaggtagccagggagaaggcagggtgccaggcaggcctgtgggtgctcagcagctgtcttccagcgcacgctgtctccccctctctctctgtctctgtctctctgtctcccaggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacgtgagtgtgcagggccgggctcggtggggttggggtggggcctgggcggggccaggcaggggccagcttgtgacttggttttggcagaaaaaacaagacccccacatcatccatgctccgcaggtggggtcccacgccagacccctacatcatccatgctccgcagatggggtcccatgccagctgctttgcgaagtggggcttcttaggaggcgaggcggcgtggcctttctggggtggcctgggcgtgaggtcagtccaggctctcctctccctgcagctcaaagtgtggatctatcccgagggtactcgcaacgacaatggggacctgctgccttttaagaagggcgccttctacctggcagtccaggcacaggtaggctgagcccagccctccctgggtgggtgcaggctggggaggcggggtcaggctggcttaaggcagcaggtgaccaccagccgagctgaggacccttgacacacaagggactcctcccactgagttggggacagggcctccttgccccttcctgcacttgccccctgaccgaccagggagggcagccccttgggccttttgcccacacagagcccagagtgaccagctgcccttggtgggcacccagtgcttggcctgcgaggctgggcaggtagaggggtggggagccgggccgctcgcctctgctgcagagctctcaggaggctcatttctgggcctgtgcctggctggggtgggcttcagggcatgggcagtgggtctggacaagccaggcttttggtgtagtatcaggccagaccagagctcagggtgggtggagctcattgtaagcagcgcctccagactctggacttcctggtccccagcctccaggggtgcagtgcatcctagggtgtctgggagaggccagggtatagccattcccccagcacctgtcctgcctctgccgctgtgctgggaagagttgcgtcaggagaaggagcttttacccatctgggtggggtctcgctcagggcaggggtctcagctccttccctcacactggccactagtggcccccagtgcctggccctgtgcaaggtggtggggagggggccctccttccagaggctcccagctaaggccgtgaggcctggggagccccggaggcgctgggctgggtgagcatccttgggctctgatcccagccctgcccaggtgcggggcacacctgcccagcctggggctgatgtcacttccctttgggggcagagtgagggctggatcagctctgggagagcagaggggagacgggcggctgtgatggggtggctgggggtggccgcagtgcagcttcagccaggagacccacagcttttccgtccctgctcccggtccccagcctacctgctggccccctccctccctgctgccagtccccagcctacctgctggccccctccctccctgctcccagtccccagcctacctgctggcctcctccctccctgctgccagtccccagcctacctgctggcctcctcccttcctgctgccagtccccagcctacctgctggccccctccctccctgctcccagtccccagcctacctgctggccccctcccttcctgctgccagtccccagcctacctgctggccccctggaggttccctggctgcctcgggttaatgatcacccccaagtgcccttggatttgaccccggtgacttccaggaacaccagcaggctccacccctcccccgggctagggctgcctccctcactggcttcctgagatggagaggactgggagagaggcgtgggcagggaagagtgccataatctcctcctaaaccggacagggccctgcccccctggctagctgcagacccaatatggggacaggtgtgaaccaggcaaacacgtgctagctcaggagggcttcctagaggagatgagtaaaaatttgcaggatgagcttatggaactctgggccaaccagagcaggacacatatcccaggtcccaggggcaggacagccacaaggacccatggcagcagcgaaggcaggggtgggtgggccgcaggacagggctccccaaccacatgcagcctggggtgtgcctggcctgtccccagggctgcctcagctgtgcgtctccctgcctgcaggtgcccatcgtccccgtggtgtactcttccttctcctccttctacaacaccaagaagaagttcttcacttcaggtacccccacatgtgtgcacccggggtgtaggccccgcctgaccctacagtcacggagccccgggcccctcatcgttcccatttccgggtggcacccgtggcgtggccacacggtgaccatgtggcgaatgagtgactcaggctggagtcccagctgtgggcttcatggcctcatggccctgtgagatgggtggtgctgggcccatttttcagatgagaaaactgaggctccaagagacttcacacggatggaccccagctgtgcacacagcttgggggcctggagggcggcctctgagcccatgtgtccaggctgatgcccgcatagggtagatggaacccaggcagcccaggggcacaggctgcggggctcatgacctcttgccccttccagccagttcccagaacgtgggcacctggtgcccaggcaggacagtggggtcaaagttggagagcagtgggggaacccagctccatctctcccacagcccctcgccccgtatggagggcagaggccaggcagtgaggtaggggctgatcaggaagtggggctttctgggggcagtaacaggggagcgcagacttgtcgaaaatgcggcgtgaaggccaggcagccatggggtttactgcagcaacgttactgcaattaaaataacccaccacggctagggagtccaggggaagagcccggcctcgggcttcccagggaggggctgtggggggctggggagaggcgaggccagggcagcaggctgaggtgggccccagctccccacaggccactgaggtctgttgcttcccccacaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggcctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcaggctctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 38772 - DNA, 1320 bp, Homo sapiens
gcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactcc

SEQ ID NO: 38773 - DNA, 1320 bp, Homo sapiens; identical to SEQ ID NO: 38772

SEQ ID NO: 38774 - DNA, 12155 bp, Homo sapiens
ccctctgcccgcccccagccctcgccccaccctcggcgcccgcacatctgcctgctcagctccagacggcgcccggacccccgggcgcgggatccagccaggtgggagccccgcagatgaggtctctgaaggtgaggtcgccccgctggcttagggcgggatgcactgctctggtgtgagcccgggctgctgggcgcatccggcgctggccctgccctgctgtgggtgtgtcgcaaagcccgcggtgacagcggccaggtgccaggtgtcccctgtgtggcccggcgggtggcatggtgccctgaggcctgccctgggcgcccaggcggctgggtctgggtgcggcccaggctgattctgtccggggggctctctggtctctgtggggccacatggctgtgaatgggggtcccagactcagggggctgcagccggggagggggcccaggccctgggtgtggcagggatcgagtgtggttgtgcggctgtgtgtgtgatcttgtctctgggagtgaaccatgcatggccctggttgtgtgtctgtgtctgtgcgtgtgtggtggttttgtgtgtgtgaccgtgtgtttgtttctgccgagagtctgtgactgttaaatactgtgtgttcttctgtgtgtctttctgtgtctgtctgtatctatgtacctgttgtgtttctgcctgtgtgtctgtgtttttctgtctgtgtctgtcacatttctgcctgtgtgcctatgtgtgtatctgtgtgtgtctatgtctgtcgtgtttctgcctgtatgtgtctgtgtgtggctgtgtgtctgttgtgtttctgcttgtgtgtgtctatctgcgtgtgtctgtgtgtctgttgtgtttctgcttgtgtgtgtctgtgtctgtcatgtttccatctgtgtgtgtctatctgtatgtgtctatgtatttgccatgtttctgtatgtgtgtctgtgcatgcctgtgcgtctgtctactgtgtttctgtctgtcacatttctgcctgtgtgtctgtcatgtttctgtctgggtgtgtctgtggtgtttctgtgtgtgtctatctgtgtgtgtctgtgtatctgccatgtttctgtatgtgtgtctgtgcatgtctgtgcatctgtctgctgtgtttctgtcacatttctgcctgtgtgtctgtcatgtttctatctgtgtgtgtgtctgtgtgtctgccatgtttctgtgtgtgtgtctgtgcacgtctgtgcgtctgcctgctgtgtttctgtctgtcacatttctgcctgtgtgtctgctgtgtttctgcctgtgtgtgtctggctgtgtctgtgtgtctcgagtgtgcacacacggtggtggcctgaggtgcatgttggtggaatcactgtaacttgtggtccaccattaaccaccagctgcacctcccgggtcccgccccctggtccctgctggcccctgtgtgacggagctccgtacatgctccctggggagcccccactagagagatggggaaagcgaggctcacagggggccatgtgacttagggccccaacaaggctggccggagtctggctggctgggggagtccccgccctgcactgtgtgggctggggaccctgttggtgtcacaaacaggaaatgttctcggaaatggagctttgcgatgaggggaggtgggcccatcagggtgtggagtgtgtctgcctccgctaccatgtgggggtccacgcccatgagcgttcagatctacagcaggcatgggagggtctggccggtccctgaagtttcagtcccaaaagggccctgtgggtccaaggtccaaggccgacaggggtgacacggagcctcagggctccctgctggctgcccgggcaccttgtagggagttgagctgtgagtacagccaggagccctgcagaggtgagagccagggaggcctgagcttagcacccgcaggcatggagatcagaagctcacccccattgcacagagcggggaaactgaggctcggcaaggtggagccccagcctggccacggcagatcagggactagagcctccaagcctgtctgggggaggtggggtgggctcaggccgtgacaggcaggcggggcgggcagggtggggtgctgaggagaggggacttgttgagaaatggatggatgatgaggtgacgtgctccagggagtgggggagggggcacgaggatggaacatggggcggaggagaggcctgctgtttgggaaccaaggatcacattccactggcaaccaggcttggggcagccaggcctggtgcccacgcccagcccagcgcccgggcctctggaaacagcgccggacagagccctccgagtcacacgacctgcaagccggataccctgtcaggggtggcatcggatgagggagaactcactgtccgccttccagaaagaagccaggaattaagacagagatttctggaacccgggacccaggcagattcccatcaaagttgcaggacctcagcctcttgggagttgcaggacctcagcctcttgggattctagaattgtgaggccttctgcgtcccaggactggaagcgtgttagaattccacaaccctgaacccgctgagggcaaacgtctgctctcagactgcaaaattctggagttattcaacatcgaaaagcgatcttgggtccacacctctccccagacacagggagggacagtaattttcccaagagccgcagtgctgctctactgccccaccgcgtgggggcccctgctacccctcctggccaatgcaggagggaagggaggccctgcccggtccccccattggcatccttgcctggagaacttgagatggctgccatcgcctgaagccagggtggggagtggaggtggggggattggaaacagccagctgtggccagaaggactcagtgccagtttccaggctcccctgggccaagggctctgggccatgcatttgctcccagccaccggaggtgtgagggagttccgggtgtgtgacccccggtgagtggagtggagtgtggtcgaggagaccctgagacccaggagggactggaagttgctccaggcagaggtcgggtcagtggccgcagggacagccgagtcccaaggaatgtccagaaacagcacataccagctctcgagggaggaacgccttgtcccaggggaaatcccagtgcaggaatccaaaccccaggcgccaaagcagcccggagtggagggcaacgatcgccagaggccgcgaggaaccccccaccgcatctgctctccaggcctcagtttctcctctggaagccctgcctcccaccacggtggcagtggccttagctgtcttcccaggaagggagttcagtgccgctgtcaggagctggataatttatgaggctggatacagcgtagccaaggccagaagccaggccaaagcgtcacaagtgagatggggagtgagggccacagtcacccatttgaccgccctggaatgcgttagctgctgcgaccccacagcccaggccctgcctcagggccagcatgcattgagtgcccgctgtgctgtgctgagtgctgcgcgtggatcccttcactcccgtcatcagcaaccccgactttttttttttttttgagatggagtctcgctctgtcgcccaggctggagggcagtggcgcgatctcagctcactgcaagctccacctcccgggttcacaccattctcctgcctcagcctcccaagtagctgggactacgggcgcccgccaccacgcctggctaattttttgtatttttagtagagacggggtttcaccgtgttagccaggatggtctcgatctcctgacctcgtgatccgcccacctgggcctccctcttttcttttctttttcttttttttttttttttgagacggagttttgctcttgttgctcaggttggttcagtggcacgatcttggctctggggccctgtttccggcccacaaacatcacttcccctgtcgggttcaagcgattctcctgcctcagcctcccgagtagctgggattacaggtatgcaccaccacacccggctaatttttgtatttttattagttgagatgcggtttcaccatgttggtccggctggtctcaaactcctgacttcaggtgatccgccctccttggcttcccaaagtgctgggattacaggcgtgagccaccacgcctgaccgtaataggaccttttgagccttaactgcctggcacctccatctcgcacacagtcccattcgcccacctttgcccacccagtccctccaggtgacttgggggtgtgtcagggcaagaggcaggagacccgggttccatcctagcctcctgggtgactttacaaccagccacaaccctctggactttgacatgacccatggggtatggggagctggttttgttttgttttgttttttagacggagtctcgctctgtcacccaggctgcagtgcagtggcacgatctcagctcactgcaagctcctcctcccaggttcacgctattctcctgcctcagcctcccgagtagctgggactacaggctcccgccaccacgcccggctaattttttgtatttttagtagagacagggtttcactgtgttagccaggatggtctcgatctcctgacctcgtgatccgcccgcctcggcctcccaaagtgctgggattacaggcgtgagccaccgcacctggccgttttgttttcttgagatggagtctcgctctgttgtccaggctggagtgcagtagtgcgatctcggctcactgcaacctctgcctcccgggttcaagcatttcttctgcctcagtctcttgagtagctgggattacaggcgcccgccaccatgcctggctactttttgtatttttagtgaagatggggtttcaccatgttggctaggctggtttcgaactcctgacctcagatgatccacccacctcaacctcccaaagtgctgggattacaggcattagccactgcacccagccagaagctggtttttgaaccatctcattttatttttacttcactcatcacacctggccccatttttttgttttttggggtttttagcgtttttgtttgttggttggttggtttttttttttttgagacagggtctcactgttgcccaggccggagtgcagtggcacaattgtagctcactgcagcctcaacatctggggctcaagcaatcctccaacctcagcctcccaagtagcagggattacaggtgcataccactacacccagatatatatatattttaagagatagggtctcgctatgttggccaggatggtcttgaactcctgacctcaagtgatccgcccactttggcctcccaaagtgctgggataagaggcgtgagccactgcgcctggcttggctccgattttgttgtgcattgtggctgagcgttagccccacacagagtaacaggtccccgcctgctgctctctaccaaccatccctggggaacctgccattccgaagaagtgttttttgttcccaaaatagaactggatttcagggtttatttcttattataaaaccgacaccatgaaaatggaggaaaaggccgggcacggtggctcacgcctgtaatcccagcactttgggaggccgaggcgggaggactacttactacagggtatgtgcctgtagtcccagctatttgggaggctgagatggggggatcacttgggtccagaaggtcgaggctgcagtgagccttgattgcatcactgcactccagcctgggtgacagagcaagactctgtctcaaaaaaaaaaaaaaaaaaaaccggagaggatatttgagctggggcattgaaggttgtgtaggagttcaccagagctacttacactgaaatgcagaattaatcacaagcaaatcttctctcgcctcccaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtgagtaggggctctgcggggtcctgctaccctcctgactggacctctggtcacccagggtggatttagatcctgatggtgggaccgggcgcggtggctcacgccggtaatcccagaactctgggaggctgaggcgggaggatcgcttgaggccaggagtccgagaccagcctggccaacatggtgaaaccctgtctctactaaaaatacaaaaattaaggccaggcgtggtggctcacgcctgtaatcccagcactttgggaggccgaggcgggcggatcatgaggtcaggagatcgagaccattctggccaacacggtgaaacactgtctctactaaaaatgcaaaaaaattagccaggcgtggtggcaggcacctgtagtcccagctactctggaggctgaggcaggagaatggcatgaacccaggaggcggagcttgcagtgagcagagattgcgccactgcactccagcctgggcgacagagcgagactccgtctcaaaaaaaaaaataaaaaataaaaaaattagccagacatggtggcatgtgcctgcaatcccagcactttgagaggtcaaggcaggaggattgctggagcctgggaggttgaggctgcagtgagctatgattgcaccactgcactccagcctaggtgacagagtgagaccctgcctccaaattaaaaaaaaagaaaaaaaatagaaagcagccgtagaaaacacataaatgagtaggcgtggctgtggccaataaaactactgatggatagatgatgaaatttgaatttcatgtcatttttatgtcactcaatttttgcctctattttgttttcctctaaccatttaaacatggaaagaaattcttagtaaaaaacaaaacaggccgggcgtagtggctcatgcctgaaatcccagcactttgtgaggcagaggcgggcagatcatgaggtcaagagatggagaccatgctggccaacatggtgaaaccccgtctctactaaaaatacaaaaaattagccgggcgtggtggcgcacgcctgtagtcccagctacttgggaggctgaggcaagagaatcgcttgaacccaggaggcggaagttgcagtgagccgagatcacgtcactgcactccagcctgggtgacagagcgagactccgcctcaaacaaaaacaaaaacaaacaaacaaacaaaaacaggccagccacggtggctcatgtctgtaatcccagcgctttgagaggccgagacaggcggatcacctgaggtcaggagttcaagaccagcctggcctacatgttgaaaccccatctctactaaaactaaaaaaaattaactaaccatgatggcacactcctgtagtcccagctactcaggaggctgaggcatgagaattgcttgagcccaggaggtggaggttgcagtgagccaagattgtgccactgcactccagcctgggtgacagagcaagactctgtctcaaaaaaaaaaaaaaaaaagaaaagaaaagaaagaaagaaagaaaagaaaagaaaaaaaacccaaagcaagtggcaggccagatttggcccatgggtcaacccttgctctaaaccctcccatggctccctgttgccctcagaagaaagttctcacaggcacttcctgcagacgcaccttgcccactcccatttgcccttcagtgacttccctaggccaggtcaggcacctcttctgggctctgacattgcttcctcctcacagctttgcccaccccatgctgtaactccccggacccagtttccgtctcccgactggactgtgagcctatgagggtgcgccctgggagttcctcagctgctgttgctgcttcattcagcctacaggacctactgctcaggaaatgatttgattgattgattgatttaatttatttagagatggagtctcgcactgttgcccgggctggagtgcagtggtgcgatctcagctcactgcaagctccgcctcccaggttcaagcgattcacctgcctcagcctcccgagtagctgggattacaggcgcccgccaccatgcccggctaattttttttgtatttttagtagagacggggtttcatcgtgttagccaggatggtctcaatctcctgacctcgtgatctgcccgcttcagcctcccaaagtgctgggagtataggtgtgagccaccgcacccggccaaattattttattttattttaagatggagtttcgatgtgtcacccaggctggagtgcagtggcacaattttagctcactgcaacctctgcctcctgggttcaagggatcctcccacttcagcctccggagtagctgggactacaggtgtgcaccaccacacccggctaattttgtatgttttagtagagatggtgtttgaccatgttggtcaggctgatctcaaacaaagtattttaatataatgtaacatttaattataatataattgtatgatatatgatatatatcaattataggccacattataattatgaataattatcatataattgattattatatattatatactaatttgtagataacattcttattttaaatatttttaaatatagtttaaaaatttcctgccaggcgcggtggctcatgcctgtaatcccagcactttgggaagctaaggcgggtggatcacctcaggtcgggagttcaaggctagcctgaccaacatggagaaaccccgtctctactaaaaatacaaaaaaatcagccagatgtggtggtgcatgcctgtaatcccagctactcgggaggctgaggcaggagaatcgcttgaacccaggaggcggaggttgtggtaagccgagaacctgccatttcactccagcctgggcaacaagagtgaaactccgtctcaaaaaaaaaaaaaaatttcccatcaatcctgacctatagataaatataatttttattatttaaatattttatttatggccaggtgtggtggctcacacctgtaatcccagcactttgggaggccgaggagggcagatcacaaggtcaggagatcgagaccatcctggctgacacagtgaaaccctgtctctactaaaaatacaaaaaattagccggatgtggtggtgggcgcctgtagtcccagctactcgggaggctgaggcaggagaatggcgtaaacccaggaggcggagactccgtctcaaaaaaaaaaaaaaggtatttatttatttattttgagacaggatcttgctctgtcacccaggctggagtgcaaccatgcctgggtaacttttctatttattttaactttttgtagacatgaggtctcactatgttccccaggctggtcttgaactcctgggctcaagtgattctctcctatttacctcccaaagtgctgagatcacaggcgtgagccactgcctggctaagagtgcgctaatttatgaacccatcaaaaggagctcagagcggttagtcaactctcctgaggtcacccagcaatgcagtaacagagtggacactggccgggcgcagtggctcactcctgtaattccagcactctgggaggctgaggctggtggatcacctgaggtcaggagttcgagaccagcctggccaacatggtgaaacccccatctctacgaaaaatacaaaaattagccaggtgtggtggcagccacctgtaatcccagctacttggaaggctgagggaggagaattgcttgaacccgggaggcagaggttgcaatgagctgagatcgcaccactgcactccagcctggacgacagagtgagaccctgtctcaaaaataaaattaaaaaacggagtggaccctggatctcaagggaccccgggcagggaccggggcgggcggggctggaggcgggggcccaggctgacagctctcccctttgcaggtcttcatcgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccaggtcgctgtccctccagccccagctcacgcagcgctccgggctgcagtaggaagtggacagagcgcccctcccgcgcctttccgcggagcccttggcccctcggacagcccatctgcctgttctgaggattcaggggctgggggtgctggatggacagtgggcatcagcagcagggttttgggttgaccccaatccaacccggggacccccaactcctccctgatccttttaccaagcactctcccttcctcggcccctttttcccatccagagctcccaccccttctctgcgtccctcccaaccccaggaagggcatgcagacattggaagagggtcttgcattgctatttttttttttagacggagtcttgctctgtcccccaggctggagtgcagtggcgcaatctcagctcactgcaacctccacctcccgggttcaagcgattctcctgcctcagcctcctgagtagctgggactataggcgcgcgccaccacgcccggctaatttttgtatttttagtagagacggggtttcaccgtgttggccaggctggtcttgaactcctgacctcaggtgattcaccagcctcagcctcccaaagtgctgggatcacaggcatgaaccaccacacctggccatttttttttttttttttagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaacgggggcacccccttttcttgccaaaatatatctctgcctttggttttattttcctttgggtccagaagttttcaatctctggagtttgtgcattgggcctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatcaaaccacctttgaatctgtgtgtcattaaaagtagatataaatgggc

SEQ ID NO: 38775 - DNA, 11161 bp, Homo sapiens; identical to SEQ ID NO: 36597

SEQ ID NO: 38776 - DNA, 238526 bp, Homo sapiens; identical to SEQ ID NO: 37739

SEQ ID NO: 38777 - DNA, 15951 bp, Homo sapiens; identical to SEQ ID NO: 36065

SEQ ID NO: 38778 - DNA, 246826 bp, Homo sapiens; identical to SEQ ID NO: 37194

SEQ ID NO: 38779 - DNA, 31056 bp, Homo sapiens; identical to SEQ ID NO: 36539

SEQ ID NO: 38780 - DNA, 17689 bp, Homo sapiens; identical to SEQ ID NO: 37308

SEQ ID NO: 38781 - DNA, 49597 bp, Homo sapiens
atggtgctgtgcccggtgattgggaagctgctgcacaagcgcgtggtgctggccagcgcctccccacgccgtcaggagatcctcagcaacgcggtacggcctgggcctgggcggggcaggggaccggggacggaggggctgaaccccggagggcccagcgactcaggaactctagggatagggatgggagagtgacccgagacccttagggatgggggaggggagagtgtcccgggacctccagggatagggttggggagagtgacccggaacctctagggatgggggaggggagagtaacccggaaccccctaggcatgggggtggggagtgacctgggtccccatagggatgggggaggggatcgtaacccgggacccctaggaatggggagggtagagtgacccaggaccgctagggatggggacagcagagtgaccccggagccccatggatggggatgaggagagtaacccgggacccccaggcatggggatggggagagtaacccgggacctccagggttggggatggggagagtaagccgagaccccccctagggatgggggtgggggagtaacccgggacccctagggatgggggagaggagagtaacccgggacccccaggcatggggatggggagagtaagccgagacccccaggaatggggttggggagaataacccgggacccctagggatggggttggggagagtgacccaggaccccctagggatgggggaggggagagtaacccgggacccccctaggggtgggggaggggagagaaacccgggacaccttagggatggggttggagagagtaacctgtaacctgggaccccctagcgatgggggtggggagagtaacccaggacgccctaggcatgtggttggggagagtgacccgggaccccctagggatggggagggaggagtgacccaggaccgctagggatggggacagcagagtgaccccggagccccatggatggggatggggagagtaacccgggacccccaggcatggggatggggagagtaacccgggacctccagggttggggatagggagagtaagccgagacccccctagggatgggggtggggagagtaacccgggacccctagggatgggggagaggagagtaacccgggacccctaggaatggggaggtcaagtgacccgggacccccctagggatgggggtggggagagtgacccgaaacccctaggcatggggttgcagggagtgacccagaaccccctaggaatggggatgggagagtaacctgggaccccctagggatgggggaggggagagtaagccgggatccccctagggatgggggtagggagagtaacccgggacccaaaaggatgagggaggggagagtgacctggaacccctaggcatggggttggggagagtgacccaggaccccctagggatgggggagggaagggtgacccgggacccccaaggaatggggaggggagagtgacccaggaccacctagggatggggaaggggagagtaacccaggaccccctagggatgggggtggggagagtaacccaggacgccctaggcatggggttggggagagtgacctgggacccccttagggatggggagggaggagtgtcccaggaccccctagggatggggagggaggagtgtcccaggaccccctaggaatggggaggggagagtgatccaggaccgcctagggatgggggaggggagagtgatccggaatccctaggtatgggggaggggagagtgacccaggaccccctaggaatggagaaagcagagtgacccgggacccctagggatgggggaggggagaataacccaggacccctagggatgggggaggggagagtgagccaggaccccctaggaatggggagggcagagtgacccgggacccatagggatgggggagggcagagtgacccgggacccctagggatgggggaggggagagtgatccagtaccgcctagggatgtgggtggggaaagtaacctgggacccctagggttgggggaggggagagtaacccgggaaccctagggatgggggaggggagagtaacccagaacccctagggatggggttggggagtgtgacccggaaccccctagggatgggggaggggagagtgacccagaacccctagggatgggggaggggagagtgacccagaacccctagggatgggggaggggagagtgacccagagcccctagggatgggggaggggagagtgacccaggatgccctagtgatgggggaggggagtgtgatccaggacctcctagggataagggaggggagagtaatccaagacccctaggaatgggggaggggagagtaacccgggaccccctaggggtgggggaggggagtgacctgggacccctagggattggggaggtgagtgactcaggacttctagggatggagtgggccctgtgactgatggttggactttgtagctggggtatgggaagtgtttcctggtgcccccatgaggatcttattccgggtggtaggacgcctaggtagtgggtgtctgcctctctctggagccctaatcacatggaggagacggtctagtgatgaagggatagttacttgtgatggggggtagttactggtgacaggcggatagttataggtgatgtgggatagttactggtaatggggtgatagttactggtgatgggatagttactggtgatgggggcatagttactggtgatggaaggatagttactggtgatgggggatagttactggtgatgggagatagttactggtgatggggcgtagttaccggtgatgagggatagttactggtgatgatggggcatatttactggtggtgggggttagttactggtgatggtgggatagttactgggtttgatgatggggcatagttattggtgatgggggtagttactggtgatgtggggatagttactggtgatgggaggatagttactgttgatgggagatagttactggtgatggggggatagttactggtgatgatggggcatagttactggtgatgggggatagttactggtgatggtggatagttactggtgatggggggtagttactgggtttgatgatggggcatagttactggtgatggggggtagttactggtgatgtgaggtagttactggtgatggcagagaagttactggtgatggtagggtagttactggttgcctatggatggtgcagtggggcaggagtctactcttggggactacggactggaggtctggtaccctgggaggggggacaccacatgcctggtcctagtgacggggatgagagtggtcagggtgcctcacagaaggcatgggtctccatgattgggggtgacagggcatagggcaggggtctatatgatctggggttgagatctgcagggcaggtccagggcttggtgactggtgccctgaagaccaggatgggcgtcagggccaggatctgggggcaccttcaagaggtgaggagcgctgaggagtgtagaagagtggaagaaagacgaaaaaagaaaagcagcttcacagtcaaagacgggtttattttggagaacaagcctgagcggggcttctggctgagttaggtcaggagtgttctctcttacagactaagggtatttaagggtttaggaaggggaatcttatcgcaggctcggaatgtttccctgtgaggcaaagttgactgaggtgttagaatgtctctggtctgaaggaggttatcttgggcttgggatgtttctggtcagaggcggtttatttcaggctttgactgtttctggtcatgctgacattagccattaggctgatgttttggggctggttttaggcagtttttaatcacgggaacttaaaatggcaatgcttgtccaagatggcggtgtgtgtccaagatggtggtgtgtgtcaaagatgaccatgcatgtccaagatggcagtgcttgtccaagatggtggtgcttatccaagatggcggtgtgtgtccaagatggtggtgcttatccaagatggtggtgtgtgtcccagatggtgtgtgtccaagatggtggtgcttctccaagatggcagtgtgtgtccaagatggtgtgtctccaagatggtggtgcttatccaagatggcggtgtgtgtccaagatggtggtgcttatccaagatggccgtgtgtgtccaagatggtgtgtgtccaagatggtggtgcttatccaagatggcagtgtgtgtccaagatggcggcatgtgtccaagatggtggtgcttatccaagatggcagtgtgtgtccaagatgttgtgtgtccaagatggtggtgcttttccaagatggtggtgtgtatccaagatggtggcgtgtccaagatggcggtgtgtccaagatggtggtgcttgtccaagatggtgttatgggtccaagatggcagtgtgtgtcccagatggtgtgtgtccaagatggtggtgcttatccaagatggcggtgtgtgtccaagatgttgtgtgtccaagatggtggtgcttatccaagatggcagtgtgtgtccaagatggtgtgtgtccaagatggtggtgcttatccaagatggcggtgtgtgtccaagatggtggtgcttatccaagatggcggtgtgtgtccaagatggtgtgtgtccaagatggtggtgcttatccaagatggctgtgtgtgtccaagatggtgtgtgtccaagatggtggttcttatccaagatggcggtgtgtgtccaagatggtgtgtgtccaagatggtggttcttatccaagatggcggtgtgtgtccaagatggtggtgcttttccaagatggtgttgtgtatccaagatggcggtgtgtccaagatggcggtgcttgtccaagatggtgttatgggtccaagatggcagtgtgtgtcccagatggtgtgtgtccaagatggtagtgcttatccaagatagctgtgtgtgtccaagatggtggtgcttatccaagatggcggtgtgtgtccaagatggtggtgtgtgtcaaagatggccatgcatgtccaagatggcagtgcttgtccaagatggtgtgtgtccaagatggtggtgcttctccaagatggcggtgtgtgtccaagatggtgtgtctccaagatggtggtgcttatccaagatggcggtgtgtgtccaagatggtgtgtctccaagatggtggtgcttatccaagatggccgtgtgtgtccaagatggtgtgtgtccaagatggtggtgcttctcccagatggcggtgtgtgtccaagatggtggtgcttctccaacatggccgtgtgtgtccaagatggtgtgtgtccaagatggtggtgcttatccaagatggcagtgtgtgtccaagatggtggtgcttctccaagatggccatgtgtgtccaagatgttgtgtgtccaagatggtggtgcttatccaagatggcggtgtgtgtccaagatggtgtaatgggtccaagatggcagtgtgtgtcgaagatggcaatgctcctgctctgtgaatccagaccctctagttataacaggacgaggggtggtgtgttctttctggccacttcctgctgagggaggtggttattacgggtcaccaaacacagccctggaggggaagaggttgatttgttcctggtagcactctttaggggccttccaagcagcacccgttgaaacatctagcttttagttcacagggctttaagaaagcagaacttgggtttcagaggttttcagttaggaaaaattggagaaaaagaaaaaggaaaagaatgcaaaacattatcttggagacatgtagccagaaaaattagaatttaattcaaaccgtagaaaagaataaaaactgaaaaccattaggcaagactagaatttcacgacaggggtaactatagtttttcaaacacgatttttctttttccagttttcccacttttattaaaagacaaattatgggctgggcatggtggctcatgcctgtaatcccagcagtttgggaggccgaggttggcggatcacgaggtcaggagatcgagaccatcctggctaacatggtgaaaccccgtctctactaaaattacaaaaaattagccgggcgtggtggcgggcgcctgcagtcccagctacttgggaggctgaggcaggagaatcgcttgaacctgggaggcagaggttgcagtgaaccgagatggcaccactgcactccagcctgggcgacagagcaagactccgtctcaaaaaaaaaaaaaaaaatgtcatgagatgtagggaccagccccacagggtcagtggatctctccctgtgtgcggaggcatgagagtgtagaaataaagacacaagacaaagagataaaagaaaaggcagctgggcccgggggaccactaccaccaagacgcggagactggtggtggtcccgaatgccaggctgcgctgatatttattggatacaagacaaaggagcagggtaaggagtgtgagccatctccaatgataggtaaggtcacgtgagtcacgtgtccactggacagggggcccttccctgcctggccgccgaggcagagagagagaggagaaggagagaaacagcttacgccattatttctgcttatcagacacttttagtactttcactaatttgctcctgctaactaaaggcagagccaggtgtacaggatggaacatgaaggcggactaggagcgtgtgaccactgaagcaaagcaccacagggagagggttaggcctccggataactgcgggcgggtctgactgatgtcaggtcctccacaggaggtggaggagcagagtcttctctaaacccccccagggaaagggagactccctttggtgaccccgtctgggcataacagaaggctcgcgctcgtcttctggtcgcacctcaccatgtcccctcagctcctatctctgtatggcctggcttttcctacattatgattctagagcaaggattattataagattggtataaagagtaattactaccaactaatgattaatgatattcatatataaccatatctaagatctatatctggtataactttctcgttttatattttatcatataccggaagagctcgtgtcctcggtctcttgcctcagcacctgggtgtcttgccgcccacaatgagaggtgcaacttgacatagggagggtagaagatagcctgagtatagggaacctcttgccatttcctggtgataaagttgtcaaggtccctgagaatttgcaagttaaaggtgctatgttcgggccatctgctgtcattatgtagtttgtattgatgccagactattgcaataaaaaattcaacactctggctttaggttcctctgtaagccaagtttggccaggttggaaaggagacatcccagagaggaggacataggaatgtcgggttgtttggcacccacgtgggctggtaaaaggaagccgagagtgtctgtttgtgttttaggcaaccccagacaaaagacagagacccagaatcctctttataaggaggacggccaagctgagaagatactgggcatccctcaagatcgcttctagcttagtgccgctggtcctccgaggactgggatggccgacctgacttttcctgggtaccaaaagtcagaggagggcagatcttaccagacggctggatttgtgtctgatgttggatgttcctgttggaattggcaaaggggctcccaaactggagccgcgcagggaagacagagagagagagagaagagggaagaagacggacgaagagagaggaagacgaagcaagggttagggagcgaaatacctgttgcagggggtcagaggtggatttctgagacctgagggttttgagaaccctccagcttgagcctctaagtcccctttacatgagttgtcttcctcacacaaattgcttggaaggtgaatggagagaaaagatgggaggggtggccagagaccctcacgatccaggagttagcccaggatgagctgctgctgcccacagcttcctgggttgcaagagaacctccactcccaacactcaaagagggagagagagaaaggacagggtcagagggccagaggctctaaaggatccaggagttagcccgggacaggctgcccctgcccactgcatcctgggttgcaaaagggcctctgtccgtaacacctgtcctgggtttcggcaccaaatgtaagagtttaagaaggaggaaacaaatatagaaagtgagcctgggcgcagaggctcacatctgtaatcccagcactttgggaggccgaggcgggcggatcacctgaggtcaggagttcgacaccagcctgaccaacatggtgaaaccccatctctattaaaaatacaaaaattagccgggtgtggtggcgcccacctgcaatcccagctactcgggagactgaggcaggagaatcgcttgatcctgggagatggagcttgcagtgagccgagatggcatcactgcccctccagcctgggcgacacagcgagactccgtttcaaaaaaaaaaaaaaaaatacaaaaagtggctcagcaaagggttttggaaaagggggcttctcgcaggctcggaatgtttctgtgtgagggaaaattgattgcggggttggactgtctctggtcggaggggaggtttctggtcacagaggggtttatcccacggctggaatgtttctggtcatgctgacattagccattaggctgatgtttgggggctggatttaggcagtttttaatcaagggaacttaaaatggaagtgtgtgtccaacatggcagtgtctgtccaagacgggggtgtctgtccaagatggcggtgtgtgtccatgatgggggtgtctgtccacgacggcggtgtctgtccacgatggtggtgtgtgtcctcgatggccaaaatggcggtgtgtgtccacgatggtgtctgtccacgatgggggtgtgtgtccacgatggccaagatggcagtgtgtgtccacgatgatgtctgtccacgatgggggtgtgtgtccacgatggccaagatggcagtgtgtgtccacgatggcggtgtgtgtccatgatggcggtgtgtgtccatgatggcggtgtctgtccacgatggcggtgtctgtccacgatggcggtgtctgtccaagatggcggtgtgtgtccatgatggcggtgtgtgtccaagatggaggtgtctgtccaagatggcggtgtgtgtccacaatgacactgtgtccatgatggccaagatggcggcatgtgtccacgatggtggtgtgtgtccaagatggcggtgtctgtccaagatggcggtgtgtgtccaagatggcggcgtgtgtccaagatggcggcgtgtgtccatgatggtggtgtgtgtccaagatggcggtgtctgtccaagatggcggtgtgtgtccaagatggcggtgtgtgtccaagatggcggtgtgtgtccatgatggcggtgtgtgtccaagacggcggcgtgtgtccacgacggcggtgtgtgtgcacgacgacggtgtgtgtcccagatggcagtgtgtgtccacgatggcggtgtgtgtccacgatggcggtgtgtgtccaagatggcggcgtgtgtccacgacggcggtgtgtgtccacgacgacggtgtgtgtcccagatggcagtgtgtgtccacgacgacggtgtgtgtccacgatggtggtatgcgtccaagatggtggtgtctctccaagatggcggtgtgtgtccaagatggcgatgcttttgctctgtcagaggggagatggtcagaggggagatgcggagttccctgcaccctggcagggtgtggcagccaggggctcccccactggaggcatttaccaccatcattcctgaccccacggtctctgcaggggtcactacctctaggccaggcctccccaggggcggtgttgtctcttcctgggtaccagggattgacgtagagccatcattgtctcccttcccacagccatcattgctggcgtttttcctgaatttcctgtgggcaggttgggttttgtactctgccccaaccttcaggtctctgggaatcctcggacactgttggctcgtgggttcaaggcccgagtcaatacctccctgctggcctctttgttcctggcttcttcctttgccaatctcttccctcgagagccaagaaggcccctggtcagtccctgaaggcccctggtcagtccgcggcccactaaccacacttagggaaagccctggtcagtccccggctccccagccacacttagggaaagcttggcggatggatgagctcacctgggacagggtcggggagtgtagcaaacgctatgtgcgtcctgcaaatcttgcatgtcccattcacttttcatagggtctttcattgacccttctgaccccttttctactgttgcagggtctcaggtttgaggtggtcccctccaagtttaaagagaagctggacaaagcctccttcgctactccgtatgggtacgccatggagaccgccaagcagaaggccctggaggtggccaaccggctgtaccaggcaaggggcccctgcccttcggcccttatgaaaattcctttgctgtgatgaggggatttgcgggtggtaaatatacatgacacaaataaacgtcattcaaaagatgcagttggtggcacagcttagctattgctatgttataatgtaatgcactattgcagtaacctaataataccattaatgatacagaattaatggagcttatctgttactgtgtgttataatattctcttgcaattgatacagtatcattgatgatatacaattaatgtagcttatctgttactatgtgttataataatttctcgcaattgatacagtatcatttatgatatacaattaatgtagcttatctattactatgtgttataatatcctcttgcaattgatatcatagtatcattgatgatacagaattaatgtagcttatctattactatgtgttataatattgtcacaattgatatcacagtatcatttatgatatagaattaatgtagattatctgttactatgtgttataatattctcttgcaattgatttcatagtatcatttatgatatagaattaatgtagcttatctattactatgtattataatctcttgtggccggtcgcggtggctcatacctataatcctagcactttgggaggccaaggcggacagatcacctgaggtcaggaattcgagaccagcctgaccaacagggtgaaaccccgtctctactaaacatacaaaaattagctgggcgtggtggcgggtgcctgtaatcccagctactcaggaggctgaggcaggagaattgcgtgaacctgggagacggaagttgcagtgagccgagatcatcccactgcactccaacttaggcaacagagcaagacttcgtctccaaaaaataaaaaattaaaacaaaaattatcttgcaatcaatataatagtctcgttgatgatatacaattaatgtagcttatctattactatgtgttataatattctcttgcaattaatataatagtatcatttatgatatagaattatgtagcttattaccatgccactaagtaatatcggattttaattaaaataatatcatttataatatagaattatgcagtttatctgttgctgtatgctacaatgcaatatacaattataattaatatactactatcatttaagatttaagattcatgtagcttgttactatgtttgaatataatattgcaattaatatagtaatatcagttacgatatagaattaacatccattactatgtgttgtgatacatagaattaatatgttactgtgtgatactatgtaatatactatgacaattaatataattgtatcataatgtagaattatgtcatttatctgttactatatgctcctatgtaatacatattattttagtagagatggggcttcaccatgttggccaggctggtctccaactcctgacctcaggtgatccacccgcctcggcctcccggagtgttgggattacaggcgtgagccaccgcaccccaccgtaatacactattataattaatacactactgtcatttaggatgtacaattaatgtagcttatcaattactatatgttatatatgactctaacataatgtcagtcacagtatataaaattaacatagctattactgtgtgttttaacttgctgttacaatgaatataatgctatcatttaggatatagagttaatgtagcttccctgctgctgtgtgttaccacacaatataccattactgttaatataagaaatacattcggggccgggtgcagtggctcacacctgtcatcccagcactttgggaggccgaggcgggcggatcacgaggtcaggagttcaagaccatcctggctcacacggtgaaaccccgtctgtactaaaaacacacacaaaatattggctgggcgcggtggcgggcgcctgtagtcccagctactcgggaggctgaggcgggagaatggcgtgaacccgggaggcggagcttgcagtgagccgaggtcgcgccactgccctccagcctgggcgacagagcgagactccatctcaaaaaaaaaaaaaaagaaagaaagaaatacattagaggtaaggctgttgtgagtcgtgctatcaagacaggagtattgattgtgggttttggcagtgcacagcttagggaggccagtgcggggctgagctaaggtcaaagctgcacacagatgtcctgtgactgcctgttgctctgaggctgaattttcaacctggatttgttttatcgtcctaagtacctttttctttttctttcttttccttgtttttttttttctttttttttttggagactgagtctcactctgtcacccaggctggagtgcaggtgcgcaaccttggctcactgcaacctccgcctcctaggttcaagcgattctgctgcctcagcctcctgagtagctgagattacaggtgcccgactgatattttgtatttttagtagagacggggtttcaccatgttggccaggctggtctcgaactcctgacctcaggagatgcgcccgcctcggcctcccagagtgctgggatgacaggcgtgagccaccgcgcccagccctaagtagctttttctgaaattacattgaacggatcaaaaaccttttggccttaattctgggtaactcagggaggtttggggcccctgaatcaaaccttacctgccgcccggaagaacaaaagcttacggaacaggcattgcgtttcccgtagtgcccgtgagatgctccgtgagtgcctgacccctgatcacgcagcccccgtgggccccggcctcacccacgttccagcccctgcagggcgaccaccggcgggacccacttgtgtccttgctcgtgaccttgagcacccccagccttcacttccaaagtcggcctggcttcgcccctgcggtgctctttcacgcccgtaccgacgggaaaacttctctgtgagacccacggcacgtcaccggtaaaccggaatctggttttcttacagaaagacctgcgggcccccgacgtggtcattggagcggacacgatcgtggtgagtgcggccagggtgcctcgtttctaatgtccgatgtggttttcctgtgcttggtgattctgcctcttgtggatgttgtacattccccttaagacagcagtggactcgcttccagaaactcccatcacaaactaccagcagatgaggggcctaagggcacgggaaggggccaggcgccgtggctcacccctgtcatcccagcattttgggaggccgaggtgggcggatcaccttaggtcatgggttcgagatcagcccgaccaacacggtaaaaccccatctctactaaaaatacaaaaattagccagacgtggtggctaattgatagtatcataagtgatactatatgatatcaattgcaagagaatattataacacatagtaacagataagctacattaattctatatcatcaatgatacagaatacagactccgcctgtaatcgcagctactcgggaggctgaggcaggggaatcgctcgaacccaggaggcggggttgcagtgagccgagatcgcgccactgcactccagcctgggtgacaagagcgagactccgtctcaaaaggcacaggaaggtacgcagttctagaggccagcaaccacaaatcacggtgtctgtagggtttcttccttccagaggtactgaggagaagttggtcttggtctttctccagctcctagaggctgttggcaacccattgtctcctttggctcatggccctgtggttcctatctgtgcctccatctccatgtggccttctcccctctgggtgtctgtggccaaatttccctcttcttttttttttttgagagagagtctcactgtgttgcccaggctggattacagtggcgtgatctcggctcaccgggacctccgcctcccgggttcaagcgattctcctgcctcctgagtagctgggatcacaggcacccgccaccacgcccggctgatttttgtatttttagtagagacggggtttcaccatgttggccaggctggtctcaaactcccgacctcaagtgatctgcccaccttagcctcccacagtgctgggatgacaggcgtgagccaccgcgcccggctgaaattttccccttcttttaacaacaccactcataaaatgcgcatcctaattctgtccaaccgcatcttaattacctaggcaaagacccatttctccttttttttttttttgagatggagtctcactctgtcgccaggctggactgtagtggcatgatctcagctcattgcaacctccgcctcccgggtttcaatgattctcctgcctcagcctcccgagtagcggggactacaggtgcgcgcgaccacgtgtggctaattttttgtatttttagtagagacggggtttcaccatgttggccaggatggtctcgatctcctgaccttgtgatccacccgcctcggcatcccaaagtgctaggattacaggcgtgagccaccacgcccggcccatgtcttttgttcataagccacccagtctatggtattctgtgatagcagcctgaaatggactaagacatctcataagaagaggagatgaggacacagacacacacagagggacgaccctgtgaggacacagggggaagacggcgtctccaagcccaggagagaggcctcaggaggaaccagccctgcccacacctggatctcagacttccagactccaggattatggaagaatcaatgtctgctgtttataagccacccagtctatagtattgttttagcagcctgaaatggactaagacacctcataagaagagcagataaggacacagacacacacagagggatgaccctgtgaggacacagggagaagacggcgtctacaagcctaggagagaggcctcaggaggaaccagccctgcccacacctggatctcagacctccagcctccagggctgtgggagaatcactgcctgttgtttataagccacccagtctgtggtattctgtgacagcagcctgagatggactaaagcatctcataagaagaggagatgaggacacagatacagagggacgagtctgtgaggacacagggagaagatggcatctccaagcccaggagagaggcttcaggaggaaccagccctgcccacacctggatctcgcccttccagtctccacgacgatgggagaatcaatgtctgtagtttaagccacctgggttgtaggactttgctatggtggcccagtcagactaatacatctactcttgtatgtacccaaaaggattcaaaacaggtgttccaccaaaaccttctacatgaatgttcacagcagcactattcacaacagctaaaaggcagaaacagctcaagtgtctgtcagtgggtaaatgggaaattacaacatggtccatccacacacagtggaatattatgcagccatgaacaggaatgaggctggccgggtgcggtggctcacccctgtcatcccagcactttgggaggccgaggcgggtggatcacaaggtcaggagatcgagaccatcctggccaacatggtgaaaccccgtctctactaaaaatacaaaaaattagccgggtgtggtggcgggcgcctgtagtcccagctactcgggaggctgaggcaggagaatggcgtgaacccgggaggcggagcttgcagtgagccgagatcgcgccactgcactccagcctgggtgatagagcgagactctgtctcaaaaaataaataaataaaaaataacaaaaattagccaggcatggtggtgtgcacctgtattcccagcaactcgggaggctgaggcaggagaatcacttgaaccccggaggcggaggttgcagtgagccaagaccgtgccactgcactccagcctgggcgacagagtgagactccatctcaagaaaaggaaaggaacgaggctgtgaaacaggctgcaacatggatgaatgttgaggacatcacggtcagtgacagaaaccagccccggaggaccacacgttgcaggattccatgactacaccacgtccgcaacaggcaaacgcacggtgaaagaaagaggatgggcggttaccaggatctggggaggcgcactggggagggacagctgcgtggggacagggtctccttctggagtgaagagaacatcctggaaccaggcaggtagtggtggtacaacatggcaactctggttagttgtttgaaatggcgactctcaggacgtgtcagcttcatttccataaaacaagtgacttctgcgaatgggaccgtgggacttgcacaggcctgacccagccggtgggaaccaactccctctgtcccttcctctcacagacagtcggggggctgattctggagaagccggtggacaagcaggacgcctacaggatgctgtcccggtaagcaccatgttggcctctgagccctctcgggttctgagccacagagtagctgtggtatctggccgggtgtcctggggagcagggtggatctctgtcagctctgccgtctgagctgtgctgtctgagctgtgctgtctgagctatgcagggaggcaggcactatccctccatgctcatccttgtctaggattctgcagcactgatcccagaatgtctcatgcccactgcagactgttggggtcatgagaagttggcagtgtcctgtccttcccactgggcatcctggacctgagcccgtagcctgggacgtcatccccatcccaggacgtggaagagatgcaccccctgcccgccataggcccagctgagagctgcctggcctggcgcctcccgtcagggccactgctggtgggatttgtgaccccttccctcggcctctccgtaaaggtttccctggagaccccacagcgggacgatcggggagaagatgctggggacggatccaggattaaggacgcctcgctgcctcccctggttttgagaaactcgctttgtagctcccacgggtcacagcatggtcacgtggtcacccgttgttgtcttacaggttgagtgggagagaacacagcgtgttcacaggtgtcgcgatcgtccactgctccagcaaaggtaaccgcggcccaggtttcggggtagccccagaggccgagacaaggacccgggacattctcgggacccttggcttgagggaggaggacggttgctcacccccacctgtggaggggtttgtgcctatgtcctgcttgggaaagttgtccgccgatttggaagtctgcaggacaaaggaaaacgtgtggttttatctttttctttttctttcttttttttttttttttgagatggagtctcgctctcttacccaggctggagggcagtggcacgatctcagctcactgcaacctccgcctcccaagttcaagtgatccttctgcctcagtagctgggattacaggtgcccaccaccatgcccggctaatttttgtatttttagtagagacggggtttcaccatgttggccaggctggtctcgaactcctgacctcaggtgatccacccgcctcagcctcccaaagtgctgggattacaggtgtgagctactgcacccggcctttctctttctttctttcttttttttttttttgagacagggtctccctctgtcacccaggctggagtgcagtggtgtgatcatagctcactgcagcctcgacctcctgagctccagcgatcctcccgcctcagcccctacagtcacagaaactacaggcacacgccaccacacctggctcatttttgtattttttatagaggtgcggtcttgctatgttgcccagactggtctcgaactcctgggctgaagaaatcctcccatctcagcctcccaaagtgctgggactgcaggtgttcaccatattgctgggactgcaggtgtgcaccacggtgcccggcccaggcagttgtatcaccatattgctgggttcttcctgcaccaacccattcccagcttgttggcggacaccaggaggcatcgtagaattcagtcagttctgacagtagccgtcggagttagcgcagatcccacaggtgaagggccgggtcccatgggacctccacgcacaatcccagccccatatccctggtcacacctgtagttttctcacccacctgccgctcactgctggctcctgcaagcacctgctcaggttgggtcatttgctcgaggggctcacagaactcgggacagcactttccttcccagcttggggttttgttatgaaggagcaggtcaggaagtgccagacagaagccaggcacagcgcagggtgctgggtgcaggatgtatggagcctccatgcccgccgtggcacagctctgccaacaccctgatgtgttcacccaccagaagctccctgaaccctgtccttctgggtctcttttttttttcttttttgtgacagagtctcgctttatcgcccaggctagagtgcacttgcgccatctcggctcactgcaagctccgcctcccgggttcacgcccttctcctgcctcagcctcccgagtagctgggacgacgggcccgccaccacgcccggctaattttttctattttttttttttttttttttttagtagagacggggtttcaccgtggtagccaggagggtctcgatctcctgaccttgtgatccgcccgcctcggcctcccaaagtgctgggatgacaggcgtgagccaccgcgcgcggtcccttctgggtctcttaaaaggccaggattaacgacatcatccgccactggggagcaaactccatctccagccccctccccctgttcccatgacaaccaaagcctgccctttccaaaaggcccctcattaacataaggtcccctgcggatgaaaggggcttgtcaccacatagcaaaacgcctgctttcgctcctgtcactcaacagattccccgggattcaggggctctgtgtccggaccctgaggcacagaccaaacatctgtttcttttattatttatttatttgagacagagtctcgctctgtcgcccaggctgcagtacagtggcgtgatcttggctcactgcaacctccgcctcccgggttcaagcgattctcctgcctcagcctcccgagtagctgggatgacaggtgcatgccaccacgcccggctaatttttgtatttttagtagagacggggtttcgccatgttggccaggctggtctcgaacccctggcctctggtgatccatccgcctcggccgcccaaactgctgtttcttttgttttttttagagacggagtctcgctctgtggcccaggctggaatgcaggggcgcgatctcggctcactgcaacctgcacctcccgggttcaagcgattctcctgcctcagcctcccgagtagctgggactacaggcacctactaccaggcctggctaattttttgtatttttagtagagacggggtttcaccgtgttagccaggatggtctcgaactcctgacctcgtgatccacccgcctcggcctcccaaggtgctgggatgacaggcgtgagccaccgcgcccggcccctttctcccttttcttgtccgaaatgaaccttattctcccatgaagcatccatatctgaactgtgcgctgcgctcgagtacacacctccacagcacagccacgcagctgtcagggcacggaggtgacaagctggcgtccacgctcacccccacggctgtgtccttgcagaccatcagctggacaccagggtctcggaattctacgaggaaacgaaggtgaagttctcggagctgtccgaggagctgctctgggaatacgtccacagcggggagcccatgtgagtctcgggggcggtggggggacgggggacacgtgtggaagcctggccaccctcacacgtggggtgtcccacccagcctttgggaaagaaggaggccccgctccgggggccgtgtggcacagggagagccgcccggctcagaagcacaaacccttcacgaccacactgacccatggaggctcaaagaggcaaactcccaggacagagaggggcagggtgggagccaacgctgggctgcggtggggactggggaggcgctgggcaggggtagaggagttcacgtggtgggaggaggagaccccagaggtctgtgcccaggacgctggctgcaattaacacgaataaactctgtgatccaaagtcaccctaagaggtgattctacctgtcgtcccgtccacagattggtgagcacgggaagtatgcgtgcaccaatcagcttcacttcatcacccaccatttgcgtttatatgtattatatttatctacatcatatgtcatataatgtctacataattatacattatataatgtaacatgatatatatttacaattatatataatttatgtattccacattatatattctattaattatatataatctacattatacaaattatataatatatatttataatatattgtattatatactataatagattatactgtaatatgtatactatattacatatagatattataatatagattatatattaacacttttgattgaaatttaatgatttttaatgattaattttaataagtagtgattaatattaatgtaatatataccatctattataatatatactgttataatagattatatgataggttatataactgttaaaatagattatataataggtagttataatcgattataattatatataaattatataatttatatttataattatttataattatatataaaatatataattttatatattttatatatttaattttatttatatataaatatataattacatatatttataattatatataaatataatttataattatatataattaattataaatgatatataattatatataattataaacaattatataaatataaattatatataattatatatataattataaaatgattatatattataaaatataattatatatttatataatatagaaatatatgaatatatggataatatgtaatatgtattaaatatgattaatatatgtaactgcatattaatacatattacataataatataaagtgtgattatatgtaaattatatattaattaaatatatgtaatacatattagttatatataatatataatgtattatgtgttatataaatatataattatataaaatatatttttatattataaaagtatataaatatataaatatatgtatataaatacatttgtataaaatatatgtttattttatatatttatataaataattttatttatttttttgagacacggtctcactctgtcacccaggctggagtgcagtggtacagtcatagctcactgcagcgtcagcctcttgagtcaaaatgatcctctcacctcagccccactagtggctgggtctgcagacgcataccaccacgcctggctaattttttctattttttgtagcaatggggtctcactatgttgcccaggctggtcttgaactcctgggctcaggcgatccttccaccaaagcctcctgagtaggtgggaccacaggacacgcaccaacacacgcggccgattttattgttagtttttgtagagatggagtctgcgtaatatatatgtatattaacctagaggattttacatcaattgaaataagcccggcagaagaagacacataccacaggatctcacttatatggaatataaaacagttgcacttggtcaaaggatacaagatttaaatcagggccaggcatggtggctcacgcctgtcatcccaatactttgggaggccgaggcaggcggatcacctgaggtcagaagttcaagaccagcctggatatggcaaatcccaatctctactaaaaatacaaaaattagcccggtgtggtggcaggtgcctgtaatcccagctacccaggaggctgagacaggagaatcgcttgaacccagcaggtggaggttgcagtgagccgagatcgcgccactgcactccagcctgggcaacagagcgagactccgtcttttaaaaaaaaaaaattaagtgagacgggagaagttcaaggctctttacagcctagtgactgtggtttacaggaacagtgtcttactggaaaattgccagcacactacatctgaagtcttctccccacacacacagaataggtacatgaggtgctcgatgggataattggcttgatttaatgatgtcacatgtatacatatatcaaaacatcccatttaacacatgaaattttttttgagacggagtcttcctccgtcacccaggctggagtgcagtggcgcgatcttggctcactgcaacctccaccttccagtttcaaacgattctcctgcctcagcttcccaagtagctgggactacaggcacccaccgccacgcctggcgaattttttatttttagtagagaaggggttttgccatgttggccaggctggtctcgaactcctgacctcaggtgatctgcctgcctcagcctcccgaagtgctgggagccaccgcgcccagcccaacacctgcactttcatacatactttaatgtttacatacatttaaagaaagacaggccgggcacagtagctcaagccaagacgggaggatcacttcatcccaggagttcgagaccagcctgggcaacagagtgaaaccccatctttataaaaaatgataaaactagctgagtgtgtccctgctacgtgggaggctgagattacagcatcatttgagcccagaattttgagggagcagagaaccaagaatgtaccactgcacttcagcctgagcaaccgagtgagaccctgtcttgaaaaaaaaaaatagataaaataagaaagagaaaagagggccagacgtggtggttcacacctgtaatcccagcactttggggggccgaggcaggcgcatcacctgaggtcaggagttcgagaccatcgtggccaacatggtgaaaccccgtctctactaaatacaaaaattagccgggtgtgttggcaggtgcctgtcatcccagctacccgggaggctgaggcaggagaatcgcttgaacccaggaggcggaggttgcagggagccgagatcgcgccactgcactccagcctgggcgacagagcgagactctgtctttaaaaaataaaaataaaaaataaaaaagtgagacaggaggaagaagttcaaggctctttacagcctgtgactgtggtttataggaacagtgtcttactggtaaattgccagcacactagatctgaagtcttctccccacacacacacacacaattcgtagatgagatgctgaatgggataattggcttgatttaatgatgacgcatgtatacatatgtcaaaacatcccatttaacacatgaaattttatttatttatttatttatttgagacggagtcttcctctgccgcccaggctggagtgcagtggcacgatctcggctcactgcaacctcctcctcctgggttcaagtgattctcctgtctcagcctcctgggtagctgggattacaggcgtgtgccaccacaccacacccggctaatttttgtatttttagtagagatggggtttcaccgtgttggccaggctggtcttgaacttctgacctcaagtaatccacccgtctcggcctcccaaagtgctgggattacagccgtgagccattgcgcccagccttgctgtgaaattgtttttctttttttttttttttttgagatgccaaaggcgcctgcccccacgcctggctaattttttgtattttttttagtagagacagggtttcactgtgttagccaggatggcctcgatctcccgacctcgtgatccacccacctccgcctcccagccgtgaaatgttcagacccaggaacttttctcctccttgtcacctcttaccttcccctgcccacccagggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaaggtacctgtgtctgtctcctcaggccacatttcacaaatgagcctacacactcggcttaaatcaaagggaatttacttctcactgtcctggaggctggcagtctgaggtcaggttgtctcagggccatgctttctccgaaggttctaggagagggtccttcctgcctctcccagctcctgacagctccaggcatccctgggcttgtggccgcatcactccagtctctgccacgtcctccacgtggcctcatccactgtgtctgtgtctcctcctctgtctcttagaaggacacctgtcattggacttggagtccacccttcttcgtgatgatttcctcttgagattcttaattacatctgccaagacccctttttaaaacaaggtcccattcacagattctggggatcaggatatggacagatctttcaggaggaccacagttcagtccactacagatgtatccagttccttctggaggccccaggggagggtccttcctgcctctcccagctcctgggggctccaggcatccctgggcttgtggccgtatcactccagtctctgcctttgtctccacgtggccttctcctctgtgtctgtgtctcttctgtctcttagaaggacacctgtcattggattttgaggtctccctaatccactgactccaactcatctgaagtcccctagcttacttacgtctgcaaagacccttttttctttttctcttttttttgtttttgtttttgtttttgagacagagtctggctctgtcatccaggctggagtgcagtggcatgatctcggctcactgcaacctctgcctcccgggttcaagcgattctcctgcctcagcctcctaactgtggtcctcctgaaagatctgttcatagcctgatccccagaatctgtgaatgggaccttgttttaaaaaggggtcttagcagatgtaattaagaatctcaagaggagatcctgagtagcctcaggagtagcctcctgattacaggcgcccaccaccaagcccggctaatttttgtacttttagtagagacagggtttcgctatgttggccaggatggtctcgaactcctgacctcagctgatccacccgcctcggcctcctaaagtgctgggattacaggcgtgagccagcgcgcccggcctgaggccccatctttcagctgttctgttcaggggcccctcacggtggcagcctagaagggatgcagccctcccaacaccaggggtccctcacagggcgtcctccgggaagcagaggtggggatgtcgggtgcaggagggacgcaggctttgggagacagggagacgggctgatgacacctcctgccattcatcatcaggagagagaacatgcagtgaataaggaataaaggtggttacagcacattccgtctgtgcctctaatttaccaagtggtgattattaaatcaccaccaggtggtttataaacaacagacattgattctcccacagtcctggaggctggaggtccaagatcaacgtgtgggcagggctggttcctcctgaggcctctctcctgggcttggagatgctgtcttctccctgtgtcctcacagggtcgtccctgtgtgtgtgtctgtgtcctcatctccttttcttatagggaccccagtcctattggattagggtccacccaaatgacctcattttacctgaatcacttctttaaaaccctgcctacaaatacagtcacatcctgagggactggggggattaggagttcaacatctgggttttgaactcagtccatatcggcagcatgttgatttttctcccatgggctagtttttctgcatgatattcgttgatgtgctttttccttgtgtacaccttgttttatagctggggacttgatcctataaatccccaccgttctctgtgaaagaaggctcaatggccaagttgtatacttccgacagcgttggcctccatcttttgagtctgtgggagtagaaagtactggacaagggacttaatgagtctctctgcacttgcttttaacagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggtgacaggacccagcgggttttgctctgaggatctttgcaggtggaagtcactgagggaaggtgacctggagcctgggcagagcgaggaaggaggcccacaccttctgtccctctgccctcaggaatgctgcttttcccgaaaggttgagaagcagagggtgaatgacagagagggaacagtggcagccgcgagcacataggagaagcgtgacctccttatgggctctagtctcaaaggggctgtatcagtccatgttctcctgagaaacagaacccaatacggtgtacacagacattgatttagttgcttatttatttttatagacaaataacgtagatggatgggtagacagatacatagatagatgataaatgcatagatacattgatatagattgacgatagagagatgacagatacatagatgatgggtagagttgatatataaatggatggatggatagatggatggatggatggtaggtggatagatgggaggaaggatggatggatggatggatggatggtaggtggatagatggatgggaggagggatggatggatggatggatggacagatggattgatcaatggatggatagatacatggatgggaaggtggatggattggtggatcagtggatgggtggatggatgggtgggtgggtggatggatagatggatggatggagaggtggatggataaatggaagggtgggtagatgggtgggtaagtggatggatgggtggatggatgagtgggtgagtggatagatggatggatgtgtgaatggaaggatgtgtggatggatgggtggatgactggatggataaaggtgggtagatggatggatggatcgatgaatcggtggatgagtgcatagatgggtgggtaagtggatggatgggtggatggataagtgggtgagtggatgggtggctggatggatggatggacggacagatggatggatggatggatgtgtggatggatgggtgagtggatagatgtgtggatagatggatgagtgggcgtgtggatgggtgggcgtgtgaatggatggatgagtggatggatgggtgcacggctgggtggatgattgggagtgtgggtgaatagacggatgggtgggtggacagatggatgggagggtggatgaacagatatatcagtggatcggtggttgggtagctgggtgggggaatggatggatgaatgggtaggtgggtggttggatgggtggatggatgagtgggcatgtggatgagtgcatgaatggatggacgggtgcatggctgggtggatgatggggagggtgggtgaacagatgggtgggtgggtgggtggatggatggatggatgagtgattggatgggtgggggaatgaatggataaatggatgtggatggatggatgcatgcatgggtggatggatcagtggatccatcagtggatgggtggatggatgggtaggtgggtgggtggatggatggatggatggacagatggatggatgagtgattggatgggtgggggaatgaatggataaatggatgtggatgtatggatgcatgcatgggtgcatggatcagtggatccatcagtggatgggtgaatagatggatgggtaggtggatggatggatgagtgggcatgtggatgggtgggcgtgtgaatggatggatgagtggatggatgggtgcatggctgggtggatgattgggagggtgggtgaatagatggatgggtgggtggacggatggatgggaggatggatggatagatgtatcagtggattgctggatgggtagctgggtgggggaatggatggatgagtgggtagatgggtggatcggtggattggatgggtgggggaatgcatagatgagtgatgaatgggtggatcagcagatgggtgggtggatgactagatgggtgggtgagtggataactggatgggtgggtgagtgggtggatggatggatggatgacaatgtgttttctgaattgaacagaactcttcagcatggtgctagaatagagagcacatgaccaagtccttgagtagcctgggaagggcaggacaacagatgacacctgggcagaggtggctgtgcttctgtgattaggagacaaagcatgccctggttgaggctccaaaggctgtgcccttaccacagagacatgtgactatatccttagaggctggaacatagaagccagaacatcttccccagccagagcagttcaggaccattctcccgtattgaaaataatgatgaataggccacgcctgtaatcccagcacttggggaggccaaggcaggcagatcacgagttcaggagatcaagaccatcctggctaacacggtgaaaccccgtctctactaaaaatacaaaaaattagccgggcacggtggcgggtgcctgtagtcccagctactcgggaggctgagggaggacaatggcatgaacccaggagacggagcttgcagtgagctgagatcgtgccactgcactccagcctgggggacagagtgagactccatctcaaaaaaaattaaaaaattaaaagaaagaaaataatgatgaatatggagaaaggcttttcatcaccggcaccatgcaagcttgttccaactccttttgacaacgctttgtgcagttgagtcctaggagcagttccacgtctgcagaggctgctcctgcttcaccataggtctcatcatttattcatgatgaaaataaatgtcatctatctgactatagcaaaccgtacactcagggtcagctcggtgggaaaacagtaacatttcatcattaacatgaacacagggctgtttcttacataggaggaccggagtggtgcgaggccatctgtttccatatacgggtctccaccaacaacttctccaccttccagcctcccattctgtgggagggggcatcctggaagggagcttggggactgggtctatggacagctgacctgggcatgaagtgggtggagaatgaagttccctgtatcatttggggctctccagggtaacagaacccctaggatataacctaggagatttatcttgaggacttacgtgattgtgtaggctggcaagtccaaaatccacagggcaggccaggaggctggaagctcaggcaggagctgctgctgccatcttcaagtggaatttctcctccaggaaagcccaatgtttgcttctggggttttcaatgagctggatgaggccaatgcacattttggggggttaatctccttaaagtcaaactgatggtagatgcaaacgccagctacagcacacctccacagccacatctagatgggtgtttgcctgcataactgggaacttgagcgtggccacgatcatgaagaaaggatcagcctcagtgggtaacagttacagcagttgacagctggggcgtggtggctgctgttttcctgcccagctgaccctgagtgtacagtttgctatagtcagatggatgatgtttattttaacatctcaatgatgcatcccctatggtcaggtttccttgagtgtacggtttgctatagtcagatgggtgatgtttattttaacatctcaatgatacatcccctacggtcaggtttccttgggttttctcgttaggaggtcacacgactgtccccatttctccaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggtagcataacacccccgcggacacctttccgtctagcgtgcattttgctaaaacactttgacacacagatcagtaggcaccttgaccagtctgtctccagtctgacagatcccaaaggcttggctcgttctgcctggagaacttagtgccgtggctcttgtgtcactcagccctggaacaggtgcaacttagacatcctccactgttatccagcagctgatgaaaatagaatttcctcctagaaacaggtttgaaggccatgctcaggggctcacacctgtcactcccagcactttgggaggccaagttgggaggatgatttgagcccgggagtttgagaccagcctgggcaacatagtgagacccccatctctacaaaaaattaacagttaggctgggcatggtggcatgagcctgtaatcccagctagtttgggaggccaaggtgggctgatcacctgaggtcaggagtgcgagaccaacctggccaacgtgctgaaaccccatctctactaaaaatacaaaaaaaaaattagctggggatgatggcgcgtgcctgtagtcccagctactcaagaggctgaggcaggagaatcacttgaacccgggatgtggtggttgcagtgagctgagatcacgccactgccctccagcctgggtgacagagcgaaactccatctcaaaaaaaaaaaaaaaaattaacgattagccaggtatgattaggcagctactttgggaggcccaggtgggtgggaagatcacttgaacctgggaggtcaaggctgcagtgtaagccgtgatggtgctgctgcactccagcccgggtgacagaacaagactctgtctgaaaaatagaaataggaaggagttggacaggctgccttaaatgaatgccctgtttcttctttgcttcaatggaactgacacttgcttatctgaggccgctgtttgcaaagcgctccctgcatcctctcgcccctccttcccctttccccgcccagaaccttcctgaggtggacgtgtgagatatggtggggtccgtggggcctgtgcagatgggtgggtctcggtctgcagggctgtgccagccaggcgtggggagtctgctgtgggctcggctggccgtggcctcatgcctccttggcagcgctggccgagcttctgtggcagtgagcacggagtcagggtgtgtgtgtgtgatgcagagatgagccccagggagccgggggcttcctgcagatgttggggagagacatacagacagggagacacagagagagagataggcagacagaaagatagagggagacagagacagacagagatggaggcagacagagacagggagatagagggagacagaaacagggagacagaaagacagagacagagatagagtgagacagacacggagatgggagacagatagtgagatagggagagagatggagagacagggagacttgagagacagagggaggcggagacagagatagggagacagaaacaaagatggagacagacagacacatagagggagatgggagacagagacagggaggcttggagagacagagatagaggcagatagagacagaaacaggagacagacatagagacagagacagagggagatagaaagaaacagagacaggagacagaaacagagagagagaaagaggaagacagagacacacagacggagacagagacagacagacagagaccaagggagaaagagtcagagagagaagccagtggtggagaagccgagaggcacggacaggggccctgagctggcgtgagcagccagcgtgggcatcgcagaggacagatccctgagccccatgattgccacccacgcaggggagggccggggagcccccgcgagatttagggagccaggatggagaccggctgtcctgctgggagcggggctcagaagcatcctcagctgggcttgcttgccctgcagggacgggatgtccaggcgaaccctggacacagcactgagccaggatgagcctgggctcctctgggacccggggtaggtgccactggggggacttggagaagctcggaggagcttctcctctgcacaccagaattctcggaggagccccctctgcacaccgcaccattgtggtgaaggctgagccggggcacctgcagagacattgtggcttctctcctggttttctccagtgaggtgtttgtgggccacccggagcctccagggtgaaaagctttattgtgaaaagcctactgcgaaagtcagacgcttggagttcaggctgtggtgtggaccaagtgattccaaggagatcgtccaccactttggggtcctctgtccccagccagcccagcccccacacagacaagagtagcccacacagctgtggcatgaagcccgctctgcagcccaggcgcggctgagcccccacgctctggagccctgcacttctccccccgacccccagggagaggctgggcgagccctcgccccgtgttctctggtgcccctaagcacctgctgtgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggtgggtggcccccccgccagggctctccttactttcgtttattaagccacaggtatcttccctgctcaggacacctaccaactgcctttttccattgacaaacctgataacgacctgaaccgggccaggctgagtcccagatcatgggtggatattcccaagttccaggaggaccccggggatgcctaaatgcccccctagaaactccggggccctctcttttggctgcggagctgaggcagagcaccttggaacccctggattcccctcagcaagtctgattatatcctgactcaccctccaccccaccccagccctggacagtgggtggagcagtagacacattcccaagggctgctgggggatcggggcctgggacgattctcacaccatcagcttacatttccccaacctctgaatgcctctcctccttgtggtccagagtggctgctgtagcaccagccatcgtgtctgcatccccatggcaggaaggagaagggaggagtacagcccccacccctgggcagaaaggatttccctgtaggtctgtgccccctacacgtggcccagagtggctgctgtagcaccggccattgtgtctacatccccacggcaggaaggagaagggagtacagccctccacccctgggctggaaggatttccctgcaggtctgtgcccccacactcacctgcttgtacagtcttgtctgggataccagcgagctccccaccactggctttcccttccagcatgggaatcaatgccatgcccttgaacattacttctgccccagttgagctttggagagtcgtcagagttccatagacgacccagccacagagcatgcatttgcttccccgcaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgagccctcctcctgttcaccctgctaaccttttccagactgcagcatctctttctagacagagggcatggctgtgtgtgcacctgtgtttctgcctgggcgtttccatggtgggtatgtgtgtgcaaatgggactgtctacggtgcttgtgtgtgtgtgtctctctgtgtgcatgtgtgtggtatgccctggagcatacctgtgacatggagcatgtctgtgcgtgagcatgtctgtgtgtgtgtgtgtctgcatccgcatgtgtgtgcacgtctctggtgtgtggttgcatatgtttctgtgagagtatgtgtgtgtgtctgtgtgggtatatgtgtgcatgtctgtgtgtgtgtgtctgcatctgtgtgcatgctgtgagccggtgggtgtctgtgtgcatatgactgtcgtgcttgtgtgtctgtgtgcatgtgtgtgtgtgtgcatgtctgtgtctgtatctgtgtgcatggtgtgtgtcttccgtgcatatgtaactgtgtgtgcacgtctgtgtagtatgtccttgtgtgtgtgtctgtgcatgagactgtgtgtccacgtgtctgcaagtctctgtggtgtgtggttgcatatgtttctgtgaggtgatgtgtgtgcatccgtgtggatatatgtgtgcatgtctgtgtatgtgcgtctgtgtgcccgtctgtgtctgcatttgtgtgtatgctgtgtgctggtaggtgtgtgtgtgtatgtgactgctgtggttgtgtgtccctgtgtgcatgtgtctgtgtgtacgtctgcatctgtgtgcatgctgtgggccggtggttgtgtgcatatgtgactgctgtggttgtgtgtctgtgtgcatgtgtctgggtgtgcttgtctgtgtgtctgcatctatgtgcatggtgtgtgtctgtgtggatatgtgagcatctgctgtgcttgtgtctgtgtctctgtgtgtttctgagtctgtgtgtgcacatctctgtgtggtatgtccttgcatgcgtgtctgtacgtcagaatgtctctgtgtctgagtccgtgtgtgtgtgtgcacctctgtggtgtgtatgtctctgagggtatgtgtgtctgcgtgtctgtggatatatgtgtacatgtctgtgtgtgcatgtctgtgtgcccatctgtatctgtgtgcatggtgtgtgtgcatgtcactgctgtgcttgtgtgtacgtctgtgtgtgcatgtgtctgtgtgtgcatgactgactgtgtgtggtatgtccttgtgtgtgcgtgcgtaagaatgtgtctctgtgtctgcatctgcgtttgtgtgtgtgcaactctctgtggtgtgtgcttgcatatgtgtgagggtatgtgtgtttctgtgcgtctgtgtgggtatatgtgtgtatgtctgtgtgtctgcgtctgtgtgcctgttggggtatctctgtgtgtccgtgcgtgtgcccatctgtgcatgtctgcatccgtgtgtgtgtgcctgtcgctgtatctgtatgtccatgtgtgtctgcgtgtccatctgtgcatgtctatgtttatgtgcgtgtgcctgtctgttggtgtatctgtatgtccgtgtgtgtgtgtgcccatctgtgcatgtctgcgtctgtgtgtgcctgtcactgtatctgtatgtccgtgtgtgtgtgtgtccagctgtgcatgtctgcgtctgtgtgcgtgcctgtctgttggtgtatctgtgtgtccgtgcgtgtctgtctgtgcccatctgtgcatgtctgcgtctgtgtgtgcctgttgctgtgcatgtctgcgtctgtgtgtgcctgtcgctatatctgtatgtccatgtgtgtgtgcccatctgtgcatgtctgcgtctgtgtgtgcctgttggtgtatcactgtgtgtccgtgcgtgagtgtgcccatctgtgcatgtctgtctctgtgcgcgtgtgcctgtcactgtatctgtgtccgtgtgtgtgtgtgtgcctgtcttgctgtatctgtgtgtccatgtgtgtacctgtcagtgtatctgtgtcctgcatgtgtccgtgtgtgcatgtcttgtggcgtgtgcttgcatgtgtgcctttgtgtctgcatttctgtgcatctggatgggtatatgtgtgtgtgcctgtgtctgtgtctgtgcgtccgtgggtctgcctgtgcgtgtctctctgcgggtccacacagacacgagggcatctccaaacaggtggacaaggctgggcacagtagctcacgcctgtaatcccagcactctgggaggctgaggcgggcggatcccctgtggtcaggagttcgagaccagcctggccaacatggcgaaaccccatctctactaaaaatacaaaaattagccgggcgtggtggcgggcgcctgtaatcccagctactcaggaggctgaggcaggaaaatcgcttgaacctgggaggcggaggttgcagtgagctgagatctcaccactgcactccagcctgggcaacaagagcgaaactccatctcaaaaaaaaaaagacaatgataataataatgataaataaaaataaacaggtggacgactgtgtgaagttatcatcagtgcaagtagccgagacgtgaggggagtggagatggggaacagccgagatcagcattcatgggcatccacggtgccgaggtcacggaaggaactgacccgagagccgtcacagtgtggccttaggttagacttgaaggagaacttccaggtggcagctgctgaggccaggacggattgacaggagacgcctggaatcccagccctctgggaggctgaggcgggtggatcacctgaggtcaggagtttgagaccagccagagcaacatggtgaaaccccatctctactaaaattacagaaattagccaggcatggtggcgggtgcctataatcccacctattcaggaggctgaggcaggagaatcgcttgaacccgggaggcggagcttgccgtgagccgagatcgcgccactgcactccagcctgggcaacacagcaaaactccatctcaaaaaaaataaaaaaataaaaaaagagacagctgacgtgctgtaactcagcaccatccgacagcggccaggcctgtgggcacaggtgctggggacctccacaaccctcccccagaggttcctggatgcttttctcgtttttaaaaaaacaaaacgcaaccaccctacagctcctcctgcaggacatcatgatagctgtgcttctgatttgccagatctgcagagacagaaatgctgaaatttatttatgtttgaatggtgtctcgctctgtcacccaggctggagtgcagtggcgtgatcttagctcactgcaacctccacttcctgggttcaagggatcctcccacctcagcctcccgagtagctggggtgacaagtgcccgccaccacgcctggctaacttttgtatttttagtacagatggggtttcaccatgttggccaggctggtctcgaactcctcacctcaggtcatccacccgtcttggcctcccaaagtgctgggattacaccccgcccggccggaaatgctaaagtttaaaatcatgagccctgaaagagcaccttctcctcgcagctgggggaaaacagctctggagacttcccaccgcacactctcccgccccttctttcccctcatgcaactcacagcttgctatttatcctctccctgtcctgcagaccggaggtctgagatcaaggcatctcagggctgtgctccctctggaggctctaggggaggatccttcctgcctctcccagctcctgggggctccgggtgtccctgggcttgtagccgcatcactccagtctctgcctccatctccacgtggccttctcctctgtgtgtctcctcttctgtctcttagaaggacacctgccattgcatttagggcccaccctactccaggatgatcccatctccagatccttaattacatctgcaaagaaactttatccaaatgaggtcccattcccaggttctggggcttaggacttggacagatcttttggacgtcaccacccaacccattgcagttgtgtttgattctttctgagaggctctaggggaggatccttcccgcctcttccagctcctgggggctccaggcgtccctgggcttgtggccgcatcactccagtctctgcctccgtctccacgtggccttctcctctgtgtctgtctcctcttctgtctcttagaaggacacctgtcattggatttaggggacaccctactccaggatgatctcattttgaaattctttactcaatgacatccatagagaccctatttccagataaggtcccattcccagcgactgagggtcagcacctgaatatatcttttaaggggacaccattcactgcactacagcagaccatctttttatttcagcaattacagaggggcgtgcagctacatgcgccccccgcaacaggcaaccctcctggggcgcctgaatcaggggatcaccagagaaggccctgccattgcccactcaccggcagtgcggccccgactctccctggcacacgcccatgtgcgccgactctgcctgcctcgcccaggtgctgcccctgaattccctgcttttttcctcccttgccttcttgtcgcccaggctggagtgcgatggcgcgatctcggctcactgcaacctccacctcccaggttcaagcgattctcctgcctcagcctcccgcgtagctgggatgacaggcgcccgccacccctgtccagctaatttgcatttttagtagagatggggtttcgccgtgttgcccaggctggtctcgaactcctgagctcagacaatctgcccacctcaggctcccaaaatgctgagattacaggtgtgagccactgtccccagcgttttctcagcccgagtcaaaccgcacgggcgtgacatcactaaccagctcctcatggagctctgttcaagtccccacggggatgtacttcaggaagacccattcccgcccacacccctctcttctctgtccctgatttaggatgcgggtggccgtcccaggatctgtccggggaggactgcttcttccatacctgacggacgtatctcgttttgtctttaaaccaggtgactttttcagggaccccctccccagcgctgagctgtacgtcctgtgccggatcctgcatgactggccagacgacaaagtccacaagttactcagcagggtcgccgagagctgcaagccaggtgagagcccatcgtcaggttagctgtttttgttaagacgtagtattttgggttcaagttttacaaggaggccgggcgcggtggctcacgcctgtcatcccagcgctttgggaggccgaggcgggcggatcacctgaggtcaggagtttcagaccagcctggccaacgtggtgaaaccccatcgctactaaaaatacaaaaattagccaggcgtggtggctcatgcctataatcccagcactttgggaggctgaggcaggtggatcacccggggtgagcagttcgagaccagcctggccaacatggtgaaaccccgtctctactaaaaatacaaaaattagccaggtgtggtagtgcgcacctgtaatcccaggtacttcagaggctgaggcaggagaatcacttgaacccgggagctggagactgcagtgagccgagatcgcgccactgcactccagcctgggcgacggagtgagattcggtgtcaaaaaagaacaaccacaacaaaaaaagaattggcttatgtgactttggaggttggcaggtccagcgtctgggtgagaggcccgctaaattgtggagggtaaatctgctgtatttaaagttggccagtgtggccaggtgtggtggctcacgcctgtcatccccgcacttcgggaggccgaggcgggcggatcacctgaggtcgggggtttgagaccagcctggccaacatggtgaaaccccgtctctattaaaaacaaacacaaaaaataagccgggcttgatagcgggtgcctgtaatcccagctactcaggaggctgaggcaggagaatcgcttgaacctggagacggaggttgcagtgagccgagactgcgccaccgcactccagcctgggtaacagagcgagactccatctcaaaaaaaaaaaaaaaaaaaaaaaagaaaatcctaaagagaaaatatatttactattcgtgaagttgaagtggctcatgataaaagtcttcattcttgaggaggtcttcacactgaggaggctgcagaggaggaagccgtgggctggtgttgctgtctcaggggtggccgaggcagagggaaatccacgcatgagtggactctgcagctggatctaatctgtgtgtttctacgcagacacacgtgcacacacacacagcacgcaccatctcggctcaaagccttcacatcaggtttctcccccgtccacccaggctgctcctggagcccagtggggctgctggaaaccctggctccaggggttcgggccagggctgcatattgggtttccacagttgaaccagctggccctgagggaatctgacgggcactcagcctccctcaagagttcagcgttgttgctccagtgagaattcctggaatatttgcagacaacggttaattatcttcacagagccagggcctggcacctgcgcgttgaaacaggactccccataggctcaaatggtcaagagacttccattcttctctccctctgtctctccttctttctctctttctctgtgtatctctcttcttttttttttttgagacggagtctcgctctgtcgcccaggctggagtgcagtggcacgatcttggctctccgtaacctccacccccagggttcaagtgattctcctgcctcagcctcccgagtagctggattactggcacataccaccacgcccggctaattttttatttttaatagagacagggtttctccatgttggtcaggctggtctcgaactcccaacctcgggtgatccacccagctgggactcccaaagtgttgggattacaggcgtgagccacctcgcccggctctattatattttttgagacgaggtctcactctgctgcccaggctggtgtgcagtggagcagtcacaggtcactgcagccttgacctcctaggctcaagctgtcctcccacctcagcctcccgagtagctggaagtacaggcatgcatcatgcatcaccatgcccagctaattttttaagaagttttttctgagaccgggcacggtggctcacacctgtaatcccagcactttgggaggccaaagcgggcagatctcgaggtcaggagttcgagaccagcctaagccacgtggtgaaaccccgcctctactaaaaatacaaaaattagtccggcgtagtggtgcacgcctctaattctagctactcaggaggctgagagaggacatcacttgaacctgggaggcgaaggttgcagtgagcagagatcgcgccactgcactccagcctgggcaacacagcaagactccgtctcagaaaaaaaaaaaaaagttttttgtggagataggagtccccctctgtcacccaggctggagtgcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagtgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtagcagcatttggctggagggcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgcactcaagcgatcctcctgcctcagcctcccgagtatttgggagtaccagcatttggctggagggcagtgttgccatcatagttcactgcagccttgacctcctgcgctcaagcgatcctcctgcctcagcctcccgagtatttgggagtaccagcatttgttatcatgccctgttagggttttttaaattttgtagagatgggatcttgcgatgttgcccaggctacccttcctgggctcaagcgatcctcctgcctcagcctcccaaaatgctggggttaaagacatgagccactgcacccggcctctgtctctctttctctctcttctccctcttcctctctgtctcctcctctctgtgtctttttaggtatctcatctatcatcatcaatctctgtttctcttctctcctccttcctcctttatcttctctgtctcttcctccctctctccaccctgtctctgtctctctttatacatctatcatccttttttaaaaaaaataaaatagagacagggtctcactatgttgctcaggttggtttcaaactcctgggctcaaaccatcctcccacctctgcctcccaaagtgctgcgattacaggtgtgagccactgcgtctggccttctaacaatgctccgtcacctgtcatctgtctatcatttattatctatccatccatccatcatctacctacccatcatctaccatatattcacccatccatccatctcatccatgcatccatctatccatctattcatctatctacctatcatctaccatctattcacccatccatccatctcatgaatgcatccatctatatccatccattcatctacctacctgcccatcacctaccatcaatacacccatccatctcatccatctatccatccattcatctacctgcccatcatgtaccatctattcagccatccatccatctcatccatgcatccatctatccatccatccatctacctacctacccatcatctaccatctattcacccagccatccatctcatccatgcatccatctatatacatccattcatctatctacctacccatcatctaccatcagttcacccatccatccatccatctacccatcatctaccatcagttcacccatccatctcatccatgcatgcatccatccatccatccatctacctacccatcatctaccatctattcacccatccatccaatccatgcatctatccatccattcatctacctacccatcatctactatctattcacccatccatctcatccatgcatccatctattcatctatctatgtacccatcatctaccatctattcacccatccatccatctgttccatgcacccatctatccatccattcatctacctacccatcatctattatctattcacccatccatccatctcatgcatgcatccatgtatctatccattcatctacctacctacccatcatctaccatctattcactaatccatccatctcatgcatgcatccatctatccatccattcatctacctacttaaccatcatctactatctattcacccatccatccatcacatccatgcatccatctacctacctacctatctattcacccatacatccatctcatccatgccatctatccatccatccatccacctacctacccatcatctaccatctattcaagcatccatcacatccatacatccatctatccatccactcatctatctacgtacccatcatctaccatctattcacccatccctccatccatctcatccatgcatccatctatccatccattcatctacctacctacccatcatctaccatctattcacctatccatccatctcatccatgaatccatccatccatctacctacctacccatcatctaccatctattcacccaaccatccatctcatccatgcacccatctattcatcttcctacctacccatcatctaccatctattcacccatccatccatctcatccatccattcatctatctacccatcatctaccatctattcagccatccatccatctcatccatgcatccatctatacatccatctacctacctacctacccatttattcacccatccatccatctcatccatgcctccatctatccatccacctacctacccatcgtctaccatctattcacccatccatcacatccatacatccatctatccatccattcatctatctacgtacccatcatctaccatctactcatccattcatccatccatccactcatctacctacccatcatctaccatctattcacccatccatctcatccatgcatccatctatccatccatccatctacctatgtacccatcagctaccatctattcacccaaccatccatctcatccatgcatccatctattcatcttcctacctacccatcatctaccatctattcacccatccatccatctcatccatacatccatatatccatccattcatctatctacctgcccatcatgtaccatctattcacccatccatccatctcatccatgcatccatctatccatccattcatctatctacctacccatcatctaccatctattcacccatccatccatctcatgcatgcatccatctatccatccatccgtctacctacctacccatcatctatacacccatccatctcatgcatgcatccatctatctatccactcatctacctacctaaccatcatctactatctattcacccatccatccatcacatccatgcatccatctatacatccatctatctacctacctacctattcacccatccatccatctcatccatgcctccatctatccatccacctaacgatccatcatctaccatctattcacccatccatcacatccatctatccatccactcatctatctacgtacccatcatctaccatctgttcacccatccatccatctatccatccattcatctatctacgtacccatcatctaccatctattcacccaaccatccatctcatccatgcacccatctattcatctacctacctacgcataatctaccatctgttcactcatccatccatctcatccatgcatccatctatccatccattcatctatctacgtacccatcatctaccatctattcatccattcatccatctatccatccactcatctacctacccatcatctaccatctattcacccatccatccctctcatccatgcatccatctatccatccatacatctacctacgtacccatcagctaccatctattcacccaaccatccatctcatccatgcatccaactattcatcttcctacctatccatcagctaccatctattcacccatccatccatctcatccatacatccatatatccatccattcatctatctacctgtccatcatgtaccatctattcacccatccatccatctcatccatgcatccatctgtccatccattcatctacctacccatcatctaccatctattcacccatccatccatctcatccatgcatccatctatccgtccattcgtctacctacctacccatcatctatcatctatacacccatccatccatctcatgcatgcatccatctatccatccattcatctacctacttacctaaccatcatctactatctattcacccatccatccatccatctatacatccatctatctacctacctacccatctattcacccatccatccatctcatccatgcctgcatccatccatccatccatccacctacctacccatcatctaccatctattcacccatccatctcatccatgcattcatctatccatccattcatctatctatgtacccatgatctaccatctattcacccatccatccatccatctcatccatgcatccatctatccatccattcatctacctacctacccatcatctaccatctattcacccatccatctcatccatgcatccatctatccatccatctacctacgtacccatcatctaccatctattcacccaaccatccatctcatccatgcacccatctattcatcttcctacctacccatcatgtaccatctattcacccatccatccatctcgtccatgcatccatctatccatccgtctacctgcccatcatgtaccatctattcacccatccatccatcacatccatgcatccatctgtccatccactcatctacctacctacccatcatctaccatctattcacccatccatccatctcatacatgcatccatctatccatccatccatgtacctccccatcacttaccatctgttcatccatccatccttctcatccatgcgtccacctatccatacatctttctacctacctacccacccatcatctaccatctgttcatccatgcatccaggagaaccggaaaaggcccaggtgatgcatccatctatccatccatctttcgatcaaatctccttctccctgtctgtccgccctgcatcaagtctctgtctctctcccctcccctacctgtgtgggccccctggccaagggttctcagcagcctctgctcaccgttctgagctcctgttgcctgctgtgtcccctgtgtcctgctgaaggatccccgcctggctggccaggactccagctctctgctgtctccctcaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatag

SEQ ID NO: 38782 - DNA, 49791 bp, Homo sapiens
ctggccgcctgttttttttgcagccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcggtacggcctgggcctgggcggggcaggggaccggggacggaggggctgaaccccggagggcccagcgactcaggaactctagggatagggatgggagagtgacccgagacccttagggatgggggaggggagagtgtcccgggacctccagggatagggttggggagagtgacccggaacctctagggatgggggaggggagagtaacccggaaccccctaggcatgggggtggggagtgacctgggtccccatagggatgggggaggggatcgtaacccgggacccctaggaatggggagggtagagtgacccaggaccgctagggatggggacagcagagtgaccccggagccccatggatggggatgaggagagtaacccgggacccccaggcatggggatggggagagtaacccgggacctccagggttggggatggggagagtaagccgagaccccccctagggatgggggtgggggagtaacccgggacccctagggatgggggagaggagagtaacccgggacccccaggcatggggatggggagagtaagccgagacccccaggaatggggttggggagaataacccgggacccctagggatggggttggggagagtgacccaggaccccctagggatgggggaggggagagtaacccgggacccccctaggggtgggggaggggagagaaacccgggacaccttagggatggggttggagagagtaacctgtaacctgggaccccctagcgatgggggtggggagagtaacccaggacgccctaggcatgtggttggggagagtgacccgggaccccctagggatggggagggaggagtgacccaggaccgctagggatggggacagcagagtgaccccggagccccatggatggggatggggagagtaacccgggacccccaggcatggggatggggagagtaacccgggacctccagggttggggatagggagagtaagccgagacccccctagggatgggggtggggagagtaacccgggacccctagggatgggggagaggagagtaacccgggacccctaggaatggggaggtcaagtgacccgggacccccctagggatgggggtggggagagtgacccgaaacccctaggcatggggttgcagggagtgacccagaaccccctaggaatggggatgggagagtaacctgggaccccctagggatgggggaggggagagtaagccgggatccccctagggatgggggtagggagagtaacccgggacccaaaaggatgagggaggggagagtgacctggaacccctaggcatggggttggggagagtgacccaggaccccctagggatgggggagggaagggtgacccgggacccccaaggaatggggaggggagagtgacccaggaccacctagggatggggaaggggagagtaacccaggaccccctagggatgggggtggggagagtaacccaggacgccctaggcatggggttggggagagtgacctgggacccccttagggatggggagggaggagtgtcccaggaccccctagggatggggagggaggagtgtcccaggaccccctaggaatggggaggggagagtgatccaggaccgcctagggatgggggaggggagagtgatccggaatccctaggtatgggggaggggagagtgacccaggaccccctaggaatggagaaagcagagtgacccgggacccctagggatgggggaggggagaataacccaggacccctagggatgggggaggggagagtgagccaggaccccctaggaatggggagggcagagtgacccgggacccatagggatgggggagggcagagtgacccgggacccctagggatgggggaggggagagtgatccagtaccgcctagggatgtgggtggggaaagtaacctgggacccctagggttgggggaggggagagtaacccgggaaccctagggatgggggaggggagagtaacccagaacccctagggatggggttggggagtgtgacccggaaccccctagggatgggggaggggagagtgacccagaacccctagggatgggggaggggagagtgacccagaacccctagggatgggggaggggagagtgacccagagcccctagggatgggggaggggagagtgacccaggatgccctagtgatgggggaggggagtgtgatccaggacctcctagggataagggaggggagagtaatccaagacccctaggaatgggggaggggagagtaacccgggaccccctaggggtgggggaggggagtgacctgggacccctagggattggggaggtgagtgactcaggacttctagggatggagtgggccctgtgactgatggttggactttgtagctggggtatgggaagtgtttcctggtgcccccatgaggatcttattccgggtggtaggacgcctaggtagtgggtgtctgcctctctctggagccctaatcacatggaggagacggtctagtgatgaagggatagttacttgtgatggggggtagttactggtgacaggcggatagttataggtgatgtgggatagttactggtaatggggtgatagttactggtgatgggatagttactggtgatgggggcatagttactggtgatggaaggatagttactggtgatgggggatagttactggtgatgggagatagttactggtgatggggcgtagttaccggtgatgagggatagttactggtgatgatggggcatatttactggtggtgggggttagttactggtgatggtgggatagttactgggtttgatgatggggcatagttattggtgatgggggtagttactggtgatgtggggatagttactggtgatgggaggatagttactgttgatgggagatagttactggtgatggggggatagttactggtgatgatggggcatagttactggtgatgggggatagttactggtgatggtggatagttactggtgatggggggtagttactgggtttgatgatggggcatagttactggtgatggggggtagttactggtgatgtgaggtagttactggtgatggcagagaagttactggtgatggtagggtagttactggttgcctatggatggtgcagtggggcaggagtctactcttggggactacggactggaggtctggtaccctgggaggggggacaccacatgcctggtcctagtgacggggatgagagtggtcagggtgcctcacagaaggcatgggtctccatgattgggggtgacagggcatagggcaggggtctatatgatctggggttgagatctgcagggcaggtccagggcttggtgactggtgccctgaagaccaggatgggcgtcagggccaggatctgggggcaccttcaagaggtgaggagcgctgaggagtgtagaagagtggaagaaagacgaaaaaagaaaagcagcttcacagtcaaagacgggtttattttggagaacaagcctgagcggggcttctggctgagttaggtcaggagtgttctctcttacagactaagggtatttaagggtttaggaaggggaatcttatcgcaggctcggaatgtttccctgtgaggcaaagttgactgaggtgttagaatgtctctggtctgaaggaggttatcttgggcttgggatgtttctggtcagaggcggtttatttcaggctttgactgtttctggtcatgctgacattagccattaggctgatgttttggggctggttttaggcagtttttaatcacgggaacttaaaatggcaatgcttgtccaagatggcggtgtgtgtccaagatggtggtgtgtgtcaaagatgaccatgcatgtccaagatggcagtgcttgtccaagatggtggtgcttatccaagatggcggtgtgtgtccaagatggtggtgcttatccaagatggtggtgtgtgtcccagatggtgtgtgtccaagatggtggtgcttctccaagatggcagtgtgtgtccaagatggtgtgtctccaagatggtggtgcttatccaagatggcggtgtgtgtccaagatggtggtgcttatccaagatggccgtgtgtgtccaagatggtgtgtgtccaagatggtggtgcttatccaagatggcagtgtgtgtccaagatggcggcatgtgtccaagatggtggtgcttatccaagatggcagtgtgtgtccaagatgttgtgtgtccaagatggtggtgcttttccaagatggtggtgtgtatccaagatggtggcgtgtccaagatggcggtgtgtccaagatggtggtgcttgtccaagatggtgttatgggtccaagatggcagtgtgtgtcccagatggtgtgtgtccaagatggtggtgcttatccaagatggcggtgtgtgtccaagatgttgtgtgtccaagatggtggtgcttatccaagatggcagtgtgtgtccaagatggtgtgtgtccaagatggtggtgcttatccaagatggcggtgtgtgtccaagatggtggtgcttatccaagatggcggtgtgtgtccaagatggtgtgtgtccaagatggtggtgcttatccaagatggctgtgtgtgtccaagatggtgtgtgtccaagatggtggttcttatccaagatggcggtgtgtgtccaagatggtgtgtgtccaagatggtggttcttatccaagatggcggtgtgtgtccaagatggtggtgcttttccaagatggtgttgtgtatccaagatggcggtgtgtccaagatggcggtgcttgtccaagatggtgttatgggtccaagatggcagtgtgtgtcccagatggtgtgtgtccaagatggtagtgcttatccaagatagctgtgtgtgtccaagatggtggtgcttatccaagatggcggtgtgtgtccaagatggtggtgtgtgtcaaagatggccatgcatgtccaagatggcagtgcttgtccaagatggtgtgtgtccaagatggtggtgcttctccaagatggcggtgtgtgtccaagatggtgtgtctccaagatggtggtgcttatccaagatggcggtgtgtgtccaagatggtgtgtctccaagatggtggtgcttatccaagatggccgtgtgtgtccaagatggtgtgtgtccaagatggtggtgcttctcccagatggcggtgtgtgtccaagatggtggtgcttctccaacatggccgtgtgtgtccaagatggtgtgtgtccaagatggtggtgcttatccaagatggcagtgtgtgtccaagatggtggtgcttctccaagatggccatgtgtgtccaagatgttgtgtgtccaagatggtggtgcttatccaagatggcggtgtgtgtccaagatggtgtaatgggtccaagatggcagtgtgtgtcgaagatggcaatgctcctgctctgtgaatccagaccctctagttataacaggacgaggggtggtgtgttctttctggccacttcctgctgagggaggtggttattacgggtcaccaaacacagccctggaggggaagaggttgatttgttcctggtagcactctttaggggccttccaagcagcacccgttgaaacatctagcttttagttcacagggctttaagaaagcagaacttgggtttcagaggttttcagttaggaaaaattggagaaaaagaaaaaggaaaagaatgcaaaacattatcttggagacatgtagccagaaaaattagaatttaattcaaaccgtagaaaagaataaaaactgaaaaccattaggcaagactagaatttcacgacaggggtaactatagtttttcaaacacgatttttctttttccagttttcccacttttattaaaagacaaattatgggctgggcatggtggctcatgcctgtaatcccagcagtttgggaggccgaggttggcggatcacgaggtcaggagatcgagaccatcctggctaacatggtgaaaccccgtctctactaaaattacaaaaaattagccgggcgtggtggcgggcgcctgcagtcccagctacttgggaggctgaggcaggagaatcgcttgaacctgggaggcagaggttgcagtgaaccgagatggcaccactgcactccagcctgggcgacagagcaagactccgtctcaaaaaaaaaaaaaaaaatgtcatgagatgtagggaccagccccacagggtcagtggatctctccctgtgtgcggaggcatgagagtgtagaaataaagacacaagacaaagagataaaagaaaaggcagctgggcccgggggaccactaccaccaagacgcggagactggtggtggtcccgaatgccaggctgcgctgatatttattggatacaagacaaaggagcagggtaaggagtgtgagccatctccaatgataggtaaggtcacgtgagtcacgtgtccactggacagggggcccttccctgcctggccgccgaggcagagagagagaggagaaggagagaaacagcttacgccattatttctgcttatcagacacttttagtactttcactaatttgctcctgctaactaaaggcagagccaggtgtacaggatggaacatgaaggcggactaggagcgtgtgaccactgaagcaaagcaccacagggagagggttaggcctccggataactgcgggcgggtctgactgatgtcaggtcctccacaggaggtggaggagcagagtcttctctaaacccccccagggaaagggagactccctttggtgaccccgtctgggcataacagaaggctcgcgctcgtcttctggtcgcacctcaccatgtcccctcagctcctatctctgtatggcctggcttttcctacattatgattctagagcaaggattattataagattggtataaagagtaattactaccaactaatgattaatgatattcatatataaccatatctaagatctatatctggtataactttctcgttttatattttatcatataccggaagagctcgtgtcctcggtctcttgcctcagcacctgggtgtcttgccgcccacaatgagaggtgcaacttgacatagggagggtagaagatagcctgagtatagggaacctcttgccatttcctggtgataaagttgtcaaggtccctgagaatttgcaagttaaaggtgctatgttcgggccatctgctgtcattatgtagtttgtattgatgccagactattgcaataaaaaattcaacactctggctttaggttcctctgtaagccaagtttggccaggttggaaaggagacatcccagagaggaggacataggaatgtcgggttgtttggcacccacgtgggctggtaaaaggaagccgagagtgtctgtttgtgttttaggcaaccccagacaaaagacagagacccagaatcctctttataaggaggacggccaagctgagaagatactgggcatccctcaagatcgcttctagcttagtgccgctggtcctccgaggactgggatggccgacctgacttttcctgggtaccaaaagtcagaggagggcagatcttaccagacggctggatttgtgtctgatgttggatgttcctgttggaattggcaaaggggctcccaaactggagccgcgcagggaagacagagagagagagagaagagggaagaagacggacgaagagagaggaagacgaagcaagggttagggagcgaaatacctgttgcagggggtcagaggtggatttctgagacctgagggttttgagaaccctccagcttgagcctctaagtcccctttacatgagttgtcttcctcacacaaattgcttggaaggtgaatggagagaaaagatgggaggggtggccagagaccctcacgatccaggagttagcccaggatgagctgctgctgcccacagcttcctgggttgcaagagaacctccactcccaacactcaaagagggagagagagaaaggacagggtcagagggccagaggctctaaaggatccaggagttagcccgggacaggctgcccctgcccactgcatcctgggttgcaaaagggcctctgtccgtaacacctgtcctgggtttcggcaccaaatgtaagagtttaagaaggaggaaacaaatatagaaagtgagcctgggcgcagaggctcacatctgtaatcccagcactttgggaggccgaggcgggcggatcacctgaggtcaggagttcgacaccagcctgaccaacatggtgaaaccccatctctattaaaaatacaaaaattagccgggtgtggtggcgcccacctgcaatcccagctactcgggagactgaggcaggagaatcgcttgatcctgggagatggagcttgcagtgagccgagatggcatcactgcccctccagcctgggcgacacagcgagactccgtttcaaaaaaaaaaaaaaaaatacaaaaagtggctcagcaaagggttttggaaaagggggcttctcgcaggctcggaatgtttctgtgtgagggaaaattgattgcggggttggactgtctctggtcggaggggaggtttctggtcacagaggggtttatcccacggctggaatgtttctggtcatgctgacattagccattaggctgatgtttgggggctggatttaggcagtttttaatcaagggaacttaaaatggaagtgtgtgtccaacatggcagtgtctgtccaagacgggggtgtctgtccaagatggcggtgtgtgtccatgatgggggtgtctgtccacgacggcggtgtctgtccacgatggtggtgtgtgtcctcgatggccaaaatggcggtgtgtgtccacgatggtgtctgtccacgatgggggtgtgtgtccacgatggccaagatggcagtgtgtgtccacgatgatgtctgtccacgatgggggtgtgtgtccacgatggccaagatggcagtgtgtgtccacgatggcggtgtgtgtccatgatggcggtgtgtgtccatgatggcggtgtctgtccacgatggcggtgtctgtccacgatggcggtgtctgtccaagatggcggtgtgtgtccatgatggcggtgtgtgtccaagatggaggtgtctgtccaagatggcggtgtgtgtccacaatgacactgtgtccatgatggccaagatggcggcatgtgtccacgatggtggtgtgtgtccaagatggcggtgtctgtccaagatggcggtgtgtgtccaagatggcggcgtgtgtccaagatggcggcgtgtgtccatgatggtggtgtgtgtccaagatggcggtgtctgtccaagatggcggtgtgtgtccaagatggcggtgtgtgtccaagatggcggtgtgtgtccatgatggcggtgtgtgtccaagacggcggcgtgtgtccacgacggcggtgtgtgtgcacgacgacggtgtgtgtcccagatggcagtgtgtgtccacgatggcggtgtgtgtccacgatggcggtgtgtgtccaagatggcggcgtgtgtccacgacggcggtgtgtgtccacgacgacggtgtgtgtcccagatggcagtgtgtgtccacgacgacggtgtgtgtccacgatggtggtatgcgtccaagatggtggtgtctctccaagatggcggtgtgtgtccaagatggcgatgcttttgctctgtcagaggggagatggtcagaggggagatgcggagttccctgcaccctggcagggtgtggcagccaggggctcccccactggaggcatttaccaccatcattcctgaccccacggtctctgcaggggtcactacctctaggccaggcctccccaggggcggtgttgtctcttcctgggtaccagggattgacgtagagccatcattgtctcccttcccacagccatcattgctggcgtttttcctgaatttcctgtgggcaggttgggttttgtactctgccccaaccttcaggtctctgggaatcctcggacactgttggctcgtgggttcaaggcccgagtcaatacctccctgctggcctctttgttcctggcttcttcctttgccaatctcttccctcgagagccaagaaggcccctggtcagtccctgaaggcccctggtcagtccgcggcccactaaccacacttagggaaagccctggtcagtccccggctccccagccacacttagggaaagcttggcggatggatgagctcacctgggacagggtcggggagtgtagcaaacgctatgtgcgtcctgcaaatcttgcatgtcccattcacttttcatagggtctttcattgacccttctgaccccttttctactgttgcagggtctcaggtttgaggtggtcccctccaagtttaaagagaagctggacaaagcctccttcgctactccgtatgggtacgccatggagaccgccaagcagaaggccctggaggtggccaaccggctgtaccaggcaaggggcccctgcccttcggcccttatgaaaattcctttgctgtgatgaggggatttgcgggtggtaaatatacatgacacaaataaacgtcattcaaaagatgcagttggtggcacagcttagctattgctatgttataatgtaatgcactattgcagtaacctaataataccattaatgatacagaattaatggagcttatctgttactgtgtgttataatattctcttgcaattgatacagtatcattgatgatatacaattaatgtagcttatctgttactatgtgttataataatttctcgcaattgatacagtatcatttatgatatacaattaatgtagcttatctattactatgtgttataatatcctcttgcaattgatatcatagtatcattgatgatacagaattaatgtagcttatctattactatgtgttataatattgtcacaattgatatcacagtatcatttatgatatagaattaatgtagattatctgttactatgtgttataatattctcttgcaattgatttcatagtatcatttatgatatagaattaatgtagcttatctattactatgtattataatctcttgtggccggtcgcggtggctcatacctataatcctagcactttgggaggccaaggcggacagatcacctgaggtcaggaattcgagaccagcctgaccaacagggtgaaaccccgtctctactaaacatacaaaaattagctgggcgtggtggcgggtgcctgtaatcccagctactcaggaggctgaggcaggagaattgcgtgaacctgggagacggaagttgcagtgagccgagatcatcccactgcactccaacttaggcaacagagcaagacttcgtctccaaaaaataaaaaattaaaacaaaaattatcttgcaatcaatataatagtctcgttgatgatatacaattaatgtagcttatctattactatgtgttataatattctcttgcaattaatataatagtatcatttatgatatagaattatgtagcttattaccatgccactaagtaatatcggattttaattaaaataatatcatttataatatagaattatgcagtttatctgttgctgtatgctacaatgcaatatacaattataattaatatactactatcatttaagatttaagattcatgtagcttgttactatgtttgaatataatattgcaattaatatagtaatatcagttacgatatagaattaacatccattactatgtgttgtgatacatagaattaatatgttactgtgtgatactatgtaatatactatgacaattaatataattgtatcataatgtagaattatgtcatttatctgttactatatgctcctatgtaatacatattattttagtagagatggggcttcaccatgttggccaggctggtctccaactcctgacctcaggtgatccacccgcctcggcctcccggagtgttgggattacaggcgtgagccaccgcaccccaccgtaatacactattataattaatacactactgtcatttaggatgtacaattaatgtagcttatcaattactatatgttatatatgactctaacataatgtcagtcacagtatataaaattaacatagctattactgtgtgttttaacttgctgttacaatgaatataatgctatcatttaggatatagagttaatgtagcttccctgctgctgtgtgttaccacacaatataccattactgttaatataagaaatacattcggggccgggtgcagtggctcacacctgtcatcccagcactttgggaggccgaggcgggcggatcacgaggtcaggagttcaagaccatcctggctcacacggtgaaaccccgtctgtactaaaaacacacacaaaatattggctgggcgcggtggcgggcgcctgtagtcccagctactcgggaggctgaggcgggagaatggcgtgaacccgggaggcggagcttgcagtgagccgaggtcgcgccactgccctccagcctgggcgacagagcgagactccatctcaaaaaaaaaaaaaaagaaagaaagaaatacattagaggtaaggctgttgtgagtcgtgctatcaagacaggagtattgattgtgggttttggcagtgcacagcttagggaggccagtgcggggctgagctaaggtcaaagctgcacacagatgtcctgtgactgcctgttgctctgaggctgaattttcaacctggatttgttttatcgtcctaagtacctttttctttttctttcttttccttgtttttttttttctttttttttttggagactgagtctcactctgtcacccaggctggagtgcaggtgcgcaaccttggctcactgcaacctccgcctcctaggttcaagcgattctgctgcctcagcctcctgagtagctgagattacaggtgcccgactgatattttgtatttttagtagagacggggtttcaccatgttggccaggctggtctcgaactcctgacctcaggagatgcgcccgcctcggcctcccagagtgctgggatgacaggcgtgagccaccgcgcccagccctaagtagctttttctgaaattacattgaacggatcaaaaaccttttggccttaattctgggtaactcagggaggtttggggcccctgaatcaaaccttacctgccgcccggaagaacaaaagcttacggaacaggcattgcgtttcccgtagtgcccgtgagatgctccgtgagtgcctgacccctgatcacgcagcccccgtgggccccggcctcacccacgttccagcccctgcagggcgaccaccggcgggacccacttgtgtccttgctcgtgaccttgagcacccccagccttcacttccaaagtcggcctggcttcgcccctgcggtgctctttcacgcccgtaccgacgggaaaacttctctgtgagacccacggcacgtcaccggtaaaccggaatctggttttcttacagaaagacctgcgggcccccgacgtggtcattggagcggacacgatcgtggtgagtgcggccagggtgcctcgtttctaatgtccgatgtggttttcctgtgcttggtgattctgcctcttgtggatgttgtacattccccttaagacagcagtggactcgcttccagaaactcccatcacaaactaccagcagatgaggggcctaagggcacgggaaggggccaggcgccgtggctcacccctgtcatcccagcattttgggaggccgaggtgggcggatcaccttaggtcatgggttcgagatcagcccgaccaacacggtaaaaccccatctctactaaaaatacaaaaattagccagacgtggtggctaattgatagtatcataagtgatactatatgatatcaattgcaagagaatattataacacatagtaacagataagctacattaattctatatcatcaatgatacagaatacagactccgcctgtaatcgcagctactcgggaggctgaggcaggggaatcgctcgaacccaggaggcggggttgcagtgagccgagatcgcgccactgcactccagcctgggtgacaagagcgagactccgtctcaaaaggcacaggaaggtacgcagttctagaggccagcaaccacaaatcacggtgtctgtagggtttcttccttccagaggtactgaggagaagttggtcttggtctttctccagctcctagaggctgttggcaacccattgtctcctttggctcatggccctgtggttcctatctgtgcctccatctccatgtggccttctcccctctgggtgtctgtggccaaatttccctcttcttttttttttttgagagagagtctcactgtgttgcccaggctggattacagtggcgtgatctcggctcaccgggacctccgcctcccgggttcaagcgattctcctgcctcctgagtagctgggatcacaggcacccgccaccacgcccggctgatttttgtatttttagtagagacggggtttcaccatgttggccaggctggtctcaaactcccgacctcaagtgatctgcccaccttagcctcccacagtgctgggatgacaggcgtgagccaccgcgcccggctgaaattttccccttcttttaacaacaccactcataaaatgcgcatcctaattctgtccaaccgcatcttaattacctaggcaaagacccatttctccttttttttttttttgagatggagtctcactctgtcgccaggctggactgtagtggcatgatctcagctcattgcaacctccgcctcccgggtttcaatgattctcctgcctcagcctcccgagtagcggggactacaggtgcgcgcgaccacgtgtggctaattttttgtatttttagtagagacggggtttcaccatgttggccaggatggtctcgatctcctgaccttgtgatccacccgcctcggcatcccaaagtgctaggattacaggcgtgagccaccacgcccggcccatgtcttttgttcataagccacccagtctatggtattctgtgatagcagcctgaaatggactaagacatctcataagaagaggagatgaggacacagacacacacagagggacgaccctgtgaggacacagggggaagacggcgtctccaagcccaggagagaggcctcaggaggaaccagccctgcccacacctggatctcagacttccagactccaggattatggaagaatcaatgtctgctgtttataagccacccagtctatagtattgttttagcagcctgaaatggactaagacacctcataagaagagcagataaggacacagacacacacagagggatgaccctgtgaggacacagggagaagacggcgtctacaagcctaggagagaggcctcaggaggaaccagccctgcccacacctggatctcagacctccagcctccagggctgtgggagaatcactgcctgttgtttataagccacccagtctgtggtattctgtgacagcagcctgagatggactaaagcatctcataagaagaggagatgaggacacagatacagagggacgagtctgtgaggacacagggagaagatggcatctccaagcccaggagagaggcttcaggaggaaccagccctgcccacacctggatctcgcccttccagtctccacgacgatgggagaatcaatgtctgtagtttaagccacctgggttgtaggactttgctatggtggcccagtcagactaatacatctactcttgtatgtacccaaaaggattcaaaacaggtgttccaccaaaaccttctacatgaatgttcacagcagcactattcacaacagctaaaaggcagaaacagctcaagtgtctgtcagtgggtaaatgggaaattacaacatggtccatccacacacagtggaatattatgcagccatgaacaggaatgaggctggccgggtgcggtggctcacccctgtcatcccagcactttgggaggccgaggcgggtggatcacaaggtcaggagatcgagaccatcctggccaacatggtgaaaccccgtctctactaaaaatacaaaaaattagccgggtgtggtggcgggcgcctgtagtcccagctactcgggaggctgaggcaggagaatggcgtgaacccgggaggcggagcttgcagtgagccgagatcgcgccactgcactccagcctgggtgatagagcgagactctgtctcaaaaaataaataaataaaaaataacaaaaattagccaggcatggtggtgtgcacctgtattcccagcaactcgggaggctgaggcaggagaatcacttgaaccccggaggcggaggttgcagtgagccaagaccgtgccactgcactccagcctgggcgacagagtgagactccatctcaagaaaaggaaaggaacgaggctgtgaaacaggctgcaacatggatgaatgttgaggacatcacggtcagtgacagaaaccagccccggaggaccacacgttgcaggattccatgactacaccacgtccgcaacaggcaaacgcacggtgaaagaaagaggatgggcggttaccaggatctggggaggcgcactggggagggacagctgcgtggggacagggtctccttctggagtgaagagaacatcctggaaccaggcaggtagtggtggtacaacatggcaactctggttagttgtttgaaatggcgactctcaggacgtgtcagcttcatttccataaaacaagtgacttctgcgaatgggaccgtgggacttgcacaggcctgacccagccggtgggaaccaactccctctgtcccttcctctcacagacagtcggggggctgattctggagaagccggtggacaagcaggacgcctacaggatgctgtcccggtaagcaccatgttggcctctgagccctctcgggttctgagccacagagtagctgtggtatctggccgggtgtcctggggagcagggtggatctctgtcagctctgccgtctgagctgtgctgtctgagctgtgctgtctgagctatgcagggaggcaggcactatccctccatgctcatccttgtctaggattctgcagcactgatcccagaatgtctcatgcccactgcagactgttggggtcatgagaagttggcagtgtcctgtccttcccactgggcatcctggacctgagcccgtagcctgggacgtcatccccatcccaggacgtggaagagatgcaccccctgcccgccataggcccagctgagagctgcctggcctggcgcctcccgtcagggccactgctggtgggatttgtgaccccttccctcggcctctccgtaaaggtttccctggagaccccacagcgggacgatcggggagaagatgctggggacggatccaggattaaggacgcctcgctgcctcccctggttttgagaaactcgctttgtagctcccacgggtcacagcatggtcacgtggtcacccgttgttgtcttacaggttgagtgggagagaacacagcgtgttcacaggtgtcgcgatcgtccactgctccagcaaaggtaaccgcggcccaggtttcggggtagccccagaggccgagacaaggacccgggacattctcgggacccttggcttgagggaggaggacggttgctcacccccacctgtggaggggtttgtgcctatgtcctgcttgggaaagttgtccgccgatttggaagtctgcaggacaaaggaaaacgtgtggttttatctttttctttttctttcttttttttttttttttgagatggagtctcgctctcttacccaggctggagggcagtggcacgatctcagctcactgcaacctccgcctcccaagttcaagtgatccttctgcctcagtagctgggattacaggtgcccaccaccatgcccggctaatttttgtatttttagtagagacggggtttcaccatgttggccaggctggtctcgaactcctgacctcaggtgatccacccgcctcagcctcccaaagtgctgggattacaggtgtgagctactgcacccggcctttctctttctttctttcttttttttttttttgagacagggtctccctctgtcacccaggctggagtgcagtggtgtgatcatagctcactgcagcctcgacctcctgagctccagcgatcctcccgcctcagcccctacagtcacagaaactacaggcacacgccaccacacctggctcatttttgtattttttatagaggtgcggtcttgctatgttgcccagactggtctcgaactcctgggctgaagaaatcctcccatctcagcctcccaaagtgctgggactgcaggtgttcaccatattgctgggactgcaggtgtgcaccacggtgcccggcccaggcagttgtatcaccatattgctgggttcttcctgcaccaacccattcccagcttgttggcggacaccaggaggcatcgtagaattcagtcagttctgacagtagccgtcggagttagcgcagatcccacaggtgaagggccgggtcccatgggacctccacgcacaatcccagccccatatccctggtcacacctgtagttttctcacccacctgccgctcactgctggctcctgcaagcacctgctcaggttgggtcatttgctcgaggggctcacagaactcgggacagcactttccttcccagcttggggttttgttatgaaggagcaggtcaggaagtgccagacagaagccaggcacagcgcagggtgctgggtgcaggatgtatggagcctccatgcccgccgtggcacagctctgccaacaccctgatgtgttcacccaccagaagctccctgaaccctgtccttctgggtctcttttttttttcttttttgtgacagagtctcgctttatcgcccaggctagagtgcacttgcgccatctcggctcactgcaagctccgcctcccgggttcacgcccttctcctgcctcagcctcccgagtagctgggacgacgggcccgccaccacgcccggctaattttttctattttttttttttttttttttttagtagagacggggtttcaccgtggtagccaggagggtctcgatctcctgaccttgtgatccgcccgcctcggcctcccaaagtgctgggatgacaggcgtgagccaccgcgcgcggtcccttctgggtctcttaaaaggccaggattaacgacatcatccgccactggggagcaaactccatctccagccccctccccctgttcccatgacaaccaaagcctgccctttccaaaaggcccctcattaacataaggtcccctgcggatgaaaggggcttgtcaccacatagcaaaacgcctgctttcgctcctgtcactcaacagattccccgggattcaggggctctgtgtccggaccctgaggcacagaccaaacatctgtttcttttattatttatttatttgagacagagtctcgctctgtcgcccaggctgcagtacagtggcgtgatcttggctcactgcaacctccgcctcccgggttcaagcgattctcctgcctcagcctcccgagtagctgggatgacaggtgcatgccaccacgcccggctaatttttgtatttttagtagagacggggtttcgccatgttggccaggctggtctcgaacccctggcctctggtgatccatccgcctcggccgcccaaactgctgtttcttttgttttttttagagacggagtctcgctctgtggcccaggctggaatgcaggggcgcgatctcggctcactgcaacctgcacctcccgggttcaagcgattctcctgcctcagcctcccgagtagctgggactacaggcacctactaccaggcctggctaattttttgtatttttagtagagacggggtttcaccgtgttagccaggatggtctcgaactcctgacctcgtgatccacccgcctcggcctcccaaggtgctgggatgacaggcgtgagccaccgcgcccggcccctttctcccttttcttgtccgaaatgaaccttattctcccatgaagcatccatatctgaactgtgcgctgcgctcgagtacacacctccacagcacagccacgcagctgtcagggcacggaggtgacaagctggcgtccacgctcacccccacggctgtgtccttgcagaccatcagctggacaccagggtctcggaattctacgaggaaacgaaggtgaagttctcggagctgtccgaggagctgctctgggaatacgtccacagcggggagcccatgtgagtctcgggggcggtggggggacgggggacacgtgtggaagcctggccaccctcacacgtggggtgtcccacccagcctttgggaaagaaggaggccccgctccgggggccgtgtggcacagggagagccgcccggctcagaagcacaaacccttcacgaccacactgacccatggaggctcaaagaggcaaactcccaggacagagaggggcagggtgggagccaacgctgggctgcggtggggactggggaggcgctgggcaggggtagaggagttcacgtggtgggaggaggagaccccagaggtctgtgcccaggacgctggctgcaattaacacgaataaactctgtgatccaaagtcaccctaagaggtgattctacctgtcgtcccgtccacagattggtgagcacgggaagtatgcgtgcaccaatcagcttcacttcatcacccaccatttgcgtttatatgtattatatttatctacatcatatgtcatataatgtctacataattatacattatataatgtaacatgatatatatttacaattatatataatttatgtattccacattatatattctattaattatatataatctacattatacaaattatataatatatatttataatatattgtattatatactataatagattatactgtaatatgtatactatattacatatagatattataatatagattatatattaacacttttgattgaaatttaatgatttttaatgattaattttaataagtagtgattaatattaatgtaatatataccatctattataatatatactgttataatagattatatgataggttatataactgttaaaatagattatataataggtagttataatcgattataattatatataaattatataatttatatttataattatttataattatatataaaatatataattttatatattttatatatttaattttatttatatataaatatataattacatatatttataattatatataaatataatttataattatatataattaattataaatgatatataattatatataattataaacaattatataaatataaattatatataattatatatataattataaaatgattatatattataaaatataattatatatttatataatatagaaatatatgaatatatggataatatgtaatatgtattaaatatgattaatatatgtaactgcatattaatacatattacataataatataaagtgtgattatatgtaaattatatattaattaaatatatgtaatacatattagttatatataatatataatgtattatgtgttatataaatatataattatataaaatatatttttatattataaaagtatataaatatataaatatatgtatataaatacatttgtataaaatatatgtttattttatatatttatataaataattttatttatttttttgagacacggtctcactctgtcacccaggctggagtgcagtggtacagtcatagctcactgcagcgtcagcctcttgagtcaaaatgatcctctcacctcagccccactagtggctgggtctgcagacgcataccaccacgcctggctaattttttctattttttgtagcaatggggtctcactatgttgcccaggctggtcttgaactcctgggctcaggcgatccttccaccaaagcctcctgagtaggtgggaccacaggacacgcaccaacacacgcggccgattttattgttagtttttgtagagatggagtctgcgtaatatatatgtatattaacctagaggattttacatcaattgaaataagcccggcagaagaagacacataccacaggatctcacttatatggaatataaaacagttgcacttggtcaaaggatacaagatttaaatcagggccaggcatggtggctcacgcctgtcatcccaatactttgggaggccgaggcaggcggatcacctgaggtcagaagttcaagaccagcctggatatggcaaatcccaatctctactaaaaatacaaaaattagcccggtgtggtggcaggtgcctgtaatcccagctacccaggaggctgagacaggagaatcgcttgaacccagcaggtggaggttgcagtgagccgagatcgcgccactgcactccagcctgggcaacagagcgagactccgtcttttaaaaaaaaaaaattaagtgagacgggagaagttcaaggctctttacagcctagtgactgtggtttacaggaacagtgtcttactggaaaattgccagcacactacatctgaagtcttctccccacacacacagaataggtacatgaggtgctcgatgggataattggcttgatttaatgatgtcacatgtatacatatatcaaaacatcccatttaacacatgaaattttttttgagacggagtcttcctccgtcacccaggctggagtgcagtggcgcgatcttggctcactgcaacctccaccttccagtttcaaacgattctcctgcctcagcttcccaagtagctgggactacaggcacccaccgccacgcctggcgaattttttatttttagtagagaaggggttttgccatgttggccaggctggtctcgaactcctgacctcaggtgatctgcctgcctcagcctcccgaagtgctgggagccaccgcgcccagcccaacacctgcactttcatacatactttaatgtttacatacatttaaagaaagacaggccgggcacagtagctcaagccaagacgggaggatcacttcatcccaggagttcgagaccagcctgggcaacagagtgaaaccccatctttataaaaaatgataaaactagctgagtgtgtccctgctacgtgggaggctgagattacagcatcatttgagcccagaattttgagggagcagagaaccaagaatgtaccactgcacttcagcctgagcaaccgagtgagaccctgtcttgaaaaaaaaaaatagataaaataagaaagagaaaagagggccagacgtggtggttcacacctgtaatcccagcactttggggggccgaggcaggcgcatcacctgaggtcaggagttcgagaccatcgtggccaacatggtgaaaccccgtctctactaaatacaaaaattagccgggtgtgttggcaggtgcctgtcatcccagctacccgggaggctgaggcaggagaatcgcttgaacccaggaggcggaggttgcagggagccgagatcgcgccactgcactccagcctgggcgacagagcgagactctgtctttaaaaaataaaaataaaaaataaaaaagtgagacaggaggaagaagttcaaggctctttacagcctgtgactgtggtttataggaacagtgtcttactggtaaattgccagcacactagatctgaagtcttctccccacacacacacacacaattcgtagatgagatgctgaatgggataattggcttgatttaatgatgacgcatgtatacatatgtcaaaacatcccatttaacacatgaaattttatttatttatttatttatttgagacggagtcttcctctgccgcccaggctggagtgcagtggcacgatctcggctcactgcaacctcctcctcctgggttcaagtgattctcctgtctcagcctcctgggtagctgggattacaggcgtgtgccaccacaccacacccggctaatttttgtatttttagtagagatggggtttcaccgtgttggccaggctggtcttgaacttctgacctcaagtaatccacccgtctcggcctcccaaagtgctgggattacagccgtgagccattgcgcccagccttgctgtgaaattgtttttctttttttttttttttttgagatgccaaaggcgcctgcccccacgcctggctaattttttgtattttttttagtagagacagggtttcactgtgttagccaggatggcctcgatctcccgacctcgtgatccacccacctccgcctcccagccgtgaaatgttcagacccaggaacttttctcctccttgtcacctcttaccttcccctgcccacccagggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaaggtacctgtgtctgtctcctcaggccacatttcacaaatgagcctacacactcggcttaaatcaaagggaatttacttctcactgtcctggaggctggcagtctgaggtcaggttgtctcagggccatgctttctccgaaggttctaggagagggtccttcctgcctctcccagctcctgacagctccaggcatccctgggcttgtggccgcatcactccagtctctgccacgtcctccacgtggcctcatccactgtgtctgtgtctcctcctctgtctcttagaaggacacctgtcattggacttggagtccacccttcttcgtgatgatttcctcttgagattcttaattacatctgccaagacccctttttaaaacaaggtcccattcacagattctggggatcaggatatggacagatctttcaggaggaccacagttcagtccactacagatgtatccagttccttctggaggccccaggggagggtccttcctgcctctcccagctcctgggggctccaggcatccctgggcttgtggccgtatcactccagtctctgcctttgtctccacgtggccttctcctctgtgtctgtgtctcttctgtctcttagaaggacacctgtcattggattttgaggtctccctaatccactgactccaactcatctgaagtcccctagcttacttacgtctgcaaagacccttttttctttttctcttttttttgtttttgtttttgtttttgagacagagtctggctctgtcatccaggctggagtgcagtggcatgatctcggctcactgcaacctctgcctcccgggttcaagcgattctcctgcctcagcctcctaactgtggtcctcctgaaagatctgttcatagcctgatccccagaatctgtgaatgggaccttgttttaaaaaggggtcttagcagatgtaattaagaatctcaagaggagatcctgagtagcctcaggagtagcctcctgattacaggcgcccaccaccaagcccggctaatttttgtacttttagtagagacagggtttcgctatgttggccaggatggtctcgaactcctgacctcagctgatccacccgcctcggcctcctaaagtgctgggattacaggcgtgagccagcgcgcccggcctgaggccccatctttcagctgttctgttcaggggcccctcacggtggcagcctagaagggatgcagccctcccaacaccaggggtccctcacagggcgtcctccgggaagcagaggtggggatgtcgggtgcaggagggacgcaggctttgggagacagggagacgggctgatgacacctcctgccattcatcatcaggagagagaacatgcagtgaataaggaataaaggtggttacagcacattccgtctgtgcctctaatttaccaagtggtgattattaaatcaccaccaggtggtttataaacaacagacattgattctcccacagtcctggaggctggaggtccaagatcaacgtgtgggcagggctggttcctcctgaggcctctctcctgggcttggagatgctgtcttctccctgtgtcctcacagggtcgtccctgtgtgtgtgtctgtgtcctcatctccttttcttatagggaccccagtcctattggattagggtccacccaaatgacctcattttacctgaatcacttctttaaaaccctgcctacaaatacagtcacatcctgagggactggggggattaggagttcaacatctgggttttgaactcagtccatatcggcagcatgttgatttttctcccatgggctagtttttctgcatgatattcgttgatgtgctttttccttgtgtacaccttgttttatagctggggacttgatcctataaatccccaccgttctctgtgaaagaaggctcaatggccaagttgtatacttccgacagcgttggcctccatcttttgagtctgtgggagtagaaagtactggacaagggacttaatgagtctctctgcacttgcttttaacagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggtgacaggacccagcgggttttgctctgaggatctttgcaggtggaagtcactgagggaaggtgacctggagcctgggcagagcgaggaaggaggcccacaccttctgtccctctgccctcaggaatgctgcttttcccgaaaggttgagaagcagagggtgaatgacagagagggaacagtggcagccgcgagcacataggagaagcgtgacctccttatgggctctagtctcaaaggggctgtatcagtccatgttctcctgagaaacagaacccaatacggtgtacacagacattgatttagttgcttatttatttttatagacaaataacgtagatggatgggtagacagatacatagatagatgataaatgcatagatacattgatatagattgacgatagagagatgacagatacatagatgatgggtagagttgatatataaatggatggatggatagatggatggatggatggtaggtggatagatgggaggaaggatggatggatggatggatggatggtaggtggatagatggatgggaggagggatggatggatggatggatggacagatggattgatcaatggatggatagatacatggatgggaaggtggatggattggtggatcagtggatgggtggatggatgggtgggtgggtggatggatagatggatggatggagaggtggatggataaatggaagggtgggtagatgggtgggtaagtggatggatgggtggatggatgagtgggtgagtggatagatggatggatgtgtgaatggaaggatgtgtggatggatgggtggatgactggatggataaaggtgggtagatggatggatggatcgatgaatcggtggatgagtgcatagatgggtgggtaagtggatggatgggtggatggataagtgggtgagtggatgggtggctggatggatggatggacggacagatggatggatggatggatgtgtggatggatgggtgagtggatagatgtgtggatagatggatgagtgggcgtgtggatgggtgggcgtgtgaatggatggatgagtggatggatgggtgcacggctgggtggatgattgggagtgtgggtgaatagacggatgggtgggtggacagatggatgggagggtggatgaacagatatatcagtggatcggtggttgggtagctgggtgggggaatggatggatgaatgggtaggtgggtggttggatgggtggatggatgagtgggcatgtggatgagtgcatgaatggatggacgggtgcatggctgggtggatgatggggagggtgggtgaacagatgggtgggtgggtgggtggatggatggatggatgagtgattggatgggtgggggaatgaatggataaatggatgtggatggatggatgcatgcatgggtggatggatcagtggatccatcagtggatgggtggatggatgggtaggtgggtgggtggatggatggatggatggacagatggatggatgagtgattggatgggtgggggaatgaatggataaatggatgtggatgtatggatgcatgcatgggtgcatggatcagtggatccatcagtggatgggtgaatagatggatgggtaggtggatggatggatgagtgggcatgtggatgggtgggcgtgtgaatggatggatgagtggatggatgggtgcatggctgggtggatgattgggagggtgggtgaatagatggatgggtgggtggacggatggatgggaggatggatggatagatgtatcagtggattgctggatgggtagctgggtgggggaatggatggatgagtgggtagatgggtggatcggtggattggatgggtgggggaatgcatagatgagtgatgaatgggtggatcagcagatgggtgggtggatgactagatgggtgggtgagtggataactggatgggtgggtgagtgggtggatggatggatggatgacaatgtgttttctgaattgaacagaactcttcagcatggtgctagaatagagagcacatgaccaagtccttgagtagcctgggaagggcaggacaacagatgacacctgggcagaggtggctgtgcttctgtgattaggagacaaagcatgccctggttgaggctccaaaggctgtgcccttaccacagagacatgtgactatatccttagaggctggaacatagaagccagaacatcttccccagccagagcagttcaggaccattctcccgtattgaaaataatgatgaataggccacgcctgtaatcccagcacttggggaggccaaggcaggcagatcacgagttcaggagatcaagaccatcctggctaacacggtgaaaccccgtctctactaaaaatacaaaaaattagccgggcacggtggcgggtgcctgtagtcccagctactcgggaggctgagggaggacaatggcatgaacccaggagacggagcttgcagtgagctgagatcgtgccactgcactccagcctgggggacagagtgagactccatctcaaaaaaaattaaaaaattaaaagaaagaaaataatgatgaatatggagaaaggcttttcatcaccggcaccatgcaagcttgttccaactccttttgacaacgctttgtgcagttgagtcctaggagcagttccacgtctgcagaggctgctcctgcttcaccataggtctcatcatttattcatgatgaaaataaatgtcatctatctgactatagcaaaccgtacactcagggtcagctcggtgggaaaacagtaacatttcatcattaacatgaacacagggctgtttcttacataggaggaccggagtggtgcgaggccatctgtttccatatacgggtctccaccaacaacttctccaccttccagcctcccattctgtgggagggggcatcctggaagggagcttggggactgggtctatggacagctgacctgggcatgaagtgggtggagaatgaagttccctgtatcatttggggctctccagggtaacagaacccctaggatataacctaggagatttatcttgaggacttacgtgattgtgtaggctggcaagtccaaaatccacagggcaggccaggaggctggaagctcaggcaggagctgctgctgccatcttcaagtggaatttctcctccaggaaagcccaatgtttgcttctggggttttcaatgagctggatgaggccaatgcacattttggggggttaatctccttaaagtcaaactgatggtagatgcaaacgccagctacagcacacctccacagccacatctagatgggtgtttgcctgcataactgggaacttgagcgtggccacgatcatgaagaaaggatcagcctcagtgggtaacagttacagcagttgacagctggggcgtggtggctgctgttttcctgcccagctgaccctgagtgtacagtttgctatagtcagatggatgatgtttattttaacatctcaatgatgcatcccctatggtcaggtttccttgagtgtacggtttgctatagtcagatgggtgatgtttattttaacatctcaatgatacatcccctacggtcaggtttccttgggttttctcgttaggaggtcacacgactgtccccatttctccaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggtagcataacacccccgcggacacctttccgtctagcgtgcattttgctaaaacactttgacacacagatcagtaggcaccttgaccagtctgtctccagtctgacagatcccaaaggcttggctcgttctgcctggagaacttagtgccgtggctcttgtgtcactcagccctggaacaggtgcaacttagacatcctccactgttatccagcagctgatgaaaatagaatttcctcctagaaacaggtttgaaggccatgctcaggggctcacacctgtcactcccagcactttgggaggccaagttgggaggatgatttgagcccgggagtttgagaccagcctgggcaacatagtgagacccccatctctacaaaaaattaacagttaggctgggcatggtggcatgagcctgtaatcccagctagtttgggaggccaaggtgggctgatcacctgaggtcaggagtgcgagaccaacctggccaacgtgctgaaaccccatctctactaaaaatacaaaaaaaaaattagctggggatgatggcgcgtgcctgtagtcccagctactcaagaggctgaggcaggagaatcacttgaacccgggatgtggtggttgcagtgagctgagatcacgccactgccctccagcctgggtgacagagcgaaactccatctcaaaaaaaaaaaaaaaaattaacgattagccaggtatgattaggcagctactttgggaggcccaggtgggtgggaagatcacttgaacctgggaggtcaaggctgcagtgtaagccgtgatggtgctgctgcactccagcccgggtgacagaacaagactctgtctgaaaaatagaaataggaaggagttggacaggctgccttaaatgaatgccctgtttcttctttgcttcaatggaactgacacttgcttatctgaggccgctgtttgcaaagcgctccctgcatcctctcgcccctccttcccctttccccgcccagaaccttcctgaggtggacgtgtgagatatggtggggtccgtggggcctgtgcagatgggtgggtctcggtctgcagggctgtgccagccaggcgtggggagtctgctgtgggctcggctggccgtggcctcatgcctccttggcagcgctggccgagcttctgtggcagtgagcacggagtcagggtgtgtgtgtgtgatgcagagatgagccccagggagccgggggcttcctgcagatgttggggagagacatacagacagggagacacagagagagagataggcagacagaaagatagagggagacagagacagacagagatggaggcagacagagacagggagatagagggagacagaaacagggagacagaaagacagagacagagatagagtgagacagacacggagatgggagacagatagtgagatagggagagagatggagagacagggagacttgagagacagagggaggcggagacagagatagggagacagaaacaaagatggagacagacagacacatagagggagatgggagacagagacagggaggcttggagagacagagatagaggcagatagagacagaaacaggagacagacatagagacagagacagagggagatagaaagaaacagagacaggagacagaaacagagagagagaaagaggaagacagagacacacagacggagacagagacagacagacagagaccaagggagaaagagtcagagagagaagccagtggtggagaagccgagaggcacggacaggggccctgagctggcgtgagcagccagcgtgggcatcgcagaggacagatccctgagccccatgattgccacccacgcaggggagggccggggagcccccgcgagatttagggagccaggatggagaccggctgtcctgctgggagcggggctcagaagcatcctcagctgggcttgcttgccctgcagggacgggatgtccaggcgaaccctggacacagcactgagccaggatgagcctgggctcctctgggacccggggtaggtgccactggggggacttggagaagctcggaggagcttctcctctgcacaccagaattctcggaggagccccctctgcacaccgcaccattgtggtgaaggctgagccggggcacctgcagagacattgtggcttctctcctggttttctccagtgaggtgtttgtgggccacccggagcctccagggtgaaaagctttattgtgaaaagcctactgcgaaagtcagacgcttggagttcaggctgtggtgtggaccaagtgattccaaggagatcgtccaccactttggggtcctctgtccccagccagcccagcccccacacagacaagagtagcccacacagctgtggcatgaagcccgctctgcagcccaggcgcggctgagcccccacgctctggagccctgcacttctccccccgacccccagggagaggctgggcgagccctcgccccgtgttctctggtgcccctaagcacctgctgtgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggtgggtggcccccccgccagggctctccttactttcgtttattaagccacaggtatcttccctgctcaggacacctaccaactgcctttttccattgacaaacctgataacgacctgaaccgggccaggctgagtcccagatcatgggtggatattcccaagttccaggaggaccccggggatgcctaaatgcccccctagaaactccggggccctctcttttggctgcggagctgaggcagagcaccttggaacccctggattcccctcagcaagtctgattatatcctgactcaccctccaccccaccccagccctggacagtgggtggagcagtagacacattcccaagggctgctgggggatcggggcctgggacgattctcacaccatcagcttacatttccccaacctctgaatgcctctcctccttgtggtccagagtggctgctgtagcaccagccatcgtgtctgcatccccatggcaggaaggagaagggaggagtacagcccccacccctgggcagaaaggatttccctgtaggtctgtgccccctacacgtggcccagagtggctgctgtagcaccggccattgtgtctacatccccacggcaggaaggagaagggagtacagccctccacccctgggctggaaggatttccctgcaggtctgtgcccccacactcacctgcttgtacagtcttgtctgggataccagcgagctccccaccactggctttcccttccagcatgggaatcaatgccatgcccttgaacattacttctgccccagttgagctttggagagtcgtcagagttccatagacgacccagccacagagcatgcatttgcttccccgcaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgagccctcctcctgttcaccctgctaaccttttccagactgcagcatctctttctagacagagggcatggctgtgtgtgcacctgtgtttctgcctgggcgtttccatggtgggtatgtgtgtgcaaatgggactgtctacggtgcttgtgtgtgtgtgtctctctgtgtgcatgtgtgtggtatgccctggagcatacctgtgacatggagcatgtctgtgcgtgagcatgtctgtgtgtgtgtgtgtctgcatccgcatgtgtgtgcacgtctctggtgtgtggttgcatatgtttctgtgagagtatgtgtgtgtgtctgtgtgggtatatgtgtgcatgtctgtgtgtgtgtgtctgcatctgtgtgcatgctgtgagccggtgggtgtctgtgtgcatatgactgtcgtgcttgtgtgtctgtgtgcatgtgtgtgtgtgtgcatgtctgtgtctgtatctgtgtgcatggtgtgtgtcttccgtgcatatgtaactgtgtgtgcacgtctgtgtagtatgtccttgtgtgtgtgtctgtgcatgagactgtgtgtccacgtgtctgcaagtctctgtggtgtgtggttgcatatgtttctgtgaggtgatgtgtgtgcatccgtgtggatatatgtgtgcatgtctgtgtatgtgcgtctgtgtgcccgtctgtgtctgcatttgtgtgtatgctgtgtgctggtaggtgtgtgtgtgtatgtgactgctgtggttgtgtgtccctgtgtgcatgtgtctgtgtgtacgtctgcatctgtgtgcatgctgtgggccggtggttgtgtgcatatgtgactgctgtggttgtgtgtctgtgtgcatgtgtctgggtgtgcttgtctgtgtgtctgcatctatgtgcatggtgtgtgtctgtgtggatatgtgagcatctgctgtgcttgtgtctgtgtctctgtgtgtttctgagtctgtgtgtgcacatctctgtgtggtatgtccttgcatgcgtgtctgtacgtcagaatgtctctgtgtctgagtccgtgtgtgtgtgtgcacctctgtggtgtgtatgtctctgagggtatgtgtgtctgcgtgtctgtggatatatgtgtacatgtctgtgtgtgcatgtctgtgtgcccatctgtatctgtgtgcatggtgtgtgtgcatgtcactgctgtgcttgtgtgtacgtctgtgtgtgcatgtgtctgtgtgtgcatgactgactgtgtgtggtatgtccttgtgtgtgcgtgcgtaagaatgtgtctctgtgtctgcatctgcgtttgtgtgtgtgcaactctctgtggtgtgtgcttgcatatgtgtgagggtatgtgtgtttctgtgcgtctgtgtgggtatatgtgtgtatgtctgtgtgtctgcgtctgtgtgcctgttggggtatctctgtgtgtccgtgcgtgtgcccatctgtgcatgtctgcatccgtgtgtgtgtgcctgtcgctgtatctgtatgtccatgtgtgtctgcgtgtccatctgtgcatgtctatgtttatgtgcgtgtgcctgtctgttggtgtatctgtatgtccgtgtgtgtgtgtgcccatctgtgcatgtctgcgtctgtgtgtgcctgtcactgtatctgtatgtccgtgtgtgtgtgtgtccagctgtgcatgtctgcgtctgtgtgcgtgcctgtctgttggtgtatctgtgtgtccgtgcgtgtctgtctgtgcccatctgtgcatgtctgcgtctgtgtgtgcctgttgctgtgcatgtctgcgtctgtgtgtgcctgtcgctatatctgtatgtccatgtgtgtgtgcccatctgtgcatgtctgcgtctgtgtgtgcctgttggtgtatcactgtgtgtccgtgcgtgagtgtgcccatctgtgcatgtctgtctctgtgcgcgtgtgcctgtcactgtatctgtgtccgtgtgtgtgtgtgtgcctgtcttgctgtatctgtgtgtccatgtgtgtacctgtcagtgtatctgtgtcctgcatgtgtccgtgtgtgcatgtcttgtggcgtgtgcttgcatgtgtgcctttgtgtctgcatttctgtgcatctggatgggtatatgtgtgtgtgcctgtgtctgtgtctgtgcgtccgtgggtctgcctgtgcgtgtctctctgcgggtccacacagacacgagggcatctccaaacaggtggacaaggctgggcacagtagctcacgcctgtaatcccagcactctgggaggctgaggcgggcggatcccctgtggtcaggagttcgagaccagcctggccaacatggcgaaaccccatctctactaaaaatacaaaaattagccgggcgtggtggcgggcgcctgtaatcccagctactcaggaggctgaggcaggaaaatcgcttgaacctgggaggcggaggttgcagtgagctgagatctcaccactgcactccagcctgggcaacaagagcgaaactccatctcaaaaaaaaaaagacaatgataataataatgataaataaaaataaacaggtggacgactgtgtgaagttatcatcagtgcaagtagccgagacgtgaggggagtggagatggggaacagccgagatcagcattcatgggcatccacggtgccgaggtcacggaaggaactgacccgagagccgtcacagtgtggccttaggttagacttgaaggagaacttccaggtggcagctgctgaggccaggacggattgacaggagacgcctggaatcccagccctctgggaggctgaggcgggtggatcacctgaggtcaggagtttgagaccagccagagcaacatggtgaaaccccatctctactaaaattacagaaattagccaggcatggtggcgggtgcctataatcccacctattcaggaggctgaggcaggagaatcgcttgaacccgggaggcggagcttgccgtgagccgagatcgcgccactgcactccagcctgggcaacacagcaaaactccatctcaaaaaaaataaaaaaataaaaaaagagacagctgacgtgctgtaactcagcaccatccgacagcggccaggcctgtgggcacaggtgctggggacctccacaaccctcccccagaggttcctggatgcttttctcgtttttaaaaaaacaaaacgcaaccaccctacagctcctcctgcaggacatcatgatagctgtgcttctgatttgccagatctgcagagacagaaatgctgaaatttatttatgtttgaatggtgtctcgctctgtcacccaggctggagtgcagtggcgtgatcttagctcactgcaacctccacttcctgggttcaagggatcctcccacctcagcctcccgagtagctggggtgacaagtgcccgccaccacgcctggctaacttttgtatttttagtacagatggggtttcaccatgttggccaggctggtctcgaactcctcacctcaggtcatccacccgtcttggcctcccaaagtgctgggattacaccccgcccggccggaaatgctaaagtttaaaatcatgagccctgaaagagcaccttctcctcgcagctgggggaaaacagctctggagacttcccaccgcacactctcccgccccttctttcccctcatgcaactcacagcttgctatttatcctctccctgtcctgcagaccggaggtctgagatcaaggcatctcagggctgtgctccctctggaggctctaggggaggatccttcctgcctctcccagctcctgggggctccgggtgtccctgggcttgtagccgcatcactccagtctctgcctccatctccacgtggccttctcctctgtgtgtctcctcttctgtctcttagaaggacacctgccattgcatttagggcccaccctactccaggatgatcccatctccagatccttaattacatctgcaaagaaactttatccaaatgaggtcccattcccaggttctggggcttaggacttggacagatcttttggacgtcaccacccaacccattgcagttgtgtttgattctttctgagaggctctaggggaggatccttcccgcctcttccagctcctgggggctccaggcgtccctgggcttgtggccgcatcactccagtctctgcctccgtctccacgtggccttctcctctgtgtctgtctcctcttctgtctcttagaaggacacctgtcattggatttaggggacaccctactccaggatgatctcattttgaaattctttactcaatgacatccatagagaccctatttccagataaggtcccattcccagcgactgagggtcagcacctgaatatatcttttaaggggacaccattcactgcactacagcagaccatctttttatttcagcaattacagaggggcgtgcagctacatgcgccccccgcaacaggcaaccctcctggggcgcctgaatcaggggatcaccagagaaggccctgccattgcccactcaccggcagtgcggccccgactctccctggcacacgcccatgtgcgccgactctgcctgcctcgcccaggtgctgcccctgaattccctgcttttttcctcccttgccttcttgtcgcccaggctggagtgcgatggcgcgatctcggctcactgcaacctccacctcccaggttcaagcgattctcctgcctcagcctcccgcgtagctgggatgacaggcgcccgccacccctgtccagctaatttgcatttttagtagagatggggtttcgccgtgttgcccaggctggtctcgaactcctgagctcagacaatctgcccacctcaggctcccaaaatgctgagattacaggtgtgagccactgtccccagcgttttctcagcccgagtcaaaccgcacgggcgtgacatcactaaccagctcctcatggagctctgttcaagtccccacggggatgtacttcaggaagacccattcccgcccacacccctctcttctctgtccctgatttaggatgcgggtggccgtcccaggatctgtccggggaggactgcttcttccatacctgacggacgtatctcgttttgtctttaaaccaggtgactttttcagggaccccctccccagcgctgagctgtacgtcctgtgccggatcctgcatgactggccagacgacaaagtccacaagttactcagcagggtcgccgagagctgcaagccaggtgagagcccatcgtcaggttagctgtttttgttaagacgtagtattttgggttcaagttttacaaggaggccgggcgcggtggctcacgcctgtcatcccagcgctttgggaggccgaggcgggcggatcacctgaggtcaggagtttcagaccagcctggccaacgtggtgaaaccccatcgctactaaaaatacaaaaattagccaggcgtggtggctcatgcctataatcccagcactttgggaggctgaggcaggtggatcacccggggtgagcagttcgagaccagcctggccaacatggtgaaaccccgtctctactaaaaatacaaaaattagccaggtgtggtagtgcgcacctgtaatcccaggtacttcagaggctgaggcaggagaatcacttgaacccgggagctggagactgcagtgagccgagatcgcgccactgcactccagcctgggcgacggagtgagattcggtgtcaaaaaagaacaaccacaacaaaaaaagaattggcttatgtgactttggaggttggcaggtccagcgtctgggtgagaggcccgctaaattgtggagggtaaatctgctgtatttaaagttggccagtgtggccaggtgtggtggctcacgcctgtcatccccgcacttcgggaggccgaggcgggcggatcacctgaggtcgggggtttgagaccagcctggccaacatggtgaaaccccgtctctattaaaaacaaacacaaaaaataagccgggcttgatagcgggtgcctgtaatcccagctactcaggaggctgaggcaggagaatcgcttgaacctggagacggaggttgcagtgagccgagactgcgccaccgcactccagcctgggtaacagagcgagactccatctcaaaaaaaaaaaaaaaaaaaaaaaagaaaatcctaaagagaaaatatatttactattcgtgaagttgaagtggctcatgataaaagtcttcattcttgaggaggtcttcacactgaggaggctgcagaggaggaagccgtgggctggtgttgctgtctcaggggtggccgaggcagagggaaatccacgcatgagtggactctgcagctggatctaatctgtgtgtttctacgcagacacacgtgcacacacacacagcacgcaccatctcggctcaaagccttcacatcaggtttctcccccgtccacccaggctgctcctggagcccagtggggctgctggaaaccctggctccaggggttcgggccagggctgcatattgggtttccacagttgaaccagctggccctgagggaatctgacgggcactcagcctccctcaagagttcagcgttgttgctccagtgagaattcctggaatatttgcagacaacggttaattatcttcacagagccagggcctggcacctgcgcgttgaaacaggactccccataggctcaaatggtcaagagacttccattcttctctccctctgtctctccttctttctctctttctctgtgtatctctcttcttttttttttttgagacggagtctcgctctgtcgcccaggctggagtgcagtggcacgatcttggctctccgtaacctccacccccagggttcaagtgattctcctgcctcagcctcccgagtagctggattactggcacataccaccacgcccggctaattttttatttttaatagagacagggtttctccatgttggtcaggctggtctcgaactcccaacctcgggtgatccacccagctgggactcccaaagtgttgggattacaggcgtgagccacctcgcccggctctattatattttttgagacgaggtctcactctgctgcccaggctggtgtgcagtggagcagtcacaggtcactgcagccttgacctcctaggctcaagctgtcctcccacctcagcctcccgagtagctggaagtacaggcatgcatcatgcatcaccatgcccagctaattttttaagaagttttttctgagaccgggcacggtggctcacacctgtaatcccagcactttgggaggccaaagcgggcagatctcgaggtcaggagttcgagaccagcctaagccacgtggtgaaaccccgcctctactaaaaatacaaaaattagtccggcgtagtggtgcacgcctctaattctagctactcaggaggctgagagaggacatcacttgaacctgggaggcgaaggttgcagtgagcagagatcgcgccactgcactccagcctgggcaacacagcaagactccgtctcagaaaaaaaaaaaaaagttttttgtggagataggagtccccctctgtcacccaggctggagtgcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagtgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtagcagcatttggctggagggcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgcactcaagcgatcctcctgcctcagcctcccgagtatttgggagtaccagcatttggctggagggcagtgttgccatcatagttcactgcagccttgacctcctgcgctcaagcgatcctcctgcctcagcctcccgagtatttgggagtaccagcatttgttatcatgccctgttagggttttttaaattttgtagagatgggatcttgcgatgttgcccaggctacccttcctgggctcaagcgatcctcctgcctcagcctcccaaaatgctggggttaaagacatgagccactgcacccggcctctgtctctctttctctctcttctccctcttcctctctgtctcctcctctctgtgtctttttaggtatctcatctatcatcatcaatctctgtttctcttctctcctccttcctcctttatcttctctgtctcttcctccctctctccaccctgtctctgtctctctttatacatctatcatccttttttaaaaaaaataaaatagagacagggtctcactatgttgctcaggttggtttcaaactcctgggctcaaaccatcctcccacctctgcctcccaaagtgctgcgattacaggtgtgagccactgcgtctggccttctaacaatgctccgtcacctgtcatctgtctatcatttattatctatccatccatccatcatctacctacccatcatctaccatatattcacccatccatccatctcatccatgcatccatctatccatctattcatctatctacctatcatctaccatctattcacccatccatccatctcatgaatgcatccatctatatccatccattcatctacctacctgcccatcacctaccatcaatacacccatccatctcatccatctatccatccattcatctacctgcccatcatgtaccatctattcagccatccatccatctcatccatgcatccatctatccatccatccatctacctacctacccatcatctaccatctattcacccagccatccatctcatccatgcatccatctatatacatccattcatctatctacctacccatcatctaccatcagttcacccatccatccatccatctacccatcatctaccatcagttcacccatccatctcatccatgcatgcatccatccatccatccatctacctacccatcatctaccatctattcacccatccatccaatccatgcatctatccatccattcatctacctacccatcatctactatctattcacccatccatctcatccatgcatccatctattcatctatctatgtacccatcatctaccatctattcacccatccatccatctgttccatgcacccatctatccatccattcatctacctacccatcatctattatctattcacccatccatccatctcatgcatgcatccatgtatctatccattcatctacctacctacccatcatctaccatctattcactaatccatccatctcatgcatgcatccatctatccatccattcatctacctacttaaccatcatctactatctattcacccatccatccatcacatccatgcatccatctacctacctacctatctattcacccatacatccatctcatccatgccatctatccatccatccatccacctacctacccatcatctaccatctattcaagcatccatcacatccatacatccatctatccatccactcatctatctacgtacccatcatctaccatctattcacccatccctccatccatctcatccatgcatccatctatccatccattcatctacctacctacccatcatctaccatctattcacctatccatccatctcatccatgaatccatccatccatctacctacctacccatcatctaccatctattcacccaaccatccatctcatccatgcacccatctattcatcttcctacctacccatcatctaccatctattcacccatccatccatctcatccatccattcatctatctacccatcatctaccatctattcagccatccatccatctcatccatgcatccatctatacatccatctacctacctacctacccatttattcacccatccatccatctcatccatgcctccatctatccatccacctacctacccatcgtctaccatctattcacccatccatcacatccatacatccatctatccatccattcatctatctacgtacccatcatctaccatctactcatccattcatccatccatccactcatctacctacccatcatctaccatctattcacccatccatctcatccatgcatccatctatccatccatccatctacctatgtacccatcagctaccatctattcacccaaccatccatctcatccatgcatccatctattcatcttcctacctacccatcatctaccatctattcacccatccatccatctcatccatacatccatatatccatccattcatctatctacctgcccatcatgtaccatctattcacccatccatccatctcatccatgcatccatctatccatccattcatctatctacctacccatcatctaccatctattcacccatccatccatctcatgcatgcatccatctatccatccatccgtctacctacctacccatcatctatacacccatccatctcatgcatgcatccatctatctatccactcatctacctacctaaccatcatctactatctattcacccatccatccatcacatccatgcatccatctatacatccatctatctacctacctacctattcacccatccatccatctcatccatgcctccatctatccatccacctaacgatccatcatctaccatctattcacccatccatcacatccatctatccatccactcatctatctacgtacccatcatctaccatctgttcacccatccatccatctatccatccattcatctatctacgtacccatcatctaccatctattcacccaaccatccatctcatccatgcacccatctattcatctacctacctacgcataatctaccatctgttcactcatccatccatctcatccatgcatccatctatccatccattcatctatctacgtacccatcatctaccatctattcatccattcatccatctatccatccactcatctacctacccatcatctaccatctattcacccatccatccctctcatccatgcatccatctatccatccatacatctacctacgtacccatcagctaccatctattcacccaaccatccatctcatccatgcatccaactattcatcttcctacctatccatcagctaccatctattcacccatccatccatctcatccatacatccatatatccatccattcatctatctacctgtccatcatgtaccatctattcacccatccatccatctcatccatgcatccatctgtccatccattcatctacctacccatcatctaccatctattcacccatccatccatctcatccatgcatccatctatccgtccattcgtctacctacctacccatcatctatcatctatacacccatccatccatctcatgcatgcatccatctatccatccattcatctacctacttacctaaccatcatctactatctattcacccatccatccatccatctatacatccatctatctacctacctacccatctattcacccatccatccatctcatccatgcctgcatccatccatccatccatccacctacctacccatcatctaccatctattcacccatccatctcatccatgcattcatctatccatccattcatctatctatgtacccatgatctaccatctattcacccatccatccatccatctcatccatgcatccatctatccatccattcatctacctacctacccatcatctaccatctattcacccatccatctcatccatgcatccatctatccatccatctacctacgtacccatcatctaccatctattcacccaaccatccatctcatccatgcacccatctattcatcttcctacctacccatcatgtaccatctattcacccatccatccatctcgtccatgcatccatctatccatccgtctacctgcccatcatgtaccatctattcacccatccatccatcacatccatgcatccatctgtccatccactcatctacctacctacccatcatctaccatctattcacccatccatccatctcatacatgcatccatctatccatccatccatgtacctccccatcacttaccatctgttcatccatccatccttctcatccatgcgtccacctatccatacatctttctacctacctacccacccatcatctaccatctgttcatccatgcatccaggagaaccggaaaaggcccaggtgatgcatccatctatccatccatctttcgatcaaatctccttctccctgtctgtccgccctgcatcaagtctctgtctctctcccctcccctacctgtgtgggccccctggccaagggttctcagcagcctctgctcaccgttctgagctcctgttgcctgctgtgtcccctgtgtcctgctgaaggatccccgcctggctggccaggactccagctctctgctgtctccctcaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctg

SEQ ID NO: 38783 - DNA, 4887 bp, Homo sapiens
gtcggggagccggcggtggggctggacgcaggtgaggtggcaccggactcagccgcgccctgggccctggatgctccgtgagagtcagggagcgctgtgggggtctgggatcgaggggcatgggggcagcctggggctgtggtagagggtctggctgcggtgaggtctccccgcgtgcttgggagccgcgcgacgcctgcgcagggccccctcccctaagggctggccctggggccctgccgggggagcccgagcaggtttccggctcccaggatgggatccttgagggtggctgcgccccgaggcctgtcctgccctggaggaatctggctcgccagggctctccaggaccagccagcctcgagtgggcgtgggctgcacacaggcgccgtctcgtgcctgtccctagcatgcgggctttagctgcgaaccgtgttaacgacctgtgccaggagcccccgtcccaaggttgtctgcctcccctcttgtcagtcagaggggagtagaatgtaccttttctcggcctagtggggagtcgtgggttgggaccagctgctctgggctgggtggtagctcaggacccctgcggcgctgtaggctgagagctcccaggggaacagggctgcgacgagggagtgcctcggtccagctgggtctttctggttgccagtggactatgccccactctgagggcctcactctgtgccagttgccacagaagagtggggctccaaaggatgagagcgtgatgacctcagcctcccactgtttgacattacaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacgtgagtgagcccatccccagatcagcccttcctctccatcctaccccccaccctagaactaagagttccaggctgggcatgttgctgagtctaacagtagctgtgtttctgggtccttcctgccaggtggctggcctggcctgggtgtgcttggctgtgttcctggaaaaacaaacaccctcccatctcttcctggaagcctgcaccctcatatcagccaggccctggggccaccctcccttttgactgtccctcctgccatagtcccacccagttcctgcacttggcacccaaccctggggtgctggttccctccagagcctcctgacagcctggcttcctacagggatacagcacagacccgcgccctgtttgagaaggtccaacccacacacgtcatccatcttgctgcaatggtggggggcctgttccggaatatcaaatacaatttggacttctgggtaagtgagggtggccccagcaagcactggaaaccaggatcccaggttctgggaacttcctggcgggcttcccactctcacaggcccacattcccaccccaggaagtccctgaggatcagggcttggcacagcctggtgggggcagcccctgagggacccccagtcactcacacttggtgctgtggacagagggccatgcagggggcctggaggcacttggcccagtaggcaaagctgtggagctgacttgcagcattgggaggctgaaaagagccagcggccacgtgggactgggagctggttcctgccccctgagtccccagggcctctggagcctctggctcccaggactgtgctggcccagctccccttagccgggcccaccacacactctggggtgcaggggtgtgaaccgcgctctgtgcatctgctgcctgtgtctgggggaagggggcgtggtgtaagggccctgccgtggctagctgtgttccggagggttggccccaccagtcactgggcagcagccttgccttagctggctttgctaagcgtaggaggcactagcgtgagcagaggctcagaggagattctgcccaggagccctgtcaccccagagccctctttgtcggtgtctcggccttcccagcaggctgcctggccaccacctctcccttctcccaagaccagtcccagggctccagccatgccgtgtctagttcatgcacgggaagtggggcccgcggggtggacccggcaagcgcaggctccattgatcctgggaagtagagccaggtgggagctcctccagggtggggaagtagaccgccctgttccccgtgtagtgggagccccagcccagcccagggccagactgggctccttcccagcctccagtggggtcctatgccctgacctcagcagcctcctgggtggggcccagccctgagctgggggtgtggttctcctcatagtggaaggcagagccagcccctcctccagccttggtggggctggagagcaatggtgtctgtaagcccactgccttgtccggaaacggttaggatgggcaggcttgggtcctcccagggctgaagggccagggtgtgtctccacttctgcgtctggaggagcaggtaagggctgggatctggcctggggagcctgaactgtccccgcctcacccctgcagaggaaaaacgtgcacatgaacgacaacgtcctgcactcggcctttgaggtgggcgcccgcaaggtggtgtcctgcctgtccacctgtatcttccctgacaagacgacctacccgatagatgagaccatggtgaggggcagggcctggctgtgggtggggccggggagccggtgggcagggccaggaagtagcggcctctgcctctcccacgcccgcagatccacaatgggcctccccacaacagcaattttgggtactcgtatgccaagaggatgatcgacgtgcagaacaggtcctcgcgcccatcctgctgaggcccagccaggagtcggggagagggcccccaggggcgggtggggccggctggtcgggtcttcgtgccagcctcagtaagaggccagcggcagcctggggtgggatcgcgggcccaggacgagggcaggagacgctgtgcctccgcagggcctacttccagcagtacggctgcaccttcaccgctgtcatccccaccaacgtcttcgggccccacgacaacttcaacatcgaggatggccacgtgctgcctggcctcatccacaaggtgcacctggccaagagtgagtgcgtccgtccgatggggtgcccgggctcagctcgggaggaggtgacccagtgcctctgacacctgctccttccccaaatctgcaggcagcggctcggccctgacggtgtggggtacagggaatccgcggaggcagttcatatactcgctggtgcgtaaaggaaggcacagctctccccagagaacctgccctattgagccctgggctggcccctgctgggctgtcggggaggtggtgcaggagggaggctcctaccagcagagaatctgggctgagctccaagaggagccatctctggtcctcgtggaggccccataggctcctgtctccaggagtcactggcgtagctctgagctccaagggagaaaggagggacccctgttccccaggctgagcccccactgaacaaggacagcagtatggactccccagcaggggcgtttgggagagggttggctatacccatggtctctgaccctgcctgtctgacctctaggacctggcccagctctttatctgggtcctgcgggagtacaatgaagtggagcccatcatcctctccggtgggtacctcagccctcagcccccttcctccatggtaggacaggatccaaggttgtcctgggaggctggctgaggggtgggagcaggaatattcatgggccgtcgggtggcaccaaggggaggcctgacccggtggctccccacagtgggcgaggaagatgaggtctccatcaaggaggcagccgaggcggtggtggaggccatggacttccatggggaagtcaccgtatcctctggctccagtgctgggggttgggcgggggccccttgggcgggctcagtggccacccggtgtagggccagcgtgggtgggacactgcggagggaggatgctcaccctggcaggcggaggagctctgctgtggctcccctgggaatggcagaggttcaagggcaagctgcgggggctggggtggaggtgctcttctcgctgtggccttgacaaagcctccagtttgatacaaccaagtcggatgggcagtttaagaagacagccagtaacagcaagctgaggacctacctgcccgacttccggttcacacccttcaagcagggtgagccctgaccccacagccctccacttggtggaggcctgccccagcccctccctcatgctcgctaccagggcagaggtgaggtgccccctcagagcctgtactgccctggaggtgggacaccaaagctctgaggggtgacttccctgtccctgggcctcctccccccacttcctcccatgcggccccgaccctccctgtccatggccctcacctgcctgcctctgcagcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtcccgggcaggcccggcgctttgctccccacaccagccccctgcgcgtgtccactctgatcctgcatcccactccctgggagccaataaagtgcattttcacaggc

SEQ ID NO: 38784 - DNA, 15220 bp, Homo sapiens; identical to SEQ ID NO: 35935

SEQ ID NO: 38785 - DNA, 15595 bp, Homo sapiens; identical to SEQ ID NO: 36561

SEQ ID NO: 38786 - DNA, 185726 bp, Homo sapiens; identical to SEQ ID NO: 36820

SEQ ID NO: 38787 - DNA, 33425 bp, Homo sapiens; identical to SEQ ID NO: 36326

SEQ ID NO: 38788 - DNA, 65850 bp, Homo sapiens
cggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccgggtaaggcgctgccaacttggccaacttcagggcccgggcggggggagcgccgaggcgcgggccgctctcgacttttccctccttttcccccctcttttctccagaagcgtgtgtgcgtgtgtgtgtgactgggtttttaaaactcgtctccgcttttctgaaagcgggggaggagaggggaggaggagcgcgcctagaggtgggggaggacctgagtggaaccagatgtggcgggcggcgggggaggggagcccgggggactccagcagcctaggaggaagcgggtgggctcttgaggacccccgcgcaccgcgctcccggaccacccggcgccggcccgtcctcggcaggggacctgcagggcgcgcccggggagccagggctctctgtccgggagttcccgggcccagtctcctcgctctgccccaggactgatgcgttaggacggctttccaactatccgcgagggttcgtttcccccaccttccccccgccccctgcatctcgtgggcgttgatattttcttttccacacttagtcttcaaggaggcttgtggcgcgcggcatccgccccgcgtgagctcggcagccctgtgaggaggctcctgccactgggacgcagcaacaggctgggcgccgccgtgctgtgatgttgcgtagcgtgggcagctctgggcacactagtggccctccagaggggacagaccttgagcggcaaaagagctgctaaagattttaaaacccaacgaacaggaaacaaaacaaaaatcagaaaaccccaaaactgtgccattctcttcctgctccttattcaggggtaacagtgaagtgtggggacagacagatccctcgccaagaatctaagagttgaaaggaaagatccacttcctgggggagtgggggtgggggtgtctggagtgaccgggggaatcgcccggcccagcttggtcctgctggctgtttaattgggggatggggacagtccgtgcagtgtctgcagttttgtgcaaggaccagacagccccctggagagtctggggcctccagcctggcccgtgcttgctgggttggcctggcgtgacgtaggcacaagacacatatctgccagatgggaaaggtgggggccacggtgacccacattcacaccaaccggagacccccggggcaattctgggcccacctggcattgaatgtgggacagacacaaaccaggccgggtaaccccctaacccactgcagggcggcctcacaggcagttcccctacctcctcgcactcctgccttcctctgctcctctgcgcagggcctcaggaggcaggcggtgggaaggggtggggaggatggccattcccagagctccagagcacactttaaagccaggccctgggagagagttgtggccagagtgctgactcggcctttccccctggagcttttcatagagggggctggaagtgcctggtgagaggcccggtcagggaggacaaggacgcctggagtgtccctcctcctcctggtctctgtgcctggccctccctggggctgtgtccagggatgaatagcctcagagggtccccttcccgttggcactgcattgaccacaccctgaggaggcttggatctgggtggcaggcagtgtgaggtcttccagcagcagctgagcaggaggaggatggagctgctgcaggttccttccctcggaaccgtgccctctgcacagagtgcgcttgcccctgccctgccaaattccactgggccctaccctgggaagcctgttcagagcctctgggccgaattccttgcccgaagagctggcagcccctagtacctggtgaattacgttgttgttgggaggaattcaccagcaccagagaccaaatagcccaggaaatgcatgtgggaggtagggtgtggcaggccagtgctgctgggggcgaggcttatgccaggcagggcaggggctgcgtgtgggcagtttcctgaccaccatgggggagccctgtgtgcccagagcacggggcaggggcagcgaggcggcagtgccttcttggtgcgtgatggtggaatccatcttttctccaccttggtggagtggcccgcggagactgtcactggaaggagtcctctttgttagttgccatattaccgcatttctggagcatgcagtttgctcagccttgagccaagttcttggggaggagggaaggtagagaagagtgtaagatgcatcctctggaaaaagaaaatcgtgtgggagaatgaaacgtggaacagtgaactgcgtagggggcagaatgccattggtgggatgcctgcctgcccagacccacgctcaacccttcatgtgcaagttcccatttcattttgataacaacccaaggagatggttattgttggaccatttttgcagttcaggaaatgaaggctaagaggggtctgatcatttacattggtcacacccctagtaagtgaaaggctggagtgtggatgcttcccgtctggagattggaggcaggagagaccgtatgggccaaagggtggccaaggctgtctggagagaggcaggaaggggccaccaggctgggctcttctggggatgatgtggaagcttgctggctgggccggggagaaggttgagtgaaagaggtgcctgggaggccagaatggggatgggacctgcaagctggctgtggggaaccccaggggacccttggaggtttccgagcagaggaatgaggggatagttgctgggaaaggggcttctgggagctccagggatcaagtctcaaggccatggggtgaggagacctcaggaaatcttcctgtggggaaggtcggtgctgcctaaaggacagggagggtggcatcgggtacttggggctctgaccagagtcagccagaccagctccctacacttctggcccagcttctgctgagtcgtggggttcggaaacttcttactgttcccccacgcaaaactcagttttccttgctccaaccctctggctctctgtgagtcatcagggcccaggaggtgcccagccgagctgtggctagtgctgggatcctggctctcttctgggttcacctgggcaaggtgagggtacatggaggggaggaagaaccccgggttttggcccccatttttcgcaccagagaaatcctggctttctgatgcacgtagggcaccgtgacttggctcaatgagatgatttcggaagtgccatgcagttctcaggcagatattcatttgagttcctcatcagtttaagcatcgaggaggagtcctgttgcactgtccatacccccagagggatggagcgatggcacccacggctgcgctgtgcatgtggtgggcgccgtgctgggtcctgtgctggcagtagctcttcggcacctcccatctctgagcaggtgtcagagatttgcacacacctggcgtgaaaatgttaaagatgttaagggagtcactcaaggctgtgccaccacaccactagaaggtgttaccagtgagattcgaacccaggagtggttacggagcctgaacgctccagtaccatacagcgtttccatcgcatgaagcactgtcagtgtgtgtgtgttaggaaagcctgggaaattctgccttatgtgttctccccgcccccataactccaagccctctaggacacctctcaatgtgtcccaccgggaggactcctgaggaggagggtggagcgagcagccctctgtcacatgtcagcggtctgggcgcttgggtcagccacttccttgtgggtccaggaggcctggaccgagccgcctgcagtgtcctcaggatctctgagggaccccctccaagaaggcattgataagtgagtgactcaaggtgccccagcatggcactccagcttccctgaggtcaaggattcacatggttgttcattcattcattcattccttcagtgggtgtctgctgagctcctgcagaactgaagtagagatggccatggcctattctttatttgagacctccccaccgtgtctccagtgggggtccctggacttggaaggcctgagcactgctgataggaagcgtgtcttcctgttcaggcctacgtgagatgggagggggccgctttcccacgcctgggtcctgtgaatctgggtggggtgggccagtggggtggtgacgcgctcctggagctcaccctgggccctgcagatctgtcactcttcagctaggggttgtaccagtaaacggcagctggatgagggctgtccagtggcacctgtgacaccggggtctgccggggtccaccagctgcagccctttaggaaacagattgggtcgaccccctcaactgcacactgtggcccctcgtggaattccaccggttgtttcccttcttgcacttccccctggcccctcgtctctccttccgccgctgggcaccagcctcttggctctgcactctcacagcgcagacccttccacctgcgctctgctcccctcagcctcccactcctcctgatttctctttctctgactgtgcattctgccctccgcagctctggtttttgttgtagaagaaggaccaacttcttcctagtttccccggccccccatgcctctggtctcttgtcctgccccagctttctccacctccaggcttctgcccacgcacgatcactttgcctggtgtgcctcccctcccctcttctttcccaccttccagtgacccttccttcgagactcaaggatcctggggaggacgctgagggagcctggtccctgcctcttgggctgacctggggtgacgagagacaagcacacagacatggcccatggtgacaaatcccagattggatgggtggcctctctgtttatctccttcccagggatcacctcaggagggcacatgtagggaacactatagccagccttcctcagccttccccagccttccctgaaggcagccgggtgcgaggctgagcagtggccccttcctcctgtagatgaggcaggagtgtgggcatggctggcagtgtttccccccgtcagtcctctggaaatgtaaatagggacagagtcggtgggaccaggattgatggcactcaccagctatgtgacctcaggcagaggctcaagtgtcttcatttataagatgggaaaaatcaatacctcttgtagaggtattataagattacatacaaatgagatcatgaacgtatgagatatgtccctggtacactactgggcacagaataatttcttagcaaacaatactaaattattgctatttttattagaagagaaagggtgggtgaggtggctcatgcctgtaatcccagcactttgggaggccgaggcgggtggatcatgaagtcaggagatcgagatcatcctggctaacacggtgaaaccccatctctactaaaaatacaaaaaattagctgggtgtgatgtgggggcgcctgtagtcccagctactcaggaggctgaggcaggggaattgcttgaacccaggaggcggagattgcagtgagccaagatcatgccactgcactgcagcctgggcaacagagcgggactccgtctcaaaaaaaaaaaaaaaaaaaagagaaaacatgactatcaaggttcccaaatatgataaaacacagtcttcaatatacaaaatcctgctggacacggtggcccatgcctgtaatcctggcttgagcccaggagttcaagaccaacttgggcaacatgacgaaacccagtcactacagaaaaaaaaaaaaaaaaagctgggtgtcctggctcattcctgtagtcccagctactgggcaggctgagatgggaggattgcttgagcacaggaggttgaggctgtagtgagccacgattgcatcattgcattccagcctgagtgacagagtgagaccctgtctcaaaaaaaaaaaaaaaaaaaaaaaaaaaaaaaaaaaaaaaaaatcctaactacagctgtcaccagaaaggaggtccaatccagaccccaagagagggaactcacgcaagaaagaatttgaggcgaatccatagggaatagtgaaagcaggcttaataggaaagtaaaggaataaagaatggctactccataggcagaggagtagcactgacggctcagctgcttatacaattgttacttcttgatgatatgctaaacaaggggtggattattcatgagttttctgggaaaggggtgggcaattcccggaactgagggagtcttccctttttagaccctataaggtaatttcttgacgttgccatgacatttgtaaactgtcgtggcgctgataggagtatcttttagcatgccaatgcgttataattagtgtataaaaaaatgggcagtgagaatgaccacaagtcattttttttttttgagatggagtctcactctgttgcccaggctgaagtgcgatggcgtggtcttggctcactgcaacctctgcctcccaggttcaagcaattctcctgcctcagcctcccaagtagctgggactgtaggcatgtgccactacacgtggctaatgtttgtacttttagtagagatgggattttaccatgttgaccaggctggtcttgaactcctgacctcatgatctgcctgcctcagcctcccaaagtgctgggattacaggcgtgagccaccacgcctagcccagagatcacttttgtcaccttttagttttggtgggatttgggtggcttctatactgcgtgctgttttttcagcaaggtctttgtgacctgtgtcttgtgttgacctccggtgtcatcctgtggcttagaatgcctaacctcttgggaacgcagcccaggagttcccagcctcgttttacccagccccttttaaagatggagttgctctggtttgaacacctctgatacaacttttttttttttttttttaggacggagtctccctctgtcacccaggctggagtgcagtggcacaatcttggctcaccacaacttccaccttccgagttcaggcgattctcttgcctcagcttcccaagtagctgggactacaggcacgtgccaccacgcccagctaatttttgtagttttagtggagacggggttttaccatgttggccagacgggtcttgaactcctgacctcaggcgatccacccgccttggcctcccaaagtgctgggattacagaagtgcaccaccatgcccagccccattgttttttttttaaattgaagcaggtctgaacctgttacttcattgctatttttctctttttttttttttttttttttcagaaatagcctcaatcagaggcattacttcttcgtgacactttgctaactactgtaagtgccaaaaagtaatcatagtttttctgaaagtaaaagaaataccaaagaaaaaaaatcccaccctcaatggtcctaccccctaaagcccctcaatttatcaccatcctctttatcaccttcctcttcatccttacacttctctatttaaccttcatttagggaaggataaggagcttcctgggactctggaataaaaccaagacagactagggaacactgggatggttgggcatacctctcccctttttgcctctagttgcctttagcctactgtctgagggactgcctcccaagggtcatactgatgaggctccctaattactaaattaagtgacctttcttaggcctcaccttgcagcatgcatgctgttcattggcctcaattgtaagaatgggccaggcatggtggctcatgcctgttactccagtgcgtttggaggccacgggaggagagactgcttgaggccaggagtttgagaccagctggggcaacataacaagaccctgtgtctagaatttttttttttttttctgagacggagtctcgctctgttgcccaggctggagtgcagtggcacgatctccactcactgcaagctctgcctccccggttcacgcaattctcctgcctcagcctcccgagtagctgggactacaggcgcccgccaccacgcccggctaattttttgtgtttttagtagagacagggtttcactgtgttagccaggatggtctcaatctcctgacctcgtgatccacctgcctcggcctcccaaagtgctaggattacaggcgtgagccaccgcgcccggccaatttttttttttttaaattagctgggcacagtggtgcgtgcctgtagtctcagctactcaggaggctgaggcaggaggattacttgagcccaggagttggaggctgcagtgagctatgattgcaccactgcacaacctgggcaacagagtgagaccctgtcgcaaaaaaaaaaaaaagtaaaaatgcatgctcagtggaaaacattcaaaccatacacaagtaagtgcaaaaaaatgtgaagtccactcccttacactacactgattacacactagcacaggccacagtctaccactggtagattctgtgggtaatcttcccaaccaagattccccaatgaagattagtagtagttcattgggtaatcttctgatttttttttttttttttttttttttgagacggagtctcgctctgtcgcccaggctggagtgcagcggcgggatctcggctcactgcaagctccacctcccaggttcacgccattctcccacctcagcctcccgagtagctgggattacaggcactcaccaccacgcctggctaattttgtttttgaatttttagtagagacggggtttcaccgtgttagccaggatggtctcaacctcctgacctcgtgatccgcccgcctcagcctcccaagtgctgcgattacaggcgtgagtcacagcacctggcctgtcgttgttttttaactaaagacagagtctcactatgttgcccaggcctggctttgaacttctgggctcatgcgattcttctgccttggcctcccaaagtgctgggattacaggcacaaaccactgcacctggaccaatggacacttttgaaaactctcttcccccggcctttgtggtgtaatttacatccacagtttcctcccttagggtcttcccttccaccctcagtccagagctggcattgctgccaggttagcgctgctaaggggaagcttgaatcgatgtaaactttctgaatttagaatttctgctaggctcggtgactcatgcctgtaatcccagcactttgggaggccgaggcaggcggatcacctgaagtcaggagttcaagaccagcctggccaggtaaaacccccgtctctactaaaaatacaaaaatacaaaatagtgaaaccctgtctctactaaaaatacaaaaatcagccatgtgtgatggtgcatgcctgtaatcccagcactttgggaggctgaggcaggtggatcacttgaggtcaggggttcgagactagtctggccaacatggtgaaaccctgtctctcctgaaaatacaaaaattagctgggcatggtggcacatgcctgtaatcccagcagctcgggaggctgaggcaggagaatcacttgaaccctggaggtggaggttgcagtgagctgagatcacgccattgcactccagcctgggtaaaagaggaagactgtgtctcaaaaaaaaaaaaaaagaaaagaaaaagaaagaattcccggccttctcagtgcttgtgcaggtcaagctgagctccttaccgttcccatagctcccagtactgcccaacccggactctgctcaggctttttttccctgccaggagcaccagcttcccagggggctgtttctgagtcccaactcacacctgtgaccttctgattaccctcagctggaagaagcctttctctccacggctgctctagcattttactgctgtcgtccctcaaacacctccagagcaaggcctttttgtcactacacaggttccagcacagtaccttgtccacggtggcatttgtttttgtttgtttgtttgaaacagggtcttgctctgtcacccaggctggagtgcaatggcactcacgggagcctcgacctcctgggctcaggcgattcttctgccttagcttcccaagtagctggacgacaggcggcgccaccactctattttgttgctcctatttttagtagtgggagggtcttcctatgttgcccaagctggtctcgaactcctgggctcaagggctcctcctgccccagcctcccaaggtgttgggattacaggcgtgagcaactatgaggctggcatttggtattatttagtaaatatttgttgaaaatgagaaaagaaagacaagtgttccaaagaattttttttttaatagaaaggcaatgagagttacccttctagaattttacatgatgccacggtcatgaaaaacatcatatggttttaaattaaaataaacagaaaaaagtccaatgtactagaaaaaaattccagaagtggatttaaactgttataagaaaataatgtgagacacaccagaaaaaacacactaataggaaaaggaatttttacttttaaatgttatgaggatggccgggcgtggtggttcatgcctataatcccagccctttgggaggccaaggtgggcggatcacgaggtcaggagttcgagaccagcctggacaacatggtgaaaccctgtctctaccaaaaatataaaaattagccaggtgtggcgacgtgtgcctgtaatcccagctgcttaggagagtgaggtaggagtatcgcttgaacctgggaggcagaggttgcagtgagccgaggtggtgccattgcactccagcctgggtgacagagtgaaaccctgtctcaaaaaaaaaaaaaaaaaaaagaaagaaacaattagccaggcgtggtggtgggcgcctgtaatcccagctacttgggagattgaggctgctcttgaactcctaaccctggaggccgaggttgcagtgagctgagatcgtgccactgcactccagcctgggtgacaaagcgagactctgtctcaaaagcaaaataaaacaaaaataaatgttatgaggacacctggattataattagaaattttaatttcagtttatagttgatcacacttgaggaaattcagatagcaagctgtcacatagaaagtgcaaggattgggccgggcacagtggctcatgcctgtaatcccagcactttgggaggccaaggcaggcggatcacctgaggtcaggagttttgagaccatcctggccaacatggtgaaaccccatctctaccaaaaatacaaaaagtagctgggcgtggtggcacactcctgtaatcccagctactcagttggggagggggctgaggcaggagaatcacttgaacccaggaggcagaggttgtggtgagccgagattgtgccactgcactccagcctaggcaacagagtgagactttgtcttaaataaataaataaacaaacaaagtgcaaggatcactggaaatgaaggaaattagctttctttaactacttaaactagcaaaaacagaaaagctagtattggcagagctgtgaagaagccaatatatctgactgggggactgtaaattggttctgtttttcaggattcaatctttcggacaatatgtaagaaactggatatgtaagaattcctatcctttgatgtcataattttacttttggtaatttataagatattaatctcaaagataaaaaaaatgttcttagaagtgtttttaagagactgggtctcactctgttgcccgggctggagtgcagtggcacaatcatagttcactacagcctcaaactcctgggcttaagcaatgctcccgcctaagcctcctgagttgttgggactacaggcttgagccacagcctttagtagcaaaacaaattggaaaccacatgatggattatttacgtaactttaagtgacaaatatatggctaatgattctttttttttgagacagagttttgcacttgttgcccaggctggagtgcaatggctcgatcttggctcactgcaacctctgcctcctgggttgaagcaattcttctgcctcagcctcccgagtagctgggattacaggcacctgccaccatgcccagcttttttttttttttttttttttttgtatttttagtagagacgggggtttcttcatgttggtcaggctggtctcgaactcctgacctcaggtgatctgcctgcctcggcctcccaaagtgctgggattacaggtgtgagccaccacgcctggccagctgattcttacaaggaaagttctgaggactgtgagacagtcttacaacatttaatatgcacatactggaaacaagatgcatacctgacattcatctgtccgtttattcattcagttaactggtgtctttgttcattcattcagttaattggtgtctttgtttttgttttctttcctgaacattgaaaacgtaccaggcatggtatttggtgctgccaacaccgtggtgagcaggctaggcatgattcctgctttcctgaggcttgcgttttgaaagcagtcccttcccaatatagagtgccacaaataatctcaaacgtacactgatttcatttgcaggtccacttttttgttttgttttgttttgagacactgtctcgctctgttgcacaagctggaatgcaatggtgggattcactgcagcctcgacctcctgggctgaagtgatcttcccccctcagcctccgcagtagctgagaatacaagcacaccaccaccactggctaatatttaatttttttttttttttttgagacagagtctcgctctgtcgcccaggctggagtgcagtggcacgatctcggctcactgcaagctctgcctcccaggttcacgccattctcctgcctcagcctcctgagtagctgggactacaggtgcccgccaccatgcccggctaatttttttgttttttgttttttgtgttttttttagtagagacagggtttcactgtgttagccaggatggtctcgatctcctgacctcatgatccacccgcctcagcctcagcctcccaaagtgctgagattacaggcgtgagccactgtgcccggcctaatttttttttttttaaatagaaacaaggtcttgctatgttgcccaggctggtctcaaattcctggcctcaagtgatctacctcagcctctcaaagtgctggagttacaggcataagtcactgtgcctggcctgtaggtgcaatttttaagttcattaagagaaaaatcggctgggtgcgatggctcatgcccgtaatcccagcactttgggaggccgaggtgggtggatccggaaggtggaggttgcagtgagctgagatggcgccattgcactccagcctggccaacagaccgagactgtctcagaaaaaaaaaaaaaaaaagagaagaaaagaaaagaaagatggaggcaatcgactgctctaaaaccttagacctagaaacaggaacctgtctgacagtggggagaacgactcccagacaaactagcctggctgaataggaaggactcaacgggaagcagctttgcagtcatcttggtccccaaggaaaggggattctggtattaccccataaaaatttaacctcattcctgaaggatctaagtatgtaagggcattgatggtttgcaaagagcttggaagcactgtttatagtagcaaaaacaaaaatgtacttggaaagagatatggataaattatagaatagacacaatgaaatgtaacacagaggtggacgaatggactccagctatttgcaacaacatgggtgaatattagagacttaatgttgaatgggggaaaagatcccagaggactgcatatggtacaatactctttctcaaaccactggaaaaactgaaaaaataatacagtgggcacccatatactcttcacctagaagcaccagttgttaacattttgccacatttgcttatctcactctctgtgtgtgtgtgtgtgtgtgtgtggtgggtctgtttggtgaaactttgaaagttagttatagacatgacatttcacacctaaatacttcaacatgtaacaactaaaaacaaagacatgctactatgtaaccataatatctaatcacacccaagaaatagagcggatgcaattttttttctcatatgcagtccgtgttaggatttctccatttgtcccaataatgtcctttatagctgttttaaaattcagaattcaattaggtgtcatgtctctttaatctcctttaatctagaatagttgcttggccttgttgtcttttatcggcattgcatttttgaggatcccaggccagttgttttgtaaaacgtcccacagtctaaatttgtctgattgtttactcgttcctggattcatattaaacgtttttggaaagggaactcatgggtgatgttgtgtccttccattctgtcacaccaatgtcaatttgttcccttacgctaactttgaccatttgtttcagctggtgtctaccagatctctccactaaaaaggtcccttttccctttttctgagatgaagtctcactgtcacccaggctggagtgcagcagcacgatctcagctcactgcaacctccacctcccaggttcaagcaattattctgcctcatcctcccaagtagctgggattacaggtgcctgacaccatgcccggctaatttttgtatttttagtagagatggagtttcaccatgttggccaggctggttgtgaacccctgagctcaagtgatccatgtgcctcagcctcccaaagtgctgagattacatgtgtgaaccaccatggctggcctcccctttgtatttagtagataacctaaggaatttgaaccatagtcttaaaaaagcaaagttgttcatagtagcattattcataatagccaaaaactaaaaactagtgccaaactgaaaaccacccaaatgcccatcagcgatagaatggatgaattgtggcagcttcacaaaattgaatattagacagtgatgagaatgaacaagctccagttgcatgccacagcatggatggagttcacaaactgagccagacgctacttcataccatatgacccaatgtatagaaaacaccaaaatagccaggcgcggttgctctcgcctgtaatcccagcactttgggagtccaaggcaggtggatcacctgaggtcaggagttcgagaccagcctggccagcatgatgaaaccctgtctctactaaaaatacaaaaattagctgggcatggcggcaggtgcctgtaatctcagctactcaggaagctgaggcaagagaatcacttgaaaccgggaggtggaggttgcagtgagctgagattacaccactgcactccagcctgggtgacaaagagtgaaactccgtcaaaaaaaaaaaaaaaaaaaagaaaaagaaaagaaaaaagaaaataccaaaataaaagacacaactcatctgtgctgtttgcagtcaggagagtggttacctttagtgcgggagaagggtactcagcaaccagggagggtttcaaataaaatttagaaagaacaacaaacagggaagggatctgtaacaaacatggcaactagctcatataaaactatgagaaaaacgcaggaacctgcaatagttttaaggcaacaaagatcaaaatagataagactataaaagatctgaacggagttcaccaagaggaaatgccagtggctaataagccaatggaaaatgtttaaaatcactagcaaaacaatttcacctctcgcaacagtgccaggaaagattgatataataatatgttcaacgtaacattataattaggaaattctatttataagttaaagtaatagctaggaaatgatgaaatgaaacgtgatattatatcatggaataatatacagccattaagatgatttttacgaatatttttaaggacacagaaaaatccctttgctgaaatgttaagtgaaaaaagatccaaaaatgtttgcgtgtggatatgtgcatgtatatttatgtatatatatgtgtattacatgtgtgtgtatatatatgaatagaaatattttggatgtctagataaaattggtagaaaaaccacagtaaaactaaaagactgtactatgctatctactacataatatattatttaacaggggtgattgtagatgaaatttttctgttttaaacatgtctggaggctgggtgtggtgactcctgtctgtaatcccagcactttgggaggctgaggtaagtggatcacttgaggtcgggagtttgagaccagcctgactgacgtggtgaaaccctgtctctactaaaaatacaaaaattagcaaggtgtggtgatgggcacctgtaatctcagctactcgagaggctgaggcaggagaattgcttgaacccagaagatggaggttgcagtgggccgagatcacaccactgcactccaccctgggcaaaagagaaagactccgtctggaaaaataaaaaaacatgtctggaggcgggatgccgtggctcacgcctgtaatctcagcactttgggaggccaggagttgaagaccaccttaggcaacatagcaagaccccatctttacaaaaaataaaaataagaaataaacatgttcgtatcttgggccatggagtggcagcgggcatcttttgcttgtgatcagtcagtcacgtgaccccagcagcatttgtgtcctgttcccagtaccgtcctgtaattggtcagaggatgagcatgtgactcctcactgccagtcagagcctccctggaaggtggtgtttttcagcacagcccgcagatcctcatttgggacttacgtgagggcataggattcctccacgctggtggtcgagggtcagcctccgagattctgcgggagagactctcaagggtcaccagctggagctggttctgtgtctgcagggaaccacctggtgctctctccattaatagccccctaccgcgagttttctcttctttatctttgtgacttagcccagtgttcacagaaggggaggggtggagggttcaaacgctgtcatacacgtttgcttttcgaaaaacaacaggacacaaaattttataaacatgaaatgacagtacctggtacgtgactcgaatgcaactcagaagggtgccagtaagttagggaattggcctttggaaggcttccttctttttaaaaactataatgtttccatataatgtttgtgtaacaaatgagaaatgggagaccccattatcatttactaacggtaaatttacataaagtaagccagggtcagcatcagataattccgtatagcccatattttaaaccttcacattcctccatttcacagataaagaaattgagcctgagaggctaagagacaggatcacaggagcaaggaatgtgatccaggtctggttcctttgcatggtcctctagaaacattatatacattcatctcaaaaatatatatatatgtgatatatatacacacgtatataatatacatattgtgtgtgtatatatacacataatatgtgtgtgtgtatatattatatatatatatatatatatatatatatattttttttttttttttttttttttgagatggagtcttgctctgttgcccaggctggagtacagtggcatgatcttggctcactgcagcctcaatcttctgggctcaagcaatcctcccatctcagactcctgagtaagcaggaccacaggtgtgcaccaccaactgcagctaatttttttttctgtattttatgtagagatgggtttttgccatgttgcccaggctggtctcaaactcctgagctcaagcaatccacctgcctcagcttcccaaagtgctgggattacaggtgtgagccaccgcacctggctttccctgtaaaaaactttatagagatgttttcatgttgtttcataatgttcttctttcattcaggaatatgtcatcaatgtatttctgcccaacacttctactggctacatagggttctgttgtgtgagtggaccataacttatcccctattggacatttaggtcatttctctgtccttttctatttttttttttttttttttgagacggagtcttgctctgttgcccaggctggagtgcagtggtgcgatctcggctcactgcaagctctgcctcccaggttcacaccattctcctgcctcagcctcccaagtagctgggactacaggcgcctgccaccatgcccagctaattttttgtatttttagtagagacggggtttcaccgtgttggccaggattgtcttgatctcctgacctcgtgatccacctgcctcagcctcccaaagtgctgggattacaggcgtgagccaccgcgcccggccccctctctctctttttttaagagacagggtctcattatgttgcccaggctggtcttgaactcctgggctcaagctatcctcctgcctcagccccaaagtgctgtgtttataggtgtgatgccaccatgctgggcaggtcatttctcattgtcactgatagaagtgtcactgtgtacatcgtagcacaccagactccttgctcagacctgaagtcggatgtggatcccagtcagggtgaaaaggtgcttgacctacgtcaacttcatgcctctgaaggcacccacttctttgctgtcagcagtgtctgctccttggcaccaggattggatggttggtctcatccatctggagcctctcgcagaaggatcttctttggtttacttgtttgctcaccctctccaaatgtgctgggtttagtgtcaaactctgcatatatgagttcaagtcccgcagggttaagtttgaaacaaaggacagatgcacaccatatattccctatctctttttaattaccaaatacattaattgtagcaaatacaaagagaagaaaataaaaatcaacagctatctcataagtcagtcataaccactgttaacacctgggtatgtacagttgttctggaaccctgatgtaccccagaattgcttgggactcttgtttacaatctagatattccatcactccgagattctaattcagtagaactgctctagggcccacacaccggcattgcaaataagctccccaggcgatttggacacccaactttaagaacaagaatgcaaaagcgtctttctagacattacttgatttaaaagaaaataaaaatgaagttatactatatattcattttttctttttctttttttttttttttgagacagagtcttgctctatcgcccatgctggagtacagtggcatgatcttggctcactgcaacctccgcctcctgggttcaagtgattctcctgcctcagcctcctgagtagctgggattacaggtgcatgccaccatgcctggctaattttttgtaattttagttgagaaggggtttcactatgttggtcaggctggtctcgaactcctgacctcaggtgatccacccgcctcggcctcctgaagtgctgagattacaagtgtgagctgccgcgccctgccatttttgctttaaaaaaaaaatcagcaatagaatgtgaacttctgtgtctaaataccctttatacatttctgttgtgtgcatagtattccattagacgaatatatttccatttacttagtcaacactatattgttggacattagttgctcccccatcattgctattgtaaataatgctgtgtggctaaatctttgtatacattcttagttctttccttaagttaaattcctaggaaatgaattctggggtgaaagttttcattcttttgaaggtttttgatagatgctgccaatttttccagcaaaaaggttgccccactggggctgctactcccatgagctccctttgtgaggagccgtgaggtgagatcttcccatccatgatctcagccatccctgccaactacccagcgggcagcacgaggtacctgctcagtggtacctgctaagtgctcagtaattggtctacgcagtggacaggaggagtgttttcttcactgaccagaggaggacactgagagtggaggggtcaagtgactcgctcaggaactgggactcaaagccagctttgaatctagagcctgagttctcttcaccaccccatcaatttttaattgatattagagagggaagaacaggccgggcatagtggctcacgcctgctatcccagcactttgagaggcccaggcgggcggatcacttgaggtcaggagttcgagaccagcctggccaacatggcgaaaccccatctctactaaaaatacaaaaataagctgggtgtgatggcacacgcctgtaatcccagctactcaggaggctgagacaggagaatcacttgaacccgggaggcggaggttgcgtgactgcgcaagggtcctggtgagggtcccaggtcaactcctcccgtcccagtgtctgccaggccaaggggtgtgggcgctgccccacctctttccacactttcccttccagctgcgttgtgagtgacctcattttccctttacagctgcccttggagtttatttctgcagaaccggaatgtggctgaaagagtgcacaccctatctgccctgccctagcccttccagagagccccctacttttccctgacacaccctcctcttctccttgcatctccctcctgggagacctgaggaggggtccagagttcaaagacagaaacatatggtggtggcaagggactgggcacccatgggaattggggtcgggggaggactttgcatctggaccgtgggtttatttttcttttaattcttctgaagagcagcttaaacactggagtccttggccgtatttcctcttatcgtttcttcttatccagattgcagtgtctgctaagcctggttcccaggctctccgctgtgaaacacaaacagattcttgagctcgctgcccaaaactgggcagaggttcttgcttaaatatcaaaagcagtaatggccttccattactctgtgctccccaggtacagagggacaggaagccttctctccctttgtcctcccagaaacccaggagacaggtcttattcgtgtccttcccaaatcgaggcttgcggaagtgaggcagccaatcccagggcccaagggcccaagcagaggtgcgaacctgggtaggtccacattctagagctgccctcccaagccctccaccatggtgcctcctggaggtgggggcaggcccggctgatctgtcgtcacagaagttggcaggtgctcaatctttggctagaattttaaagggagatcttgaaggttcccaagcaagaaggattctaaattcacttgactttaaagagtgccatttgggcgcagtggctcatgcctgtaatcccagcactttgggaggctgaggcagatggatcacttgaggtcgggagttcaagaccaacctggccaacatggcgaaaccccgtctctactaaaaatacaaaaattagcgaggcatggtggtgggcgcctgtaatcccagctacctgggtggctgaggcaggagaatcccttgaacccaggaggtgaaggctgcagtgagccaagatttcatcactgcactccagcctgcgtgacagagagagactctgtctcaaaaagagtgccgtgccttgcttttagaaccaaacaagtgatctttgaatgttgccatgtcaggagggcagggaattgccaatgtgtggagcaacagctcattaggaaacgtgccttgatttctcagtcatattgtgctgtgcttcaaatgtgtctcatgtctcctatgcagcgtgtcacagtgtcatttgacatcaatcatgttggcagggcagcagaccccccccgccccaccgatacatacattttttgttttgttttattttgaaatagatacagccttcttgtcattcttttttttttttaattttttttaaaatttttttgagacaagagtgtcgctctattgctgaggttggagtggcactatctcggctcactgcaacctccgcctccagggttcaagtgattctcctgcctcagcctcctgagtagctgggactacaggcacccgccaccacacccggctaagttttgtatttttagtagagacggtgtctcaccatgttggccaggctggcctcgaactcttggcctcaagtgatctgcctgcctctgcctcccaaaatgctgggatcacaggcatgagccaccatgcttggccgtcattcttaatagacaccaggatactgaaaaatgctttgccactcagaaaaacaagggtacaagcatgatactatatggccactctcattccacttcagtgtgtgtgtatggtgggggcacaaaagggatgggtggagactgtggcaaaccggtgagcccacacccctcccaggtgggcagctgcaccagctcttgtggctggcaccctgcaggcatgctgcctcgactggaaatctacatttttatgtgtaatctctctcacacatcctgaagccaaacacaacttgcctgtgggctatcatctaaaattcggaggctagctggagtccgctctggaataagtctgcctggccatccttcccagctcttccccttattaactgtgttatcaagatgttaatctctcagttatttaatacctcagtttcctcatctgtcaagtgcagatcagaattttgcctacatctgagggttgttataaggattaatgaaaagccttggaacccactgtctggtgcctggacgcgcatggttaatgcctggcattctttgtgtctctttttacaagcgcagggtgaccacaggtcccagtttgccgggggcaggcctggttcatgcttgtggtgctggtgtaatgatcactaacttgccatttcattgtcggtattgacgtaaatgatatgatttgcctagagaagcaaatactggcacagtgctgtttaggactctgatgaggtttagacctaatagaaaggccatggtccaggttccttgaacatccctggacaagtcacttaacctttctgtgttcagtttcccgttctaaacgattggcaagatgaattctaagatccctccattcacagtcattctgtcatttgacaaacatctttttttttttttttttaaacgcagtctcgctctgtcgccaggctggagtgcagtagtgcgatctcggctcactgcaacctccgcctcctgggttcaagcaattcttctgcctcagcctcccaagtagctgggactacaggcgaacgccaccacgcccagcaaatttttgtacttttagtagagacagggtttcaccatgttggccagaatggtctctatctcttgacctcgtgatccacccacctcggcctcccagagtgctgggattacaggcgtgagccactgcgcccggccgacaaacatctttcacaagctcagactcatgccaggcaaaggtccagggcatggagaagccaggggcagagcctgggtcctcagtgggcacttggccagtgaaaacctccagtgcaggttgttgggaatctctaccttttttgtcaagtgttacttgaaagaccattaccaagaaattgaattgaaagttaatttttttctccttctttacggagacgagtttcactctgtcccccaggctagagtgcagtggtgcgatctgggctcactgtaacctcctcctcccgggttcaagcaattctcctgcctcagtctcctcaggcatacaccaccacatctgccaccatacccagctaatttttgtatttttattagagatggagtttcaccatgttggccaggctggtctcaaactcctggccttaagtgatccacctgcctcggcctcccaaaatgctggaattaaaggcgtgagccaccgcgccctgcctgactgttaatattttaaacctcagtttctcaggaactaatcattctggttgaatacattttgctacacatttcttttgtttgtgggggggtatctaagttgtttttttcttttaagtcagaaaacataaattttcactatggaaaattgtaaattacagaaaggcccaaagattttcttcatttctgctgactcttcaatgaaccagaggggcacgtgtaatatttccgctttcggttactccccaccccacacaccttgtagacactttgtcaaaactacattttaaaaaaatgctttcccccaaattcgtatggatgtctcctaataaagtcacgcagtcactcactggttcgtcctcaatcaaccaggcgtggagtcctaacctgtccatgattttaagaaagggcaggcgcacaacacccccgcacggagaaatgaacaggtgtggctcggcagaggccttccgcacctgcgttatggagtggtggccgctgtcggcgatggggtccccgcgagggcacaagtgatcgcgtggccacggcgaggctctgcctccgcccccgcgctccgggtcccattcccgaattctgccctcagcggcctggtcaatgaggttggatcgttggcccagaaagccacttcctgccgcgactggagccagccgtcgttgtgaaaattccccccacggggaaggaagtggctcttgggctgtttattttggctgcgggctagcagacggcgccaggggcagcggccacgcagaccgggcatttgtctagctgggcgggaggcggcggagcgggaagtgccacagattgaggggcgcacggcggtggagggaggggcgcccagtggagagggggctcacggtgacagaggaagtggcgccgcttgggggggtgcacgatggcagggggaggggtgctcggtggagggaggggcacacggtggcggggggaggggcgtgccgcagattgagggcgaacggtggcttggggaggggcgctccttggagttgggggcgcacgatggcgggggcaggggtgccccttgggagcagaagcagagaagactcggaactccaagagcaggtggatctgggagccccagatcctgggcactgggttgggggagaaaggggtcaaggtgtgcccgcccccgggatgctcggactctggggatccaggcctggtgacccccggtgaggaagagccagtgggaggaaagggccgggcgctgcccggagcagaggctggaggcgagagcgattgctgcttgctgtagcgcggccgctctccagttcctccggcaaggggggcctgggggaggactggccgaaaatactgtgatgctttggtctaagacaaaagccagcaggggatgagatcaaacaccatgacactgcgaaggggaaggccagcgcgggtgaggatttgccttcccagagaaccccaggggcggggctagcttccactcagcccgcattacccccacccccgcccccacccccggggcggggtctggaggatcagcaaaaccgcgggaaaggtgacagtcgccttccccaccaccgcctgcatttagtaggtggagggacagtcccacctctccacccattccctgccagagtgtgatttaatgtcttcctagaacacaggatatcacagtctgcagcacagagatttgaagtggggagaaaagcatctctggaaatgactggtgggggaagcccgccactgctctacaaagggtggcctgtgacagcaacagcgcaacactgggactgtgtgtgtaggttttaggcacaagcactttaagctgtgggaggaaagcagtttggcctggctgggatggaggggctgttggggaggagggaggagggtgtgaaaaggggaaggtggccggtagagggaaacccaccatggttcaggatgtcggtggggatgttgcacagttgggcggggtattgggcttcgatatcatgtaacccccgtcctccatggaagcaatgcccccctcgtccagcccaggatctaatgtgcatgcatgtacgtggacacagtctctagccaggggtggtgcagggtggggtgctgggtccccagggttggcctcttagcagggtggggctggcagcttctgctgactcaaggacatttccaggcctggcctggaggttaagcagctcattgaaaacagctgctcctcttggctggcggccctttcaggcggcctctggctctccctgggatgacccctcgcctctgcgtggcctggggaggggcagtgaagggagagaggctcagaggctggaggccaccctgccatgccctcagggatggaactgagtcccctccagggctggccagctgtcctccagcccccagctttccaggagctaagccaggtggtcgctgggccctgcgttcctgcctgcagcctttgctcctgcggttgggcagcttggaccgccttccttgtccttggaatgccttccttgtccttgtctctgcttgtgcctttcagggttttatgtgacatgcctctcattcaacacatatttgttgagagtccgctgcatgccaggcaccatgctagaattaacttctcatctgcctccttcatctgtgatgtcttgtggagagcagccgtcttatctgaggtcagacctctggctgcctctgtggatgggctgagtccggggaaactgcagcaacagctgagggttttgctccagagacacaaactgttgtcaagcctttgcactcagcctcgcgacttcaccaaagcattgtgtgccttgaagcagacaggacgggagaggaggcctcagtgaccatcaaggaggaaggagatgggttactcaatgtagggcaaattgctttaaaacccagttgcccatgagcacaggcatgtttcccaggtgatgacctggatgtctgagaaacaagaagtgtggactacatcagaaatattcctatcaaactagacacggtggctcacacctagaaatcctgcactttggaaggccaaggtaggaggatcaggaggttggggccaggagttcaagatcagcttgggcaacaaagcaagactccgtctctacaaaaagtaaaaacaattagctggggctgcgtgcggtggctcacacctgtaatcccagcactttgggaggccgaggcaggcggatcacgaggtcaggagatcgagaccatcctggctaatgcggtgaaaccctgtctctactataaatacaaaaaaattagccgggcgtggtggcgggcgcctgtagtcccagctactcgggaggctgaggcaggagaatggcatgaaccccaggggtggagcctgcagtgagtggagatcgctccactgcactccaggctgggcaacagagcagactccgtctcaaacacaaacactttgggaggccaaggtgggtagatcacgaggtcaggagattgagaccatcctggctaacatggtgaaaccccgtttctactaaaaatacaaaaaaattagccgggcatggtggcgggcgcctgtagtcccagctactcgggaggctgaggcaggagaatggtgtgaaccctggaggaggagcttgcagtgagccgagatcgcgccactgcactccagcctgggcaacagagcgagactccatctcaaaacaaacaaacaaacaaacaacaattagctgggcatggtggggtgcatgcctatagtcccagttattctgggggcttaggtgggaggatcacttgagcccaggaattcaaggctgcagtgagctatgatcatgccactgcactccagcctggacaacagaacgaaactctgtctctttaaaaaaaaaaaaaaaaagaaaaagaaaagaaaaaaagaaagaaagaaatatttctatcacacttcatttatctggaaagttcatttctatctatcaccttcacccccaaccgtgcagacttaaacttttccatggattgcttcatgagttcagcctctccagcttcattataaacgcatgagggcagaggctgtatcttcttttgattcctaggctggaatgcagtggcgtgattatagctcactactgcctcagactcctcggctcagttattcctcctgcctcagactcccgagtagctgggaccacaggcacatgccaccacacctggctaatttttttttgagatggaacatcactctgttgccaggttggagtacagtggtgcaatctcagctcactgcaacctccgcctcctgggttcaagcgattctcctacctcagcctcctgagtagttgggattacaggtgtgcgccaccatgccccgctaatttttgtacttttagtagagatggagtttcaccatgttggccaggctggtctcaaactcctgacctcgtgattcacccgcctcggcctcccaaagtgctgggattacaggtgtgagccaccacgcccagcctacacctggctaatttttaaatttttttgtagagacgggatctcaccatgttacctaggcttgtcttgaactcctgggctcaaacgatcttcccaccttagcctttcaaagtgcagggattacaggcatgagccactgtgcccagcatctggttcatttttaatttcccttacagtgcttcataaatgattatcatctgtatgggataagaaagcccccaagggagcagccagaaggatgattaggagaatgggctgagggtccagcctccaggcacctcctctgacatggccttggtgctgcagccgacccaagaggctggtctgacaggtcagaggaggtcctagagcagtaacctcccaggaaataaggagaatgggacagaaacccaatgcagacaagctaattaaaaaaggaatgcaggagcccagctggctgcagatgatcctgagtgtttcacagaatggaggaaagagcctcagggattcagggacaggacatccagcatctttgggactcacttcctctctttccatctctttgtcccgtttcactctgcttctctttatatattatcccctcatcgtaggaagcatggccattggcagccccagcctagcaatcttaacaaaaagggaaagctttatgtgttccaggggagttctctgatcagccctgtttgagttatgtgccccatcactgtggccaaggggatagacactgtcatcagctcaagagtgagccttgtgcccacccacacatccacatagccagaggtacacaatacaaggagaacaagaaggggatgggaagtttcctgggcagataaaggcagctcaatgaggtcacagattgttatcgttgccatgtcttcattgtagagcccagcgccctgccagaccatatggtgataagggctgggatcatgtctatattgttcacaataccctcagtgcctgatgccctgctggcatctatgaaattctcaatacatcattgttggatgaatgaatgaataaatgaatgaatcacacccagccagtgctcagtgcacagctccctgcctagcttcattcatttctccatttactcagtaagaacatattgagccacagcttgatgcgtagcactgtgctaggcatgggttgattgcctacaaaatgcaagaagtggtctttgtccttggggaggagaatcccaagatccttgtgaggggccctgcaccttctgtggggggcacttttgctccctgcactgacacctgatgctcccatgcatatggatgaggctggggggtgggtgaggctggaggggccctctctggatgggggtggggggcatcaggcctctgcactctgagctccctctgcccgctttgtatgtgcttgatgaagcacgggtacaaagaacacagagccagctctcaggacgccttttctctttccccagcagttccagcccagcctgagcgtgcactccccctccactaggccttggagaaagagcctcttttcattgagggcccaggcccaccggccacttcgggtggaaaatgctctcaagaaccccctgaccccggcttggcagagtccccccggatccacctacaggaatcccccctcagcttctcctttgctttgcagagctcctgcacgcctctcctctgctttttgattcctcagccttttctcatttgctgccaaatgagaaaatgcaagaggttgcctttgtcctcttttgctgccaaatgagaaaatgtgacctgtgttcttcagtgcctcctccacattgcagtcttcagatctctgcccagcggagtctctcggcccttgggaggcacagagctccttgtaacgcccccagacacctgggattttaaaggtttgtttgctcttatgcccggcatttctcctctaactggattacaaatcctgcgaggggagggacggtgctgcgagtttccttgtggtcccagcattgcctggaacatgccatgcacctagcagaaagttgggtggatttgaacccagagcctaggatgtcagagggaggaggggccttgaagctgtgcctcatgtgacaaaggaggaaactgaggcctgaaaggtacttctgttggacattctaatcccgtcccctttctggacttcagtttcctctgtcaagtgaggggaggttggcctgaccctgggaaaagcccctcccgactaacctggacctctttcagacccttcattcaccgtttgctacaactgctacagcccacctggcattgatttagcacacttgtggattttctggctggggaggagaggaagataacgtcctcttgggctattgtgggctcacgtgaagttttgggcttcgttttccagtcgtatctctgagaaacatctacaaaacaagcaataatttttttccttttccggccccaggcccctttggctacctcctgccaaggccattttctgttactactgcctggagtagagtttctgagaaccagatacctactccttaaaggaagcttgggcaggcatggatcaagtcctggagctggtttctggtttctggtgggtggctgaaaggtgacctagtctgtttgggttgttataacacaataccgttaacagatggcttgtaaacaatagaaatgtatttctcatggctttggaggctgagaagtctaagatcaaggttcctgccgattcaatgtctggtgagggccacttcctcgtggacagctgtcttctcactgtaccctcacatggtggaataggtgagggtctctctggggtgtcttttattaggacgctcatcctatccatgaaggctcttccctaatgacctaagcacctcccaaaggtctcacatcctaatgccatcaccatgggggtttaagatttcaacacaggccgggcgtggtggctcactcttgtaatcctagtactctgggaggccaaggtgggaggctcacctgaggtcaggagtttgagaccagcctggccaacatggtgaaactgcgtctgtactaaaaatacaaaaattagctgagcatggtgacgcaggcctgtagttccagctacttgggaggctgctgaggcagaagaatcgcttgaaccggggaggcggaggttgcagcagtgagcagagatcgcgccactgcactccagctggggcaacagagcgagactctgtatcaaaaaaaaaaaaaaagctttcagcacatgaatttttggaggttgacacattctgttcatggcaggagggaaggagcaggttcaaggcaggggacccagagattagctgtggcagttgtcctaggggtactttaggaagctcactttgtcctgcccagagaggaaccccatccaagtgctgttagaggacagaggggcagggtccctgccccaacctacattcccatggtggtgttttgagcatcagtgacaggagctgtgggtactatgttttaggaaaattaatctggctgttggaacaaggagcagaaagataggctggttgtttgtgattattatctaggcatgaaattcgttcattcatgcatgtgttcatttgttccttcagtatttaagcatcactgtgtgtcaggcagaactgtaggtgctggggttacagtggtggagaagacagaaaacaagagtgtcagatagcgagttctggttctggaagtggcagagtagcttgtgtcagtctaactctctggccaagaatgcttttagactaagggaaaattataaaatatggtgattatggtgatttgaaggcaatgaacagcaattaaaaccagacagaggtagagaggaaaaaatccttgaaagtaaaaagtaaacctggcacatttaaccagcttttccctgaacacactacctggtttgaggagctcatacagaaagtggcagttttaccggttagagcttggggccactagaaaggctaacattgagaggaaatgttaggaaagcaaggagccatagaaattccttctacagattctccttaaatccttggtgactcctgaactgtgcatttgcagggtagggttctaagcagcccagcaagaaacagcagctgggaggtagaggtttcagttgctatctggtgctgaggaaacagagtttaaaatttaagttccaccaagtttgaggggcttagtaatcacctaaggttttcttttgaaatcccagaagggcctcaccttatgattaaatccaaggttaagagccacatctgaagactaaaggcaaaactcaaacaaccccaccctagcaaagcttaaaaccaaacctccacaagagcaaggtaatccactggtaatttaactgcctgccataacaaaatccagcattctttagaggaagatttttttaaaatccagattccctttaacatagcatccctgacgttcagtatacaacaaaaaagtccagactccttatgacattatccacaatgtccagcatataataaaaatttgcagatagtaggcagcaggagatgacccataatcaaaagaaaaaacagtcaatagatgcagatgcacagacaacccagatggtgaaaaaaatcagataataaatgccatgaagagcattataatcaagtgatatgatagagagtaactgtggtcactttacgattgggaggccaggaggatctctctaaagatgttacccttttttgttgtttgaaatgtgaaatgccaggtagaggaaataatgcataggcccagagataggaaacagccaggcttgttcaaggaagaacaaggaggtcaaagcgacttgagcaaggtggagtaacaagatttgagatcaggccgttagacaggaccagatcatgttaaattgtggctcatagtaagaggctgaatctcatttgaagaatgatgaattatctttgaagtaattcaagcaggaggaagacttacctgccttctgttgttgttgtttttttcccttttactatgagcgaggctgtcatttcaaatatttaagaggcaattgcattttcttcttttgctgtctatgcatatctcttcttcattttctactgcattgttgatactttccctaagtttcatgtatctatttttttggtagaagctcttctttcttttcttttctttccttccttcctttctttcttttctttctttctttctctttctttttctttctttctctttctttctttctccttccttccttcattccttccttccttccttccttccttccttccttccttctttcttaagactagtaaagtcagaaaggaggaaagagtagaacaaagactttggtctgtaactgactatgaacaaccaattgagataactcaccatctttggaccagccagaggctcttttaatattgtggacttaactatttgcctctaataaggcacatatatttttgtcatttatttgaattttgaccttgctgatggcatcatatgttggcattaaaaaaatctttttatgggaaaaaagttcttatgctattgaattcatcagtgttgtctatgaccttcaacattccaataatatttttaaattttttctaggactgatttatatctttaaaagattattctaggccaggtgcggtggctcatgcctgtaatcctagcactttgggagtctgaggagggcagattccctgagctcaggagtttgagatcagactgggcaacatggagaaacactgtctctactaaaaatacaaaaaaattagccaggcatggtggcatgtgcctgtagtcccagctactcgggaggctgagacagaagaatcgcttgaacctgggaggcagaagttgcagtgagccaagattgcgccactgcactctagcctgggtgacagagcgggactctgtctcaaaaaaaaaaaaaatagattattctgactgtctttggagaatggactataataggatgatgagatcagcatcggggaagagagagaacttgagatttggacccaggagatgagggccacatttcagctccttcccttaacaatcttacgactcttgtcatcaaattgcttcaccaccctcagccaatttctttaccaataacatagcataatgctgatttatagtcttcttactgtgccagatcctgttccaaatgctttacatgtattatctcatttcatcgttaccagagtcttaagatgaggaaacggcatagagagatgaagcactttgcccaagtcccatattcagtggcagacctagaatcgaagcactagctgccgggcacggtggctcatgcctgtaatcccagcactttgggagaccaaggtgggcggatcacccgaggttgggagtttgagaccaccctgaccaacatggagaaatctcatctctactaaaaatacaaaaaaattagccaggtgtggtggtgcatgcctgtaatcccagctactcaggaggctgaggcagaattgcttgaacccaggaggcagaggttgcagtgagccgagatcgagccattgcactccagcctgggcaacacgagcaatagtccgtctcaaaaaagaaacaaaaaaaagaaacaaaagaaaataaacactagcagtcggattcatcatttcaacacatgaaaagtatcctggggagctagtggctagtggatgcaaaagttctttggagattggatgtactccatatgtgtgttgtgtacataagtggcagtcagggaacaagaggaaggtgatggatgtcacagagatctgggtttgcttactgggcgtgggacactgggagtaggtcacttcatgtctctaagactctgtctgtcttttcttaccttccttccctccctccctccctccctcattccctccttcctaccatccatccctccctccctccttcctccctagtttcttcctttctttctctttcctccttcctaccctcccttgctccttcctttctttttcttcactgaaacataactcacatatagaatttacccatttaaaacatatatttaattgggatttagttttttcacagcattgtgcaactatcatgacaatctaattttagaacattttcgtcatatccccaaaagaagcaccgtgccctttagcagccactcccctttctcgtcacccacaggcaaccattaatttgctttctgtctctatgcattgaagcttcatttcttactctgtaaagtgggtgtgctgtggtggggggcaggttggatttcccccagtgacttctacagagggtgcctgctcagcgaggagataggtggaaagaggaaaggttgaggaagccaaagaattaaattgctgcgtaaaaattaaggcgtgaaatagttcaggggtgggatgagtggtctgggaagatcctagaagaaggaaaggatggaaccagtgcaaggggcagggggaagggtgagacacaatgcctccggatcaaaggagaattttggcagaaaaaccacgccatgtaatagagattgagattgaggttgcaacgtggtgtgtggtgtaaatgcctccactcctcctcataaaatcttcagaaaagtatacaggtgatgtgccgggtggagttgggtttgctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgggtttgcttttgagggtggtacagaggactgagtcctccctcctggtgagcaggggctagaacagaggtagtcctgcaggcctctgcctcatctgggcacaagggcttagcactgccactcatttccacctcagagggttggtagtgagtaccgagtgatttaacgtatgagtgacggctcaccatcctgcactgggcacatggtaggtgcctgtcagccacaccggtcatcaagggccaaccaggagagcccctgtgatgccttcgtgtcttgccttcccttccagaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacggtgaggggccgcttgcaggcgggagggtggggtccccgatgtccaggggactggagccatgagggacagattcccagtgacaaggcctttggcctctgtggacccttggcagtcacatgtttaattataataggaagcattttttaataattaagaaaattaacttcaggccaggtgcggtggctcacgcctgtaatcccagcactttgggaggccaaggtgggtggatcacttgaggtcaggagttcaagaccagcctggccaacatggaaaaaccccatctctactaaaaattcaaaaattagccaggtgtggtggagcatgcccatcatagtcccagctacttgggaggctgaggaaggagaatcgcttgaacccaggaggcagaggttgcactgagctgagattgcgccactgcactgtgcagcctgggtgacagagcaagactctgtccccccccccacaaaaaaaaaaagaaaagaaaagaaaaaagaaaaattaacttcaaagcatttaatttacttttgtaaaaattgcaaaatacatgcttgtaaagtcttcaaatagtatacaagtatataacataaaattaaatgaaaattcccttcccccaggcccactctccaggtgaaaccccattgtagccccccatgttgtcttaatgcctgtcttgcatgtggtgaatggggaccagagtcaccatgtgaggggctggcctcttgtggtggacagccccgtcctgggggggcctttcctgggagaccccctgagttccgagatagaactttgtggggacacagagcccatgggctgggtagctgagcagagattccaccgggctcagccctctgtgggtgacttggaggccctcttgcccagctggagtttggatgggattaggggtactagggagccccttcccagccctatgaggtgtgcagcaagacctctctctggttcctgggctgactcaacagcagaagaagccttaaagccactatggggtgccattgcctctcccacctgctgatccctgtgaacacccagcactctgggttttaggggatttctcctgagggtcgaggggcttggcagcctctggtgtccagatgccaagggcctggcccctgtccaccccctgcagaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtgagagctgttggagccgtgggggcgggggcagtgttcctggagggaggctggtgctgaggggccccggggcccagggtgagatactgccccctcccctacctagtgtagccttttggtgggggagggtctgcactcccgagggaccctggagggggcctgaaggagagggctgtcgtggtggcaggtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggtgagccggggcctgatgcctgctcgtgcctctggagggcccgggccctttccgcttgtgggttggggagagggcgatggggagcgggggaggctggggctggggatcccctgttcagtgtccctccttgctgtcaggcctcctcactgggtacagctccaccctgtggatcggcttgaatgacttggacacgagcggaggctggcagtggtcggacaactcgcccctcaagtacctcaactgggagagtggtgaggcacaaggttgggggcgcagggcagcataggggccccgcgggctcttggcctcccatggactcctctcctcatgtcctcctgcagaggggcagtgtgggtaggggaagcaccgacctccacccccctccccagactgcgcccccctagcccatgtagggcggcgctgccccaggccgaaggtcttggtgcatatggactgggtgccagcctccactcacctcttcagccacccctgtgggcagcgggcaccagcgcacccagcagcctggacggggaggccggggcggggctggtactggttactgggtagaaggttcaaggcgacgtgcacccaggttagaaagcgcggaggaccccgtggtctggggcggagctggagctgagcaccaggcttcccgaactggctcaggcttccgagggagcagagggaggtaggaggttctgagcagggccccgggagccacggtgtgagcttctctctccgggggtgctggcgccctgccctccccacagaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccaggtgagccagggactgtgccgcagggtggggaggggctcccagggccagggacacagccacagagccgtggcaggcccagcctctcctccggttaccaccacagcacaaggggactctggatcctctgactcttatttcattgttcagttaaagtctgagcaaattggaatatgtcattaattcatttggggaacatgtgctgagatctgtgttaaatgctggcaatacccactgttacctcgtagagaccacagtctgctggaggtgacagacatctcaatgcagttagactatcccaggtcatgagtgattatagaaatatggatcagtgttagaggagcatagagaagaaactgattcagcttctgagagttaaggaggggtttatggaaataacatttgatttgggcctttcaaattgagtctaagtttaaaagatataaagaggtgtgggggaagggcattcctggcagagggaagagcatatgcaaaggtgtggaggcctagaactacactgcagctttaaggggtggtgagtgatggccgggcaccgtggctcacacctataatcccagcactttgggaggccaaggcaggaggattgcttgagctcagtagttcaagaccagcctgggcaacatagcgagaccctgtctctgcaaaatatttttaaaaaattagctgagtgtggtgatgcacgcctgtctactagggaggtcgaggtgggaggattgcttgagcctgcaaggttgaggctgcagtgagcctcgcttgcaccactgcactccaacctgggcaacagagcgagacgagaccctgcctcaaaaaataaataaataaataaataaataaatttaaaaaaaaaaagaaaaaagaaagaaaaagaaaaaaatggatggtgcctgttgcagtttgggtggagtatagattctaaccacttcaagtatggtcatccaaccagcagcacagcatccccggagggcttgttagaaatgcacagtcaggcccgccccagagtaattgaatcagaacctgcatttaacaagatcctcagatgattcatgtgcagacacagtttgggaagccctggcttaaagggcatggtgaagaagaggcaggttgcagccagtctctgcagggtcttggctgctgggccaagtttgggtggggccaggtaggctgtggggagcctttgaagatgtttaagccagggagtgtctggttctcgtttgtgatcatagagacagctttaggggcctcgtggaggagttggggcaatggacagggtctgctttagggattctgccccttactgctgtgtggccctgggcaagcagcttagtctctggggtgcagagtcctcattgcaaatggagaatgaagccaccccccttgcaaggttgttgtgaggaaggctggagatctggcctggcacgaaggagtttttctgtagttggctgtggatgtttactgtggtgtaggttggaggggctgtgcagtttcctgcgaagctgtggggtggtgaggagacttttacaaagaaaatatggcaacacacacacacacacacacacacacacacacacacacacaacactaactacagacagtaaagagtttacagagcaaaacttctgctcctgaccatggaagtcttgccaatgatcgactcaggactggtttttttgtttgtttgtttgagacagggtctcactctgtcacccaggctggagtgtagtggtgcgatcttggctcaccacaacctctgcctcctaggctcaagagattctcgtgcctcagcctcctgagtagctgggattacaggcgggcatcactacttcccggctaacttttgtatttttagtagagacggggtttcaccatgttggccaggctggtcttgaactcctgacctcaggtgatctgcccacctcggcctcccaaagtgctgggattacaggcgtgagccaccgcaccccgcctttttatttttatttttatttatttattttttgaaacagagtctcgctctgtcgcccaggctggagtgcagtggcacaatctccactcactgcaacctccgcctcccaggttcaagcgattctcatctccaggttcaagcgattctcatgctccagcctcccgagtagctgggattataggcatgagtgtgccaccacgcccggctaatttttttgtatttttagagatggggtttcaccatgttgcccaggctggtctcgaactcctgtcttcaagtgattcacccgcctcggcctcccaaagtgctggaattacaggcgtgagccacggctctggcctgattcaggactgctgaccactgctttatctcccattccgtaaggggccaggagcagaagcttgaaacgtcagcaacccgatctagggcacctccacctctagctggagggagccttgggccctagtccagtcctcccacaagcacctttctgaaggaaggggcccgctgggaggcccgggtgtgggcatgcctagcctatctgtggccccttaccaagtcctctgtcctctgggtcttcccggacctgcagacagatgtaaggcctcggatttccgcccctctgcccagcccatatctctctgcacgaggcatattctaggcaggttctgctttcccggtctcatcacttaagtcctgtcatttcgaaggcaggcgccccgtcgtgtccccaaagcatccacatttcccaagctcccttccggtccttgaggcccctcgggtctcagcagccactaaaatccgcttgtctggggcggcagcctcaggtcttagctcattggctaacaagagatgattgacaggtcctgagccagagagcgagcccaccgggctctcagtccgcccagctttgccgggtctccaggagcaggtgtggctggaccactggaatcccagtctgaggccgtgttctagtgggcgcgcagtttcctgcccgactaggcagaatcctgcccgagcatgacactgtgggtggtttggtgaagtcctgttttctcttgccaagaccaagtaagggcttgtttgcctcagctgccctcggatcccaacccctagaaggtgaacctgaaaggcatggaaatcggggcaagggagggcctgggacgggtggatttctcagccctggggttcagggttaggagttaggagcggggaaggagtcccagctgggggatggggccgatctgtagtgactttgagcacctcctaatgttctcggttgcccgtccaccaagacctcagattcctggtgggcttgcctgggccccattagtggctcaaggtcccgtttcccagttttctccctcctgggcttcccagacctgcacagagtgggtgctcaataaatgttatttgagagaataacagtgattccatttactaggcagggggccataagccaagcttgaatctcatagcaggaaaccccatttacagagggagaaactgaggttcatggggctggtttgtcctttctacccatcgtttattgactgattgattgatgcattgattgagataaggtcttgctgtgtcgcccaggctggagtttagtggtgcaatcatggctcactgcagccttgacctccccgggtcaagtgatcctcccacctcagcctcctgagtagcgggaccacaggcgcacatcaccatgcctggctaattttttattttttatagagatggggtctcccctttgttgcccagtctgttcttgaactactgggctcaagcaatcctccagccttagccttccaaagtgctgggattacaggcctgagccaccatgcctggcccacccatcgtattctgagagccacagccagaggaagtgttctgtcctgggtggaatctgccaccacgacttgggtctctgtcccggggctccagcagccctgtaaagttttgtgtttttttagcatttccaagacctgtggtggggaccgggattgatctgggagagtttggagaggaggtgactgggaggcctcgcctgtgttgacgtcaacccagtgggttggttcccagactgggcggctcagtccctgagcagcagcctcatgggtctctgcagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaaggtgaggagctgcccgcccacgtgtctgggtggagggcagggcctcccactgccccacccatcctgtccaggagcctcagagaatgttccttcctccctactggtggctgaggctgacctctcaatgttttctctcccctcctctcctgctgcacccccagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggtgagatctccctctccctatcacagggccacaaaatacacccccaacctccaggtgccaccccagctgaaggacatcctagttactatcagaacctgcctggaacctcttacctctcagcagtccccctcctccccaccaatgccttcccttccatgtgagagactgccggggcttgaatcctacctccacctccacctccaagtagccaagtcaccttgggcaagttactagagggtcactggggagatcagaggagttaattctcgtgaaaccttaggcacagtgcctggcgcattcttggtctcctcccagctgcccttccctgccagaaggtggcatcagaacccacattatgtgcagatactttgcaagcagggctgcactctgccagccctcgcccccagtgctctacccagtccagggtcctgtcatctcaagagattgttgggttttatgacaatttgccatggtttgggcttagatgtggtgtaagtgaaggaattgatggagggcttcaagcagagatgaaagacccttaaaaaagggacaaagccagctgagtgtggtggctcatgcctataatcccagcacattgggaggctgaggcaggcggatcacttgaggtgaggagttcgagaccagcctggccaacatggtgaaaccccatctctactaaaaatacaaaaattagccaggcgtggtggcagatgcctgtaatcccagctactccagaggctgaggcaagagaatcgcttgaacctggaaggcagaggctgcagtgagctgagattgcaccactgcactccagcctgggtgacagagcaagaccctgtctcaaaaaaaaaaaaataaaataaaaaggagaaagccgtagggacacagaccacccttcctagggacagacaggatgttctgctgtcacatactgcaaacagtgctgtggactgtagtggcagtcatttgccttaggggatgctatttaagaattttaaaacaattatgtattgagtatctaccatgtgccagtcatttttctgggtgctaggatacacaaacacgcctgccctcagaatggagcttagagacagacatactgctggctgggggcctgtggatactggggagggcgaagacagaagcaggggccgaggactaaattcctcctcagcttcatcagctgagattctggtctgggcacactggcctctgcacactctggccctgcaggcactagctagacgccttgggaatccaagctgtctatcctgccatcagttactctaacaatcttagccagtttgtttttgatatttataaaacgagttatcaataatgtaaaaggacgcctttcctttttttttttttttttttgagatggagtttcaccctgtcgcccaggctggagtgcaatggcacgatcttggctcactggaacctctgcctcccaggttcaagcgattcttctgcctgagcctcccaaatagctgggattacaggcatgcaccaccacaaccggctaactttttgtattttcagtagagatggggtttcaccatgttggccaggctggtcttgaactcttgacctcaagtgatccgcccacctcggcctcccaaaatgctgggattacaggcatgagccaccgcgccgggccaggatgcctttcccatttagacaatgcttgttaagtttcaaggcgtttgcacatgaactgcttgtgctctcatccaccctgtgaggcttatgggttcatcccgccttccccattgcacagctgggacacagacatgtcagaatcacacagtaagtcagagacagggccagctctaggaaccagattccaagaaggatttgggagatttatggggaggtgggggttgagattcttcctcaccctgtgtccgtaggaaggccgctggaacgacagtccctgtaaccagtccttgccatccatctgcaagaaggcaggccagctgagccagggggccgccgaggaggaccatggctgccggaaggtgagggtgtttctggagctgccctgagtggggccacctgtcagaggggctaccaggggagggagaggtggatgaactcctgctgcctcgcatggcatcgccctctcgtcggcacccccttccctgagctctccaaactgctcctttattgaaggagtgatactggatgggatgggacgggtgggcgctgttgggaggaagcagagctccccacccccagcccagtcctgagtccctccccatgggggaagccacttcctcgagacagcagagaacagggaggtgggggctggtctacccccgagtgccccctcagagtccagcctagtcatgtcaagcagtggctgccgaagtgaagtgtggcccctgtgcaccgccagtcctgacttccccctcctctgccgtctgacacagggcgtgtgctggtctgtctcccctggaggagtgaggccactcagggtggggctgcaccttccccctccttgtgttcccagccccagtgggcttctagaggatgtttagggaggttgagggggggggtgtcaaggaatgaaagctgtgtaagtgagtggggggtgagtgactgagggtgtgagggggtgacagaccctctcctcctccagggagtggagcaggggtgcaaatgctgtgatgggtgcggggagcttgcttctaaaagacactgcttggcccttggccccccccagcagccccttgcagccaggctggctcctcactctgttttcctttggattaagcccctaccacacccacctggaccccaaagcctcccccagaaaatgagcaggaaacactaacaggcatggccccatgggcgaggaagcagaggggagagcagagcccagctgcggagtctgtggactggcaaggacagtgcctggcccaggggctgtgtcatggctgcgaagaggtgaagggaggagtagagaggaattaccaacttctctggcaccaaggccagcctggaatttgtgtggggagtgttgagggtccatggttaacagcccaggatcaccaggggtcttggcacagcccctgccagcagatgaggcccccaccacacataccacatctgcttctcttctgccttggctcctgccagcctcgcctgccagggtctcgtctctgagcccctcctgccatccccgggccaggagcatcctgcgccgactccagctttgccaggccctcgaggactgcccatcccctctccatcctggcagctctccccagcctttagctgtggtttcccagccaacagtaatttccccactgtgtctcttggtttaaatgcccaagagaggagcctgaagggccattcatcttcccgagccgggtcactggccggtcgctggtggcctgccaatcagccacgctggggctgggcctccaccccagcttccacagctgtgggtgatggtggagggggaatgtggagaaacgaggtgcagaacacagcccagtactcaaaccagtcccctccgtcctgagcacgttcagtgatgtccctgatggcatctcccaccacaggatttatgggtgagggtggagagtcatcttccctacagacacccctcttctgtccactcttgagccagggttggacgtggcacagcccatcctgctactggctgggagaagaccaagtgacctacagtgaggcccggcgcctgtgcactgaccatggctctcagctggtcaccatcaccaacaggtacagcaggggcgggtgccctgactagcccttgcccatgtctgggcctattgtggtcccttcagcaaacagggtagcatctgccatcatgcccagagggacctggagtcctgtgaacctcagtgggctccagggcattttaaaatcttgtcagaagaatgactctcacttgttaagtgaccccagtgtagggcagggcccgggcaggcacaggtgtgggctggatacttgagaaagagaggccttggttgtgtctgattttctctactttcttctcagcaaagcaaggggtgcagagaatagaaggggcagctgggggttccataaatcagctgcagggctcccaggcgtccctgctttcttgagcaagttattggtcgggtgcagcacccgagctcccacggtagggcgtctggcctgtgactgggggattgggaagcagggagatccctgccctgaccagcctgtctcctgaaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccggtgagccccttatttgacttgccttggtgaagcgaggagggaggccagggtggactggccctgccagcaccgagccccagggcttccccataaacagatcattggtgcactgtggtgtagtgtctatgagcacaagctctgaaaccaaactgcctggctccgatcatgactctgccatcttttagctgtgcatcctctgagcctcagttttctcatctgtccagtgggaataatgatcctttcctcatagggatgacatgagtcttaaatatgtgtaaagtgctaatatgtgtaaagagttaatgtgtgtaaagtgtctagattacttctctatctgggctcacaaaaaagaaacaaataatctcttctctatctggactcatttaaaaaatgtgttcagaatactgagcgcaatacaagtgcttgttattactattattaccatttcacattcattatctttctaaccccttcaataacctgatgaggtagatgatgaagcaggctcggtgaggttaagcagcttgcctgagccctcacagtgggtgaacccagagccagggctctgcctccattcccttcctccctcctggctccaaccccagagagcatgtctctgaagaggtggccaagctggttcccagtgtgagggccgtgctagtgccctgccgggatgtgagggaggaccagactatgaatccttctcagagcctgggtctcccttccctctccttcagggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtagggcagcctgttggccgggtagggggcagggggaggacaggagcaaagagacagtttggatggaggtcccagtgggaccagccacaatccagagacacaccaggctgcagacgggtgatttctggtgagacttgtccatggaatctggaggcctggtgctcagtaatcatttgaggaattgagggaaccacagatcattgatttcagaggttcccaaatgttggggccagcctagctgttcttcagaattgcttggggaacctgataaaaataaaatcttggccgggcgcagtggctcacacctgtaatcccagcactttgggaggtcaaggcgggtggatcacgaggtcaggagatcgagaccatcctggctaacatggtgaaaccccatctctactaaaatacaaaaaattagccaggtgtggtggcaggcgcctgttgtcccagctactcgggaggctgaggcaggagaatggcatgaacccaggaggcggagcttgcagtgagccgagatcgtgccactgcacgccagcctgggtgacagagcgagactccgtctcaaaaataaataaataaataaataaagataaaaatctaggctgtcacaatggagatttagattcattaggtctggattgggcctggtaatctgtatttttaatcacgctaggtttgggagccactggcagagtccgaggtcttttattatgcacagaaactgaagtctagggagaagaagggacttacccacgttaagctgtggctctgctgggattagagcccagatctccctgctggtcaggggatggggctcaggggccctctccagaaggtgactgtgccagctcccctccccagacctctgcagatgaacaggattgtccttagctagccttagccccctgtccagtaaggctccaggcccctcctctgccatggtgggaaaggcagtaggtgccccctgaggggtgggccagtggggacagcttagacagctggactctgcccctgcaggtgttcagctcagagcggctgcaggacaagaagagctgggtccaggcccagggggcctgccaggagctgggggcccagctgctgagcctggccagctacgaggaggagcactttgtggccaacatgctcaacaagatcttcgggtactgagccgggctgaggcgtgttaggagggcacccgcacacgtgtaggagcaggcatggccgacagacccttggttttgttgggcgagcagggggatggcagaatgtgggtgaccccagggaggcctgcatctgctgctggtgccaggaccatcttgtcctcactcaagtagccatggtgccctggcatcttgggagaacaggctggtgtgatccatgcactcataggagactgtgttttgctcaccatcatccccccagcaatgctccaacagacccacaaacttacatatgtaccccccaccccattgcaaaatctcccacatgctggtcctggcaagtgtttcccctcaccttacaccatcctacaatgacccacactcctcaatccacagtttttcctgagagataggaggagaaaggccgcagctatgaggatttgcccatgggcctccctctgagacaccacctctgtcctgggctctgagcattagcacgtggaatcccctagcactgggaaaatcgagatggatctgggcttcctgatagcttaattgaagggatctctcctctcagcaaacattgaaattacattatttgtctcataattacaatagctcatggtcatcacttctcaccacgtaccaggcactgtgctaaacatatagtcctcactcaagcctcccgacaaccctatggagcagacgttaacccctgacccttgtgggttgatagagaggttatttgcccaagttcatgggtgaacggatacttgaatccaggtttatttaactccagagccgtagatccctgccacctcctcatctgaacttcctaaactccgtaaagtaaaagcctgcagaatcttgctggacagggcacccccacccaaaaggaacccaaacaaaggggaggggccactgccccttgagtggatggcttggtccagctctccccagctctgtcttgtggggagaactttaccgaagtgacctcaacgctgtatcgatgggtcaatgtgaagcccagatggagaggccccaggccctgggggctgccccggtcacagctgcaagggacagggggcacgtttgggttcctgcccctctcacttcccatctcttccgtccccactcctgggttgtgctgaagtgaatcagaacccgagatccacgagcagcactggttctggatcggcctgaaccgtcgggatcccagagggggtcagagttggcgctggagcgacggcgtaggggtgagggggcctggggtacttgggactgcgaggccgggagcttggtgggcggggcctgtttggggcggggcctggaggtgggcgggttttcttgagggccgggcccccagtcggagccggcttcaggaaagcaggtccgagaggggtcacccggcccccggtgagaattcgcagctcaggccaggcctcttgttcacctgttccgggcatgggggcggcctgcaccttgcgcctcacgttcctcttccctccacccgcctcctccagttctcttaccacaatttcgaccggagccggcacgacgacgacgacatccgaggctgtgcggtgctggacctggcctccctgcagtgggtggccatgcagtgcgacacacagctggactggatctgcaagatccccagaggttggccggagtggcgctgggggacgcgggatggagcgaagggtggcggggccaggaattccagggagggtctcctttcctcacaacgtctttgtccttgttcccctaggtacggacgtgcgggagcccgacgacagccctcaaggtgagcaccccccagcccatcccgctacccatcgcgtgggagagggcgtcaactctggggtaagtcccgagaggcctgaatgaaatggaggggatgaggagttccggtcgagagaagggggacggggttggctcggacggaggcagccacagccctgtttgcttccgtgtgggaggcgaggcaagcctggggcctggggcctggcacggtgcctgcctgggtccggtgtgcctgcaggctcgcctgctgccgcctggctctgccccggccctgccgcgcccgcctccggggcctggcgtgcagcctctgcctggccgccgctcccacgcccgcgctgctcctgcaggccgacgggaatggctgcgcttccaggaggccgagtacaagttctttgagcaccactccacgtgggcgcaggcgcagcgcatctgcacgtggttccaggccgagctgacctcggtgcacagccaggcggagctagacttcctgagccacaacttgcagaaggtgggcattggattgagcagggggctgcaggctgggggagggcaggcccgggatgagggcagggggctgcctacccacacctgcccgcctggcttctccagttctcccgggcccaggagcagcactggtggatcggcctgcacacctctgagagcgatgggcgcttcaggtaggaacccaggcaggcagcagatgtggaagggggctggctgtccacacacggagcacagaggcagacttgcatttgaatccagccctgccccttccttgctggctgtgtggccttgagcaagatacttaacctttctgggccttggttttctcatctgaaaatgggaatatgaggcctgcctggtaagatttttgtgaagattagaaataacatatgcgaagtgcttacgcagcatccagcacattagttactaaataatggcagctcctgttacgtctggtgtcattcatcatgactaaggccctctcggggaagtgggcagaacatatgatgatccgggggcctctttgtatttggtgcctacttaccatgtactggggggcttgaggcaggaaggaccaggagcacctgggactcagaatttgagcttgtctttttgcccttgggcttcctgccctggagtcctcaggcttcttttctggagcagcaagtgtccagggacagctggggccttatctagaggcaccaggtccttgggtctttgactgccctgagctcagtagctccacccctcagcctacagccactaaaccccagaacctgggcccttccctgcccccattcctgcggccttcattgctgcatccggtggaggcccagctgggggccggtgctggagttacctctgctccatgccattgcagatggacagatggttccattataaacttcatctcctgggcaccaggcaaacctcggcctgtcggcaaggacaagaagtgcgtgtacatgacagccagccgaggtgagggcaaggtgggggcagagtgcgcagtcagctgtgcaaagggttaatgctgggcgagcctgggcagaagtcatcagtctgttctcattctctttgttcccacaacccaataaaggctagactcagcgaggggtggacctgtctccatggtccagaagacttgaattcggagctggacacaggccctgagcctctgcccagactcctctcagggcatgaggctgagtgtgctgccagccatgccctgccctgctctgccctgggggtgactgccctcccctcccctttccgcagaggactggggggaccagaggtgcctgacagccttgccctacatctgcaagcgcagcaacgtcaccaaagaaacgcagcccccagacctgccaactacagccctggggggctgcccctctgactggatccagttcctcaacaaggtaggaggtggcaatggggcacccaagggagtcaggggagaggacgtgaacagggaaaggctgagcctcaggagtcctggccttttggcagcaccaaactcatggcctcttgcctgtacccaccaacttctctttcacctggctccagtaccagggccagactccttggaaaatgactcactgtagtagcaccttccaatcctccgggaagcaaggttgtccaaataatttggtgagtgttctagatcagtgattgccaaagattttttttttttttttttgagaaggagtttcactcttgtcacccaggctggagtgcagtggcgcgatctcggctcactgcaacctctgcttcctgggttcaaccaattctcttgcctcagcctcccgagtagctgggattacaggcacctgccaccacccctggctaatttttgtatttttagtagagatggggtttcaccatgttggccaggctagtctcgaacccctgaactcaggtgatcacctgccttggcctcccaaagtgctgggattacagatgtgagccaccgcgcccggcctgattgccggcctgattatcaaagattttgataatgaactcctattagtaaaacaaaatattgagcttacatgaccaaactatgtgtgtgtacatttaacttatatatgtatatgtgtgtgtaaataaaacctacttccatactaatatgactaatattatatatagtaaaatatgtataagaacaaaagagtataaaacattagctaaagatttttaaatacttttaagtttaaaacatttttttggctgcgcgtggtgggtcatgcctgtaatcccagccctttgggaggctgaggcgggtgaatcacctgagattaggagttcgagaccagcctgaccaacatggagaaaccccatctctactaaaaatacaaaattagctgagtgtggtggcacatgcctgtaatcccagctactcgggaggatgaggcaggagaattgcttgaatcctggaggcggaagttgcggtgagtcaagatcgtgccattgcactccagcctgggcaacaaaagcgaaactccgtctcaaaaaaataaacaaagaaaaaaaaaacaacaaaaaaaacaccttttttttttttttttttttttactagtggtatgaaaacatttttttgtgctcactcaaaagtgattaattggctgggagaggtggctcacacctgtaatcccagcactttgggaggctgaggcaggaggatgacttgagcccaggagttcgagaccagtctggacaacatggagagaccatgtctctacaaaaaataggaaaattaaccaggtgtgatggtgcacacttgtagttccagctacccaggaggtgggaagtgggaggatctcctgaacccaggaggtagaggcttcaatgagccatggtcatgccactgtataccaccctgggtaatggagtgagaccctttctccaaaaaaaaaaaagatcaattataataattattgtttaatatgctcactttggcagcacatgtacaaaaagtgaaacaatacagagaagattagcatggccctgcacaaggatgctatgcaaattcctgaagggtccatattttgcgtagttcatgaaagttgaaggttgttcaacaaaaaaattgtctaaataattttaataagagcaatgtgattacatgtacttcacgtttttaaaaaattttagtctgacactttatgactcatgactcacaggtctaacgtgttgaaaatcaaagttatttcaaaacatgcatttcatggtggctatagattaaatatgcctcacaaagacaaatagattgaagtgaaaaaagttcatccatcatttctaaataattctccccatttttagtccttctaccaattaaacaaacatttttgtttaaaaattggctagtaggctgggacgctgagcactgggaggatcacttgaagccaggagttcgagaccagcctgggcaatgtagcaagaccctatctagaaaattctttttccaagtgttttgagtgtgcaggtaggaaagtttggggcactgacattaatcactatggatgcatttctcaacacgtttttacaacaccccctccatagtgtgagtttcttccccacagtcgttatttttccatgcacaggctgatttattagacctgattagtccttcattgtttttacctggcgattgacaacgagttcataccaggaagagaaggttgtcattttccttgttatgtgccagggtaattggcattaatctcaagccatggcttctttgcaggacattttaagaacacttagccctgttgtgaagattagattagttaacactgaataatataatccacaaatccttgtcatacacaggaaggcagccagcctcttagtgtcatggatctcctgccctcctcagaatattcaaaagaacattacacggccaggcgctgtggctcatgcctgtaatcccagcactttgggaggccgaggcgggtggatcacctgagatcaggagtttgagaccaaccagggcaacatcgcaaaaccctgtctctactaaaaatacaaaaaattatctgggcatggtggtggacgcctgtaatctcacctactcgggaggctgaggcagcagaatcgcttgaacctgggaggcagaggttgcagtgagctgagatcgagccactgcactccagcctgggcgagagattgagactctctctcaaaacaaaacaaaacaaaaaccacacaaaaaaaaaattacacctcttctaccttaaaaaattaaggcatgtatattattaaaactttggaaaatacagaagagaaaccaaaactcacccaacactctctagagatcacagctatcaatatttgttattctccttcctgcctttttccatggaattgagctcatactaaataatataatttcctacccaactcttctttctctgtatcatattttgagcatctctcatgttataaagtttttccaaaaacttgttctttttccatccactttttaaacagaatgtattttatatatgtaataggtcccattcttaatcatcattgtcaagataccagttactctcctgccctgtggaaagttctgtttgtttttgtttttgagacagggtcttgctctgtctcaaaaactgctggagtatggtggtaccatcatggcttacttactgcagcctcgacctcctaggcttaagtgatcctcctgcctcagcctcctgagtagctggcactacaggcttatgccaccatgcccagctaatttttctattttttttgtagaaatggggttttgccatgttgtccaggctggttttgaacttctgggctcaagcgatcctcctgccttggccttccaaagggcagggattacaggtgtgcgccactgtgcctggcctgtggaaagctctggaagtatgctagggtgttcactccttcactgcctgccctcacacatcttgctttactagttctgtgcccttctttgtgtccctatagcatttggatgtaggtaaagcatttatggcagctgtccccaacctttttggcaccagggactggtttcttggaagacaatttttccatgtactaggggaggggagggatggttttgggatgaaactgttccacctcagatcatcaggcattagattctcataaggagcacgcaacctagatcccttgcatgtgcaattcacggtagggttcgcactcctatgagaatcttggctgggcgcggtggctcagcctataatcccagcactttgggaggcctaggtgggcagattacctgaggtcaggagtttgaaaccagcctggccaacatggtgaaaccctgtctctactaaaaatacaaaaattagccaggtgtggtggtgggcgcctgtaatcccagctactcgggaggctgaggcaggagaatagcttgaacctgggaggcggaggttgcagtgagctgagattgcgccattgcactccagcctgggcaacaaagcaagactccatctcaacaacaacaacaacaacaacaacaacaacaacaaagaatctaatgccctgctgatccaacaggaggtggagctcaggctgtaatgccccttcgccccgctgctcacctcctaagaggccggggacccctggtttgtgggacagcctcttccactagctttaagctcctggagggcagggccactagcacctgccataccccttaatacacttgcacatggcagggatgccctcagtgtcggctggactgagctgaataccctccccctttagctgtcacttcttgctggtactggtgtgaccttgctgcttccaagtttatgatgaattctactcatgatttaagttgggcctcagcatggctctgaaactacttctgtgaaaccaaatccttgaactttgtgacagacctccaaaaatctgcattatttctgggcttacaattttttaccccaaatctgccatctgcatcagtaaggatggtgctggagctaattattaatagtcacagctctcactggttaagtgcctactgtgtcatgtactgttatctttaatccttaaaatgatccccaaagacaggctttgtattaccactttacagaagagtaaattgaggccataaggttgtcagagctggaatctgacatctcccccttacctgaatcccacccctgtctttatgactccaaagcttccctacaccctttctttttttttcttttgagacagagtttcgctcttgttgcccaggctggagtgtaatggcgtgatctcagctcactgcaacctccgcctcctgggttcaagcgattctcctgcctcagcctcccaagtagctgggattacaggcatgtgccaccacgcctggctaattttatatttttagtagagatggggtttctccatgttggtcaggctggtctcgaactccagacctcaggtgatccacccgccttggcctcccaaagtgctgggattacaggtgtgagccaccgtgcctggccaacaccctttattttccatcacactgcctctgagcagaaaatcattagatattcattttcctaagaaagagtcttcacttgatgagagatttcctacccagggcttttgtttgtttgtttgtttggaaaccttatagagctaatgaaagtgggaaaagagaaatgtaaaattacagagttagaagctgctgctaatagatcattcaacaatagagataaaagtgtcctagggctgggcgcggtgaaaccccgtctctactaaaaatacaaaaaattagctgggcatggtggtgggcgcctgcagtcccagctactggggaggctgaggcaggagaatggtgtgaaccctggaggtggagcttgcagtgagccgagatggcgccactgcactccagcctgggagacagagcgagactctgtcttgaaaaaaaaaaaagtgtcctagagatgatcatgtaagttcaaagggcaagataatggatgtcagacaacattcggaagggtgtttagcagaaagcaagatagatccttgtccccatcttcctagtgcttggcctaggcactgttgtcatagcctttgacggcccaaagaaatcctcccatttgaagatcccctggagtgtgggcaggtgtgtgtgaatctgcagtgccaagctgggaggtgctggaggctgccaagcagacccagctgtcctggttctcagatactgttctctcccggccctcaaaggccccccaggacctgctgctgaggggcgcacagtggcctttctgggtttgtggatggggtggtggggctggccattacatccccacctctgccccacagtgttttcaggtccagggccaggaaccccagagccgggtgaagtggtcagaggcacagttctcctgtgaacagcaagaggcccagctggtcaccatcacaaaccccttagagcaaggtagggccagcctatggggagcccccagtatcctctgacactgtccccccaaatagctatagcagagtcactcacaactgtcttctggggaccatagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccggtgaggatgccctccctgttcccctccgcaccgcgctgccctaagcctgtggggctgcctttgccccagcatctcttgccccagggtctcccttcttccagcctctttgctcacattgcagccttctggggacagtagcacagggaggcagctgctggggctcccctgagcagctccctccccccagaccagctgtgcagtggtcctgcacagcccctcagcccacttcactggccgctgggacgatcggagctgcacggaggagacccatggcttcatctgccagaagggcacgggtatgtgtcaccagtcacctgggaaaccccagtggggccctggcaccgggctggatgctgggaccatgccaggaggaaggaatcatggtccctggcagagcagggctctgcttgggaagcagatgggcagaaaggcaaggtgccaataagatggaaaagcaatagcacccacaggtctcaggaggaagatttgggggtatggagggctcgttgggtcggggggagagctagacgctgggctgcatgaagtgctggcacgtgtggcgtcaaggaccctgaggttccaggtccaagacacctccagctccatgcgtaggtggcctctgcgccgggttccttgggtaggaggaggtcaaggccctcacctccctgtccatttgttagcaaacatgtattattaataacaacagggctgacacctaccaagccttggtctgggccaagcgccgagtctggtggagaccgggtctttgcctggtgtgcggccttctcctggccttgtgcctgggaacggggtgagggaagcagagcccagcctgaaccctgaccccttccctgtagacccctccctgagcccgtccccagcagcgctgccccccgccccgggcactgagctctcctacctcaacggcaccttccggctgcttcagaagccgctgcgctggcacgatgccctcctgctgtgtgagagccgcaatgccagcctggcctacgtgcccgacccctacacccaggccttcctcacgcaggctgcccgagggctgcgcacgccgctctggattgggctggctggcgaggaggtgggctcccgacacttttgccctgggccccagccttgcccgggttcccctccctgccccttcctgcccccgccttatccgcaccctatcctgactattcccttcctcccaccccatggccccccatgcccagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtggtgagtgcccacctgccagggcgggggcatgggcaagctgtcggtggccccggggagggtgctgagccacttcttaatcctgtacccccacagggccccctcctccccgaagaataagctaccatggcagctgtccccagggactggcagactccgcgtggattcccttccgggagcactgctattctttccacatggagctgctgctgggccacaaggaggcgcgacagcgctgccagagaggtgggtgaccaggccagagcccacacatggcgggcaggtggcacctcctctcgtgggcactcagacccatgagtacatccccacactgctctctacccataggcagcacttacacaagatgccctcgtgctctcacatgtggagaccatacatgacactatatgtgcatatgctgcccccccacacacttgcacatgtgcacacacacacacatgaatccacagactccacaccatcctctactcaggctgcagagaagagggctggagcagctctgggggactctgccccccccggagacccatccgccctgacgtgggccttctttgcatccagcgggtggggccgtcctgtctatcctggatgagatggagaatgtgtttgtctgggagcacctgcagagctatgagggccagagtcggggcgcctggctgggcatgaacttcaaccccaaaggtgggtgccctgtgtgtggggtggagaggtcaagcctcaggctgtaaggggctgccctccactttgccctgagccttgtcctggggcttgtcgggggacagggagtcggttctagaacacacctgctctcctccacctactcctgccccaccttgtccctgctccctcagtgccttctttcctgcaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtggtgagcgccgggcaggcccacgctcagcctccttccaccccgtgccgctggtcctgggctggggctgggggctgcttcacaactgcagggggcacagccgatgggaaggcctgaacagaacggactgcgggcagctgggacccccgggataaattagtcagtgggatggactggacctgaaacttatcatccaaactagaccacaaggctcgggggtcagcaaccccctgtcactttgtagtggtcaagggcatggacagagttcaagtcctggccatgtcacttatcagtggtgtgaccttgggcagagtctgtggcctcagtttcctcgtatgtaaaatgggaataatagtagttccagactgatgtggtggctcatgcctgtaatcccagcactttgggaggctgaggtgggcggatcacttgaggtcaggggttcaagaccagcctggccaacatggtgaaaccccgtctctaccaaaaagtacaaaaattagctgggcgtggtagcacatgcctgtagtcccagctacttaggaggctgaggcatgtgaattgcttcaaccgtggaggtggaggctgcagtgagccgagatcgcaccactgcattccagcctgggcaacacagcaagaccctgtctccaaaaaaaaaaaaaaaaaaaaaaagtcccgacctcctagagtgctagtgaagctagtaaagatgaggtgagttagggaaggggctgacacccaggcctcccacgagggctgggctgagacctagctgagtgcagcatggcgttttccctttctgggggaacctgaagtcttgtctcttgggcctgtgcccccacagtaaccagaggtaggatgggagggggaactagagcctctttctccccagacctcccggcccaggcctgtgtgctttgtatgtttacttaagtgattattacgatgatcactgctattattaactggccccctcctcttgcccacagctgagcagagcagcttctccccatcaggtgagtgaaaggcaatgcccccaggtgggcaggcaggaagcactgctgggcctaacgcccacttggcctttcacgcccactcgccttggcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgttttt

SEQ ID NO: 38789 - DNA, 125464 bp, Homo sapiens; identical to SEQ ID NO: 36542

SEQ ID NO: 38790 - DNA, 12761 bp, Homo sapiens; identical to SEQ ID NO: 38168

SEQ ID NO: 38791 - DNA, 91988 bp, Homo sapiens; identical to SEQ ID NO: 36672

SEQ ID NO: 38792 - DNA, 18173 bp, Homo sapiens
agatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcagtaaagaatcttacttaagccaggtgcggtggctcacgcctgtcatctcagcactttgggaggccaagttggggggatcacctgaggtcaggagtttgaaaccagcctggccaacatggtgaaaccccatctctactaaaacaaacaaacaaacaaacaaatcagacgggtgtggtggcacatgcctatagtcccagctactcaggaggctgaggcaggagaatcacttgaaccctggaggcagaggatgcagtgaactgagatcacaccactgcacttcagcctgggcgacagaagaatgagactctgtctcaaaagaaaaaaaaagaatcttacttaactcttttaccctgcctttctcaagtgtatgtgaccttgaagatgttttttgcatgtgacatgatgagtacctgcggggctgatgtcagctctgcctggggaatctgcctcagcttcagaccctgcaccccaaattcatgcttagcccaggccagacccccttcctgctgtcggcaagcagcttagctttccgcacacccatgaacagatacccagcagcctttggcatgagccatgtggcccgaggagataaacagacagagagaggaacattgatgcgtgtgaaatgttggcaggtgagtgggaggggcttgggttggtgctgagaccggagacacactctgctgtcacatccttcagggtccccgggggccagcacggagggccatgatcatgtaaattgggacttaaatttaactctatgtaaatataactctatgcagaggtcagggatggtagaggacaagctcactgcagagaaagaaagaaagatgggcaacagttgcagaacctaacccacagataggttttgtttgaccagctctgtacatttttagtttattttttatctttttgagacagggtcttgccctgtcgcccaggctggagtgcagttgcatgatctcggctcattccaacttctacttcccgggttcaagcaattctcctgcctcagcctcatgagtatctgggattacaggtgtacgccaccacgcctggctaattttttgcattttgagtaaagatggggttttgccatgttggccaggctggtcttgaactcctgacctcaagtgatctgcctgccttggcatcccaaagtattgggattacaggtgtgagccactgcgcctggctcacccatactttgttactggttttagaattcctttttacctggtctttcaaaccaagttttgaccatgtctgtccctgagtataatccttgatgagtagcaccagagagagctccacgttacccggggcctggcattcaaagcactcagtggtctggtgccactcaaagcctgtgagccaggcaggaagtttataaaattagagatggatgaatggatggatgggaaaaagcaagcaagggaggaaggaaggaagaaaggaaggagttctgggaagagagagaggctgcccccgcagggctctcagtttgaaggagaggtgcagcacactcagaaaaaactcccggccaggagtggtggctcacacctgtagtgccagcactttgggaggccaaggctggcagatcacctgagatcaggagttcaagaccagccaggccaacatggtgaaaccccatctctactgaaaatacaaaaatcagccaggcgtggtggcacctgcctttacccagctacttggggggctgaggccagagaaacgcttgagcctgggaagcagaggttgcagtgagcggagatcacaccactgcactctagcctgggagacagagcaagactctgtctcaaaaaaaaagaaagaactccgtgagcatcccaaatgccacatccccataatgcaaccagacccggtcctcccggatccaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctgatcactgtggtgagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctggtaaggccttcggggagcgggtcctctgctctgggcaggggtgagtgggaggcaggaaatacctgactcctggcacagagctcacaaaccgagcttcctgcagagctcaggcaggggacgccagcggatgacgatggcgatgcagcagcactagacagagctgcgggacctcggatgtcccatctgaccctcagttcctgcccctctgggacctggattccaaagttatcggatctcctgatctttccctctttctttctcaccatgtatttttcagcttttgtgacaaactcgtgtttggccttagtactggaaccatccaagcaccgcattcctttagtggggtgggtctgcatgtaaccagcctcagctctcccccaggctggaccgcccccttcagacattggggtctgaagctgcatcgctcaccccaaacttagggctgctcagagctccctatagaggaaactgggtgtggaacggagtaaccacactccctagggcagaggccccagacctgtgtttgatgggtcaaatccacccctacatgtgcagtgccataactgagcctgtgttataaaaatcataaaatgtttgttttactttttttcctcttcttttccccttccccttcctttccctttttatgagacagggtctcgcactgtcatcacccaggctggagtgcagtggcgcgatctcagctcactgcagccttgatctcccgggttcaagcaatcctcccacctccaaagtagctaggatcacaggtgcatgccaccatgcccagctaactttttaatttgttgtagaaatgggtcttgctatgttgccaggctggtcttgaactcctggcctcaagcaatcctcctgcttcaacctctcaaagcattaggattacaggcatgagtcaccgcacccggcctgatcttctgatttttcaagagacgatggaaatctagattttccagtgaaatctcccagcatgttaatgttcatggcaagttctcatgagctcttcaaggtcagatgacactgttgttgaaccccaaaggccaggtttgagctcccgatgcgtagtcagccaaacactgacacctcagtgcttagaagctgagataggattatttaatttagccaaagcaaggggacagaagagagaaactctcaaatctgacctgactttgagcgttagtgggggcttttatgagtaaagtaggtgtgcaggaggtgacctcccgatcgtcaaagctgttgtgcccctcggctcatcaaatttctggatgtcatcaaggaggtctgtgtgacctaaggatcattgttctttgaaagagagacaagttcatttatcttgcaggcagctgccagggagtcaggatgtaagttaaacaattatgagtgaattaatggttacctgctactgaaatgaccaaatgtaactaatcatgcatggaggaaggaaaggacaaagagaaaagaaaagaagtaaaacgaacatcttataatttttataacataggttcagttatagcactgcacatgtaggggtggctttgacccatcaaacacaggtgtggggggcccctgccacagggagtgtggtcactccgttccacaccgtttcccggatgggcagttctgagcagccttaaatttggggtgagcaatgcaacttcagaccccgctgtctgaaggaggtggtccagccttggggagagctgaggctgggtgcacacagacccactccactaaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacgcctgtaatcccagaactttgggaggccgaggcaggcggatcacaaggtcaggagatcgagaccatcctgactaacacagtgaaaccctgtctctactaaaaatgcaaaaagttagccaggcgtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgtttgagcccaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtgacaaagcaagaccctgtctctaaagaaaaaaagaggccgggtgtggtggcttacacctgtaatcccagcactttgggaggccaaggcgggaggatcacttgaggtcaggagttcaagaccagcctggccaacatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccatcctcaagccatgacatgaattggggattatctggttaggtctttttgttcccctcttggtggggatttttttcgcatcattatcttgtgcctcattcattcaataaatacgtatcatgaacctactaggtaccaggccttattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaagaaaaaaaaagaaggtgagcacttaagctgactggaacggagggagtggctgaggccggcacatatttgggagaggaggatttcagggaaagagaagggcaggttcaaagctttgaggcagcagctgggtgggaggacctcagaggctgaagttcaccgcctctgagggccacatggtaggacaggaggcaggagatggagcaggactctggatcccgagggctgaggtgagggtttgggattctatgcaaagcacagaacccgctcgtggtttccagcaggattggcgaggtctggtagatggtgttaggaaccctgcgtgctgctggtggagaccaagaagtagaggaagtgggagggggaagctgagagccgagttaggaggctgtgaccatcacctgggtgaagggactggcaggccatggctttgtcagaataaaagcactttccacaccctccaccctctgaggattccccgccccctccccgactgcccctctgctcctccagacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtgtgagcccctcggagctggggacaggccaggcagggaggtagcaggggtggacccggagaggggagccacgggggctctcggggccgtgtgcacaggttgggggtgctctcctcacccctccactcgcctctgccccctcttccagatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtgtgagtagccacggagcctctggttctagggagagaagatggacacagggaacggggaaggcagatggggtgcagggcattccggggtcctggagtcaagagcaaggagcagccagggtctcctgttcacaactgctgtctcagctcctagcatagggcctggctcatggagggtgcttggtagatgcttgtttttttgtgttttagttttttttgagatggagtctccctctgtctcccaggctggagtgcagtggcacaatctcggctcactgcaagctccaccttcccgggttcatgccattctcctgtctcagcctcctgagtagctgggatgacaggcgcccgccaccacgcccggctaattatttgtacttttagtagagacggggtttcaccgtgttagccaggatggtctcgatctcctgacctcgtgatccacccgcctcggcctcccaaagtgctgggattagaggcgtgagccaccgcacccggcctgtagatgcttgttgaatgaatgaggccaggtgcggtggctcccgcctgcaatcccagctctttaggaggctgaggcaggagggtctcttgaacccaggagtttgaaaccagcctgggccacacagcgagataccatctctacaaaaaaatacaaaaattagctgagcatggtggtgcgtgcctgtggtcccagctactggggaggctgaggagggagaatcacttgagcccaggaagtgaaggctgcagactgaactatgttcctgctactgcactctagcctgggtgacagagcaagacctgggtctcaaaaagaaaaagaaaatgctgggactgggattataggtgtgagctgggcacagtggctcacacttgtaatcccagcactttgggaggccaaggtaggcagctcacttgaggccacgagttcaagcccagcctgggcaacatggtaaaaccccatctctacaaaaaaaaattagcctggcatggtcatgcatgcctgtagtctcagctacccaggaggctgaggtgggaggatcacctgagcctggaagtagaggctgcagtgagcctgtgatcatgccgctgcactccagcctgggtgactgagtgagaccttgtctcaaaaaaaagaatggattggccaggcatggtggcttacgcctgtaatcccagcactttgggaggccaaggtgggcagatcacctgaggtcaggagttcgagaccagcctggccaacatggcgaaaccctgtctctactaaaaatacaaaaaattagccgggcatggtggcaggcacctgaaatccacctacctgggaggctgaggcaggagaatcgcttgaacccaggaggcagaggttgcaatgagctgagatcatgtcactgcactctagcctgggtagagtgagattctgtctccaaaaaaaaagaataattaactgcaagataccaggactccatgagggacacagagacttagcgtccctaggcagtggctgagtcttgagagatcttgaaatttttaatgagaactggggcaaactgtctcattacctctccattgtaagacccttttaacacagtgaatcttgttaccatgtagagcacaggacaaaaagaacacataagctcgatccttggaccctgagatgtcatatgtgctaacaggacaggggtgcccaaatcctgagcatctcagacagctggatgcgtgaccacagcagccacagtgatgtttgtggagtgtttgccacacgccacactctgctctaagggagtcatctcatttccttcttgaaacaattcccaggaggttaggaactctcaggactcaccccccacccaccccgcactgcctcttgtttttaagatggagtctccctctgttgcccaggctggagtgcagtggcttgatctcggctcactgcaacctccacctcccgggttcaagcgattctcttgcctcgaccacctgagtagctgggactacagacatgcaccagcatgcatagctaatttttaaaatttttagtagagacagggttttgctgtgttggccaggtctcgaactcctgacctcaggtgatctgcccacctcagcctcccaaagtgctgaaattacaagcgtgagccaccatgcccggcctcaggaccccatttgacagacgtgtaaactgagacctgcagcccatgcccgtgcgcctctcagcagccgtctggcttcagcgctgtgccctgaacccctgcaccaaaccacagccaggccagagagccagggcagggtttctgttctcacacagatgcaggaaggacgcacaagcccccctttgattaatttaggacctgtgcagatgcccgggacaggtagcgggagaagaggaagcaggagggaaggggtactgtggacagctggcttttctttactcacctctctggttttcttccagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtgtgagtccctgggctaggcagggggatctgggaggtggcccggctgggatgaggggatgaaggcaacgaggccggagcctgggccagtgtcttcaacagaattgagggacaggagcctggcgtcagggccaaggggaggggaggcctggggacagcaaaagggacagggagcggagaggtcagcttgggacccttgccctccagatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtgtgagtgagggccggaggctgggagtggagcagagaagggaccagtggcctgcctggtagtgacttcgcaccccctccccctgcccgccatgcagatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactgtaaggcctcttcctgctcttgttcttcttggtggtggtcagtccttccttccttccttccttccttccttccttccttccttccttcctttctttctctctttcttttcctcctcctcttcttcccctcctcctcctcttcctccttcttcttcttcttctgctttctccctctcctcctcctctttcttctccttctccttccttcttcttcttcttatagagacaaggtcttactctgtcacccaggctggagtgcagtcgcataatgacacctcactgcagcctccaattcctgggctcaagcaatcctttcgcctcagcctcctgagtagctgggactatagacatgcaccaccacatccggctaatttttacatttttgtagagatggggtcttactatgttgaccaggctggtttcaaactcctgacctcaagtgacccttctgcctcagcttcccaaagccctgggattagagccatgagccactgtgcctctccctgtttcctctcatgctcctctctggccctgtctcctccagtgacttcccgaaaagccttccagaccagctggccccttcttccccacctcactgtcccctttcccattcacaccccttgctccaggccatctgccgctgtgctggaggagtcgtcttgtcctgcgtcaccagtctctctttttctacctcccctgcagtctctcctgcctccctctagggtcccctctcaggctgctccaccttccagaagtcctgagctcctactgggtccctgtctctctctctctgactactctgtctctctcagccctgacaggctccttgtttttatcttttaaaacgtaaatgattttttttttaaacggagtctcgatctgtcacccaggctggagtgcagtggcgtgatcacggctcactgcaagctctgcctcccgggttcacgccattctcctgcctcagctccccgagtagctgggactacaggcgcctgccaccatgcccggctaattttttgtatttttagtagagatgtggtttcaccgtggtctcagtctcctgacctcgtgatccgctcgcctcggccttccaaagtgctgggattacaggcgtgagccaccgcacccggctgattttttttttttttttttgagacagggtctcaccctgttgcacaggttggagtgcagtggcacaatctcagctcctgcagcctcgaccccctaggctcaagtgatactcctgcctcggcctccacagtagtaaacttgagtggtttttaaacagatcatacaagcacctggtaaaaaaataaaatgtaagcatgaaagggtaaatagtggaaagacagacgcggctcactcttgatccctgagaactctcatccccaccaaaggtcctcactgcacacagtcttcccatctcactgcacacagtcttcccatctcctccaggggtatttttcacacgcacaattcacacacagaggtctgtgcctatatacccttcctcatgacacagacgaggcagagcccacactttgcctgggaattttctttgcttttttccatgtaataatactgtttggacattgttctgtatctatgcatacacagagtgtctaaagtctggaggctgggcatggtggttcatgcctgtaatcccaacactttgagaggccatggtgggaggatcacttgagcccaggagtttgagaccagcctgggcaacatagcccacacctcatagcaggatctcatctctacaaaaaataccaaaaaaaattttaaaaacgaacaaacaaaacaataacaacaacaaaaaagagtctgaaagcatatggaagatacctaattaatttattgtactttttcagattaataattggaaacatggccttaaattgagggaacctgaccaggcacagtggctcacgcctgtaatcccagcactttgggaggccaaagtgggtggccacaagcactttgggaggccacaaggtgggtggatcacttgaggccaggagttccagaccagcctggccaatggtgaaaccccatctctactaaaaatacaaaaattagctgggtgtggtggcgcgcacctgtagtcccaactactcgggaggctgaggcaggagaatcgcttgaacccgggaggcagaggttgcagtgagccaagatctcaccactgcactccagcctgggtgaaagagcgagactctgtctcaatcaatcaatcagtcaatctagggaaccatcaccagcacggccgaaggccaaaggaaaacatctgaaacatgttatctggaaatgtaacagacacatcccatcatataaaaccattgttccctgggtatcccctttgcagacagcctgagagcctcctctttttcctggggccatggagtcctcgcgtatgaaggttgcatacatcctcctcccagtgccctcttcagggcctaggtctgcagcctcttgttttgggcacgcctgcaaggacagttgcaagatgcattcccatgtggaattgctgggtggaagacaggtgcactttcagagctgatcacacagctatactgccgtgaagagctgcacccatttatgcgggtgcgggtcacaggctctgggcgtgccacgtctgtgggaaaagcagctcctcaggagaattagtgccttattcctaaagggaggcccagagcaagcaggggccgttgtcaccctcttcctctgcacccctgcacgcatgcaggggagaaggacgagtctggctgcagagagaagtccaggatgccttccaggcaaaggctgccagggagagctggcccctcagttgattaaggtctctcctttctccacccagatagcccggagaccatcggcaggcgagtggctgtgggactcgggtcctgcctcgccatcctcatcctggcaatctgtgggctcaagctccagcgacggtgagctcctgccatcccccaccacctcctctatcccttggcagaggcccgtgtccagttgctccatctcgaagcctccagcctgtggagtccctgaccctcacacatgtgcctttatttctcagttggaagaggacacagagccagcaggggcttcaggagaattccagcggccagagcttctttgtgaggaataaaaaggtaggatggggctgggcacgatggctcatgcctgtaatcccagcactttgggaggctgaggcaggtggatcacctgaggtcaggagttcgagaccagcgtagccaacatggtgaaaccctgtctctacaaaaaatattttaaaaattagccgggcgtgatggtccatgcctgtaattccagctactcgggaggctgaggcaggagaatcgcttgaacctgggaggcagaggttgcagtgagccaagattgcgccattgcactccagcctgggtgacatactgagactctgcctcaaaaaaaaaaaaaaaaaaaaaaaaagggtaggcatgaggcagactgtgaagctgagtggggaaacaaggtgaaggaaggggataaaatgtcctctgaggagacctgggctgtcagaggccagggaaggggacgagggttggggaacaggtggttagcacttcatcctcgtctccctcccaggttagaagggcccccctctctgaaggcccccactccctgggatgctacaatccaatgatggaagatggcattagctacaccaccctgcgctttcccgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccactcggcaacaagcctctgggtaagggccagtctccagaagtggacctgctccttcaagtcagcagcacacatgcccagtccgttcttatcacaaagatcaagacctcatgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggagggtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctggcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacagggagacgtacgtatcagcggccccttgactctggggactccgggtttgagatggacacactggtgtggattaacctgccagggagacagagctcacaataaaaatggctcagatgccacttcaaag

SEQ ID NO: 38793 - DNA, 51644 bp, Homo sapiens; identical to SEQ ID NO: 37655

SEQ ID NO: 38794 - DNA, 15205 bp, Homo sapiens; identical to SEQ ID NO: 36021

SEQ ID NO: 38795 - DNA, 3843 bp, Homo sapiens; identical to SEQ ID NO: 36565

SEQ ID NO: 38796 - DNA, 82910 bp, Homo sapiens
atgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggtgaggccccgggtcggcagcgcgggtgcggccgcggagtgttgtctccgggacgctgggggcagcgtcagcccggagtggaagggcgtgggttagggctggggagggtcccagcgggatcgtgggtcagggtcggccaggggagggtctctgccgagggcgtgggtcagggccaggcgaaggtcatagcgcgggcgtaggtgagtgcctgctggcggtgattgcggagggcgaggctgggaccgggtcggggtactttcttgtcataagagtagggtcaagtcggagcaaggcctggggcttggggaaccccctcagggtgggtgggggaagatgttacggtgaggtgggggatggtggcaggcagggagcttgggtggggacccacagcggagactgagggacggtgcctagaaggccgacagctggagtcaggaggtgagcggtgcaggaggtgggtttaagccttggccttttgccggacatctggggttattgagcaggcagggacaggactggactttggaggttagggctggttcttctacagtccagggaacttgagagttggtgggtgcacacgtgttgcaggtagttgcggttgtagcctggggggtgggggggttggccgagggtagactgggctgtgtctcgtgatcccccttcgtctttcaacacctcagtgtttctcttcccggtgaacatctactcgtgtgattccgtgtgtagtacaggaagcagagccagtggttgtgacctatatagaacttgcagagtggacaggtcactcggcttaagtcctcttgagtcagtcttgagtcagttttgtctctgcatgctatttctagctccctggatgtcctctccgttcacacggaatcgatcaccagtgccagtgggtcccattctctcttgtggattttccttacattttttgtccagtggtgcctggaggtgtgtcatatttcactggctgtgaagtttatgggctaaacacagttgacttgggtgcggaagcgtaactctattctgctgtattggcacagggagagggagtgaagcgacacaaaagccctcaccctcaccagctccctggtacctctcagggctggagggttagcctgtccaggtgcctgctctgtgaccagacaggagactatcccagaattctgattatcacaaaaggcctgcggagacattttgactgtagcattatcacacactttgtctccattgtggtcaaaaccaaacagattttgggtatgatttggtcagaaagtctaagctcttctttcagaagtgggggctgaagtgtgatattctttcacatcagttggaagatttctctcagatcaaatcatttattctgaaaatactaggtggttatcttcattctttaagaagtttattgtggacaggacttgctttctggaacttcagacttgtgctcaaggggtggagagacagaggcagcacagggacagatccttaggggtggtacagacagtgtgagctttgggaaggggccaagcagaagatggcacggatcttggtgggagggatggagaatgcaccctcactggggcccggagaggaagattcgtataaagaaagaagcttgtgggtcacttagcacccaggaagaagaacaaggaaatgtgggcagctgctgaggttgtgcaaaagaacttgtttccctttgctatctaggcaagtcaggagataaaaataaccaatgcaattaggagctgtagatttcctccttgtaaacttaataggtggcctgcagcctcctaagtactttgaagcctctttgaactgaaacagagtgtgaaagctgaattaagtattttatataaacatacttaattaagttttgtctgaacagcaaccttagaacataggctatgggagtttaggctgtcttgtgtaaacatggtgatggctggtaatctgaacccttgagtacagatgtttacacttccagaatttttcaggtttcagaatggtcattgcagcatataacctgtatatcgtgggatactcccagaagacttgggaaagtattctgtaattgaatacattaatatttctgtaattaaatgaataaatattctcactgtgggataattaaagtctgtaattaaccccatatcagttcatgtcaggttttatcccaaatgaggttattatgatagaccaggatttgctgtcaagtgagttaggaaaaaatggttttcatagcttttaggaatttggacttgtggtgtgaatgggtttttaggtagaactgtggaaccagatagctttctaatttcttcaaatttgttctgtcatcttcctttttttttttttaatttaagagacgaggtcttgctgttactcaggatggatttgaactgggctctggatcttcctgcctcggcctcccgagtagctgggcttacaggcatgtgctgctgcacctagctagtcttcacttttttaaaaggcagattatcaggagcaccaaccatgtcagagatgcccagggcaggtgtatgctgtgtgttctttgttttgggttctgcgtgccgttgcttctgaagtggagcctgtggtgccctgactgcagggaaatccaccttccctgtgtggctgacttgaactcggggttactgctagtgagataaattgaggcagaaaagaaaacgatgccgcacagccgtcgtatggtttaagcgtaacccgcctcgtgcgtttggttgggtgttgtatgtaatttgagccagcccgcagcccttgtgtgccatgcgcagtgttagctgagtggctgggcccgctcaggagccttgggggtcaagctctggcctaaggaatggggagggcacagcctactcccacccccagggccacttgtgtgtggtcctgactctccacccttcttcctccttgacatggcttttggaggcttcctcccttcacttacttagaatgttctgggccgggcgcagtggctcacgcctgtgatcccagcactttgggaggccgaggcgggtggattacctgagatcgggagttcgagatcagcctgggcaacacggggaaacccgtctctactaaaaatacaaaattagccgggtgtggtgacacatgcctgtagtcccagctactcaggaggctgaggcaggagaatcgcttgaacctgggaggtggaggatgcggtgagccaagatcacgccattgcactccagcctgggcaacaagagtaaatctccgtctcaccaaaaaaaaaagaaaagaaaaaagaatgttctggactgggtgagggcactgtgaatatttggtactgactgacagttgcagaatcatgtggtacaagcaagactcttggttgcaagtttcagaaaccctcccaggtgggctcagtggcaggaaggccccatgtctccaaggtgggctcagtggcaggggaggccgcatgctggccccatgtgtcctccgcagggtacacttgagatcattttcttttattgaaaagagtctggctctgtcgcccatgttgagtgcagtggagcgatcacgactcactgcagccttgaactcctgggcctacgtgatccccctggcctaggcctcccagagtgctgggacgacaggcatgagataatgtgcccagccttagactgatcttaaaagtagaccgggccgggcacgacggctcacgcctgtaatcccagcactttgggaggccgaggtgggcagatcacccgaagtcaggagttcgaaaccagcctgaccaacatggcaaaaccccatctctactgaaaatacaaaaactagctgggcatggtggcgcgtgcctgtaatcccagctgctcaggaggctgaggcaggagaatcacttgaacctgggaggtggaggctgcagtgagctaagattgcaccactgcactccagcctggacgacagagcgagactctatctcaaaaaaaagtagacccttaggttgctgtggcgagccagccttgtagccgaccctcttcccacataggacttgtgactgagggcaccagcctctgaagctccgtgctgttctcttggccatgtgactgagggcaccagcctctgcagctctgtgctgttctcttagccaccagggttctgtcatccttgcttctttgtacctctcctggacccagagcctgaagtgcggtggctgcgctcacccagggaggggtgcggggcctgcgctcacccagggaggggtgcggggcagtgcagagcgcaggtaagcagggaggggtgcggggcagtgcagagcgcaggtaagcagggaggggtgcggggcagtgcggagggcaggtgagcggggaggggtgcggggcagtgcggactacaggtgagcggggaggggtgcggggcagtgcggactgcaggtgagccgggaggggtgcggggcagtgcggactgcaggtgagccgggaggggtgcggggcagtgcggactgcaggtgagccgggaggggtgcggggcagtgcggaccgcaggtgagcggggaggggtgcggactgcaggtgagccgggaggggtgcggggcagtgcggactgcaggtgagcggggaggggtgcggggcagtgcggactgcaggtgagccgggaggggtgcggggcagtgcggactgcaggtgagcggggaggggtgcggggcagtgcggactgcaggtgagccgggaggggtgcggggcagtgcggactgcaggtgagcggggaggggtgcggggcagtgcggagcgcaggtgagccgggaggggtgtggggcagtgcggagggcaggtgagccgggaggggtgcggggcagtgcggactgcaggtgagccgggaggggtgcggggcagtgcggagcgcaggtgagccgggaggggtgtggggcagtgcggactgcaggtgagcggggaggggtgcggggcagtgcggactgcaggtgagcgggaaggggtgcggggcagtgcggagcgcaggtgagcggggaggggtgcggggcagtgcggagcgctggtgagccgggaggggtgcggggcagtgcggagcgcaggtgagcggggaggggtgcggggcagtgcggagcgctggtgagccgggaggggtgcggggcagtgcggagcgcaggtgagcggggtggggggggttgcggggcagtgcggagcgcaggtgagctgggaggggtgcggggcagtgcggagcgcaggtaagcagggtctctggggcttggttagttggttctaggtcatcaggcctgtgaggcccagattctgccacagagtagctgccccctggcggctctcctggtaccaaccgccttcacttccaagttgacagcttgatcatcaacatttgtccactttggctagttcccagcgtgaagtaaaaatggtcagaaccaccacagcaacccttaggggctcttcgtatttgccgagcatggtcagtagtactttatgtggattgtgtggtcctcacagtagccctggaaagtgggtactataattacttccatctcgcagaagagaaaagtgacgtttgcagagattagttgcttgccagaggtcgagtggtggagtgggggctgggagccccagggaggtgtccttagggcccctgtcctggcccccgttgctctgcgcattgtgccctggaggagatgtctgagcatataaggtagtagaggctgttggggcggagagtgacaggccaacaccacttcatgctcagctgcggctgacccttggcaggaacaagcctgtgttacttctgtggtttctgtctgttaacatacagggaggtcactcttggggaggaccccatgggtgggctcaccattgggggaggtcactgtcgagggaggaccccctggggtgaattagacgttcggggaggtcactgtccagggaggaccccctggggtgaattagacgtttggggaggtcactgtcgggggaggacccccttggggtgaattagacgttcggggaggtcactgttggggacgacccccgggtgggctcaccactgggggaggtgacagttgggctgggccactcccctttcctcctcctccactccgtggactcctggtgaattgctcatggttgtctgtgtgggtgcgcatccccgtgtcccagtccgtctgtgctgctgtaacagaacgtcgtacactgggggcctataaaccacagacgtttgtttattcctcacggctctgcaggctggaagtccaggcgcaaggcgccggcagatctggtgtctggtgaggtccagcaccttctcgctgtgtcctcacagggcagaaggggtgagggagtgctctctggggcagtaatcccagtcctgagggctccaccttcatggcctagtcacccccaaggaggccccacctcctaacaccatcaccttgggtattaggatttcacacaggaattttggaggggacacagattcattctgtagtgttgtgaattatgtgtgtattgaaaatgttggtatgtggtattttacgttagaaaagtgtctgtttcttaaaagaggccgagttgattaaaaaagatactcagatctgcctgtagtggtcctgtactgacctcactgtcccccggcactctgtcccgtccccagcgtgctccgtgcatcctacacgcatcctggtgagaggtgtcctcagccctttgcatggacgctggtgggctgtgtgggggaaggttgcccagctctgctcatggggcctgcaggctgctcgggggcaccagactctagtgtcccaagtcctcagagtgtcccctgggggtttgttttatttggacattttgatgggtttaaaaagtgtcaagctttgatttgtgcctttctgagtagcgagtttggtaatgcttatttgctgctcagcctccccttctggcattgcacattcatatcctgtgcctgttatttttttattcttatttttttgagatagagtcttgttgtgttgcccaggctgtagtacaggggtgtgatctcagatcctggcaacctcctcctgagagcagcccccgggcagaactccacccccatgacccaatcagatctcacaggagagcactcactatcctgagagcagcccctgggggaactccaccaccacaacccaatcagatctcacaggagagcactcactatcctgagagcagccccccgggggaactccacccccacgacccaatcagatctcacaggagagcactcactatcctgagagcagccccgggaggaactccacacccatggcccagtcagatctcactatcctgagagcagccacgccatggggaactccgccccataatccggtcacctcccaccaggcccctcctccaacattgagggtcacaagtgaacatgagatttgcatggggacgcagatccaaaccgtatgtgctgttatgaataaagatccaaaccgtgtccgctgttatgaataaagatccaaaccgtatccgctgttatgaataaaggtgccgagaacattttttttcaagtctttttgtggacgtgtgtttttctttgtcttgggtaaaaaataccaaggagtaggattgctgatttacaggttggatttaggttgaacttcacatgaaacaaccaaacctccttccacggtagctgcaccattttacatttccaccagctgcagtggagagttcctggctctccacttcctcaccagcatttcttgtggtctctcattttgattacatccattcttgtgagtgtgcagtggtgtcgatctcattgtgatttcattggaatttccctgatgatgatgttcagcaatttttttttttttttttttttgagagggagtcttgcccaggctggagtgcagtggctccatcttggctcacggcaagctccacctcccaggttcaaacaattctcctgcctcagcctcccaactagctgggattaaaggcatgcaccaccatgcccagctaattttgtattttttagtagaaatggggtgtcactatgttggtcaggctggtctcaaactcctgacctcaggtcacccgccggccttggcctcccaaagtgctgggattacaggcatgagccacggcgcctggcctttttgtccattttttattgggcagggagtttctgcttactctggatacaggtcttatgtttatatatttatataatttatgtgagaaagagaaggcaagccttagctgtggtcactctgctgtcccaggccaggctgcctcagggaacctgggccttgagatttgacctggcttgagcatttgatgtctctgtgcctccactccccacccctccactccctgcccttgagatgaggtcttgctttgttgcccaggctggagtgcagtggcatgatcacagctcaccacagtcttgaactcccggactcaagcgatcctcccacctcagcctcccaggtagctgggaccacaggcacgcaccaccacgcctggctaatttttaatttatttctggtagagatggagtcttgttatgttgcctgtaggctgttctcagaactcctgggctcaagtgattctcccacctcggcctcccaaagtgctgggattgcaggtgtcagccactgtgcctggcctgtgcctgttccttaattggcagagtgtgtgctgtaaaatgtatataacagggtcttggaggtacccgacatgccattctttaatgtcttatacgttactattatttttaaataaactgtattattttgagttcattgtaggttcccacgcggctgtgagaaaagatggagatcttttctattttagacccttgcctggtttccccagtggtgacggtcgggatgctaaccctggtgcaggtgaggctgtggaagtctccatccccgtagggagccctcatgccacctctcagccacgccatttccttaccctctggaaacctctagtctttgctctgtctgtgattttgtcattcgaaggatgcagtgtaaggggaagtgcagaattcttcaggtaattgtgtgtcagtagcttgtttcccgtggtgagactcctctgcgtgagtgtgcacggcttgcccagccagccacccgtggaaggacatctgggctgtttcctgttttggctactacagataaagctgctgtgacacttgcgtataggtttttgtgtgaatatacgttttcatttctgggataaatgtttaagagtgcagttgctggttcatgtgtggtaattatgtgtttagtttgttagaaaactgccagattgttttcttgagtggccatacattcccaccagcaatgtaggagcgtatcagcctggttaggctgccataacaaaatactccagactgagtggggagcagtagaaattcactctcgcagttctggaggcttgaaggccaagagcaagatgctgtcagtgctgattccaggagaggcctcttttgctggtttgcagatgctgccttttttttttttttttttttgagatggagtctcgctctgtcacccagactggagtgcagtggcgcaatctcagctcactgcaacctctgcctcctgggttcaagcagttctcttgcctcagtttcctgagtagctgggactacaggcgcccaccaccatgcgccgctgatttttgtatttttagtagagacggggtttcaccatgtttcccaggttggtctcaaactcacgacctcaagtgatctgcccgcctcggcctccgaaagtgctgggatcacaggcctgagccaccgcgcccggccgatgctgcctttttgctgaggggatgctgacatctctggtgtgtcttcatcttataaggacaccagtcctattggattagggccccactcgtatgaacttatttatccttcattacttgagggcccgtctccgcatagggtcatctggggcttccgcagatgcattttgggggcacacagttgagtccctaacagcgagtttctctttgtactcaccagcatttggcgtcgtggtttttactgtgatcattgtgatacatgtgtagcgatacctccttgtggttttgatttgcattttcccgatagcttgggagtgcttctttgccatctgcatatcttcaggggtgaaatgtctgttcatgtcttttgcccacttcctaattatgtttttttgaccaagttttgagtgttctttattgtagatttaagtccttcgtagacatggggttttcaagtatctgttcctagtctgcagcttgtcctttcgtcccctaaacaggatctttttggacgcaaactcagaccagttaattaaaaaaaaaaaacaaacaaagcggggtctgttgcagatccaaagtttttcattgtgaagtctgatttatttttccttttacgaatcacgccttgtcacagctaaggattcttagctctttatcttgaagatttgtctcctgtgtttttctgaaagttttaaaccttcacagttgcagatttatgtccgtgtttattttggtgaattactgtatgtggctggcatttacatgaagctcattgtctggcaccatttgtggatcttccatggagttgcttctgtgcctccctcagaaatcatctcgatgggctgggcgtggtagcccaggcctgtaatcccagcactttgggaggccaaggcacctgaagccaggagttcgagaccaacctgggcaacatagtgaaaccccgtctctactaaaaatacaaaaattagccgggcgtggtgacgcacgtctgtagtcccagctactggggagactgaggcaggagaatcgcttgaacctgggaggcggaggctacagtcaactgagattgtgccactgcactccagcctgggtgacagagcgagactccgtctcaaaaaaaaaagaaaaagaagaagaaatcacctggattgatttgtgtggctgtttctgcgattttctttccattccagtcatctttgtatctgtccctctgccaataccacatagccttgattaatttagctgtgtagtaagtcctgagatcaagtccagatattactatctttaaaaattatgaaatattttaaaatgcagaaaaatacagtaacataacgaacacctatgtcctactatccagaataaacgttaaccttttaacaaaatagtatctggggccgggcatggtggctcacacctgtaatcccagcactttgggaggccgaggcagggggatcatgaggtcaggagatcgagaccatcctggccaacatggtgaaaccccgtctctactaaaaatacaaaaattagccaggcgtggtggtgggcgcctgtagtcccagctacttgggaggctgaggcaggagaatcgcttgaacccgggaggcggaggttgcagtgagccgggattgtgcctctgcaccgcagcctgggcaacagaccaagactccgtctcaaaaaaaaaaaaaaaaaaaaaatggctctaaacctttttcacaattttggtagaataatgtcgcaatattcttggacttctgggaccttctccttcctggtggcgttttcaccaccaggagttcaatgcacatccttcctgctcattttccttccgctttccctgcactgtgtgtgatactgcgttagaggtgttaaaagtcacatcagtgatgctgtgtttttttgttgttggttttttgtttttttttttttgagatggacttttgctctgtcgcccaggttggagtgcagtggcgtgatctcggctcactgcaacctccgcctcccgggttcatgccattctcctgactcagcctcccgagtagctgggactacaggtgcccgccaccataccgggctaattttttgtatttttagtagagacggggtctcactgcgttagccaggatggtctcgatctcaccttgtgatccgccctcctcagtctgccaaagtgctgagattacaggcctgagccactgcacccaccctgtttttgttttttaagacaagatcttgctctgtcatccaggttggagcacagtggcttgatcatagctcactgcagcctcaaactcctgggttcaggtgatcctcctgcctcagcctccctaagctttgggattacaggcatgagccgttcccagaccttagtatacacttttggtcaggcaccacttaggtgctggatgtagatgtaaacaatgtggaggaaatttctgcttcatggtgtttgtagtctagctgagacagacggtaaacaggtatccgagtagtgtgtgatgtaatgttagatatcagaaagtgtcaggaaaaaggaacaagttaataaagagtggctgggatgggcaggtgcattagggaaggcatcgcagaagcggtgaggagcagctcctgagggacgcaagggagcaagccaggaggtgcccagggtcaggggccccttccaggcctgtggtgtgtgggaaggccctgggcaggaatgggcctgctgcgtttgaggaagagcagttgtgtcaatgtggtggcttggaaccaaatgcggggtgcggctggagaggaggaggctggggaggcacccagagacctgtggccctgctaaggtcatgcggcactgaaggcctttggagccttctgtctttctaaggtcatggggcgctgaggcccttggagccttctgtcctgctaaggtcatggggtgctgaggcctttggagccttctgtctttctaaggtcatgcggcactgaggcctttggagccttctgtctttctaaggtcatggggcgctgaggcctttggagccttctgtcctgctaaggtcatgcaacactgagacctttggagccttctgtcctgctaaggtcatgcggcgctgaggcctttggagccttctgtcctgctaaggtcatggggcgctgaggcctttggagccttctgtctttctaaggtcatgcggcactgaggcctttggagccttctgtctttctaaggtcatgcggcactgaggcctttggagccttctgtctttctaaggtcatggggcactgaggcctttggagccttctgtctttctaaggtcatggggcactgaggcctttggagccttctgtctttctaaggtcatggggcgctgaggcctttggagccttctgtctttctaaggtcatggggtgctgaggcctttggagccttctgcctttctaaggtcatgcggcgctgaggcctttggagccttctgcctttctaaggtcatggggcgctgaggcctttggagccttctgtctttccagtcatggcatctgaaaatgagaggagttttagttcctccttttttttgtgtttaatatattttttaattgacagataaaattgatgtctttgtcatgtacgctatgatgttttgaagtatatatgcatcgtggaatgaccacatctagctagttaacacatgtactgcatcatagttgtcagttttggggcatttttcagaatgtaatctgtcgttagtaactgtatagtcaccgtgttgtacagtggatctcttgagcttattcttcctagctaactgaagttttgtctttcgttagtttttcctttttgatctttatgccttttattaattttcctagctttcttgcattaactcgaatctccagtaaaatgttggcttacagtgctgagagcagacatcttgccttgtttctgatcttaggaagaaaacacgattaagtcttatgttagaagtcagttttttgtagttgttgtttctaaattttgttggtgatccagtgttccctattctgctaatgttgtttactacagtgattgattttttaatgttacaccaaccttgcattcctgggatgaataccacctggtcatgatgtagtatccttattatgttttgctggaatcaatttgccagtattttcttgaggattttttgtgtctatggtaatgagtgatctctttccttaatttggtatttatacccttctttggttagtgttatgctaacttcaagcaatgagctgggaacccttctcctctatctaatgaaagactttataagcttgttgtgatttcttccttaagtgtttgatgtaatttagcagtggagccatctgttttctattttctatttcatggatttccatttacttcctttcatctgtgtttttcctcacagatttatttattatttaaatattttaacagttgagataaaaatgagatatacaggctgcatgttttaaatgtttcggcacatgtcatgtatgtatgtgtgtgtcacacactgtatctgccacgctaatcaaggcagcaaacatgtgcgtcagcgccacggtctccctcctccccacggtaacccttcgccctgctttcctgttcccatcccaggaaaccactgattggccttctgttactatagattcatttgcattttctagagttttctgtacactaactgtatgtgtatatgtactctctttttttggcctggcattggccttctgttactatagatccatttgtgttttctagagttttctgtacactgactgtatgtgtatatgtactctctttttttggcatggcattggccttctgttactatagatccatttgtgttttctggagttttctgtacactgactgtatgtgtgtgtatgtactctctttttttggcctggcattggccttctgttactatagattcatttgcattttctagagttttctgtacactaactgtatgtgtgtgtatgtactctctttttttggcctggcattggccttctgttaccatagatccatttgcgttttctggagttttctgtacactgactgtatgtgtgtatgtactctctttttttggcctggtcgtttgtgttttctggagttttctgtacattgactgtatgtatgtgtatgtactcttttttcgcctggcatcttttactcggcatactgccttttcgtgtgttattcatgttgttgcatgtaacagcagtttcctcctttttattgctaggtagtgttagaggtgtgggtaatttgttcattcacctgttgatggacatttgggttgcttccatttttaggctattgcacatgaagctgctgtgtagaagtctctttacgcacatgtgccttcatttttcttgggtaaatacacagcagcgtaatgtcagggctgtattgttgatttatgttcacctttttaagaaatcgccaacatgttttccagagtgattgtaccattttccatttccaaaagctgtgcataagcattccagtcgctccacatcctcagcgacacttggtctgggcggtttttaaatgtcaagtattctgctaggtatggggtcctatcttcgcggtttaagtctgcatttctctaatgggcagtggtgggacacgttgtgtacttgtcacaagtatatctttggtgatgtgtctattcatatcttttgcacattaaaaattttgttgttttctgggcgtggtggctcacacctgtagtcccagcactttgggaggctagacccgcctgggcaacttggcgaaacctcgtctcttcaaagaataaaaaaattagccgggtgtggtgacgcatgcctgtagtcccagcttcttgggaagctgaggtgggaggatcacttgagcccagatgtcgaggcagtgggttgtgatagtgccactgcactccatcctggtgacagagtaggaccctgtctcagaagaaaaaaaaattgttgttacttggatttttaaaatattttctcgatagaagtcctttattaggtatatgatttgcaaaacttagtagtgatttatcttttcatcctctgaccagttttcaaaaagcagaaattcctgaagtccatttatcattatttttcttttatgggtcctgcttttgtgcttatatctaaaaaatcactgcctaaccttgggcatgtggaagcacagttggtttttgtatgttgcccttatatccaacaaccatcctgaatgcgtttgttatggtagcttttctttagtagatttcaccagattttctgcatagataatcatgtcacctgcagataaaaataattttactccttttttcatctggatgccttttatttctttttcttgactgatggcaccggcgagaacttcctcacagtgtcgaccatcagtggtgagaacaaggatccccgcctccttcctgatctcagaagggaggattcgacattgcaccacgaaatgcagtgttcctgttggtctctcacagatgccgtctatcaggctggggaggtttctttctgtcctcgtttgctgagagttttaaatttcatgatgtagtttttccactgcagaaacctaaaagaaaactaagcaaattagaccccaaaacaatagaattaaattgattttcaaatgttaaaccaactctgctcctgatgtcttggtgggcttggtttgctgttttatgaagaattcttgggtccacattcgtgagtgatgttggtgtgtattctcttttatgtcttttcctcttttgggcgtcggggaaggaggtcccctctcttgttctgggtattggtgatctgtcctctctctctggatcagtctgtctagaatttatcagtctcgttggtctttggagaactgcttgtggttttgtttttccttctattgacctctgttcttaggttattcctgtctgtctctggagtagaggaagtgaaaggcagtggtgtatgcactggggccgcgcacgctggggctgagtgcggggggccatgtacgctggggctgagtgcacggggccgtgtatgctggggctgtgtgtgtggggccgtgtatactggggctgtgtgtgtggggccgtgcacgctggggctgagtgcggggggccgtgtacgctggggctgtgtgtgtggggccgtgcacgctgggactgtgtgtgttggccgtgtgcgctggggctgtgtgtgttgggggccgtgtgcgctggggctgtgtgtgttgggggccgtgtacgctggacctgtgtgtgtgtggggccgtgtacgctggggctgtgtgtgttgggggccgtatatgctggggctgtgtgtgtgtggggccgtgcacgctggggctgtgtgtgtgtgtggggccgtgcatgctggagctatctgtgttgggggccgtgtacgttggggctgtgtgtgtatggggccgtgcacactggggctgtgtgtgttgggggccgtgtatgctggggctgtgtgtggggccttgcacgctggggctgagtgcggggggccgtgtatgctggggctctgtgtgttgggggtggggctgtgcacgctggggctgtgtgtgtggggccgtgcacgctagggctgagtgcggggggccgtgtacgctggggctatgtgtgtggggccgtgcaccctggggctgtgtgtggggggccgtgcacgctggggctgtgtgtgtgtggccgtgcacgctggggctgtgtgtgtgtggggccgtgcacgctggggctgtgtgtgtgtggggccgtgcacactggggctgtgtgtgtgggggccgtgcacgctggggctgtgtgtgtgtggggctctgtgtgtggggccgtgcatgctggggctgtgtgtgtgggggccgtgcacgctggggctgtgtttgtgtggggccgggcacgctgaggctgtgtgtgtggggccttgtactctggggctgtgtgtgtgtgtggccgtgcacgctggggctgtgtgtgtgggggggggccgtgcacgctggggctgtgtgtgtgggggctgtgcacgctggggctgtgtatgtgtggggccgtgcacgctggggctgtgtgtgtgggggccgtgcacgctggggctgtgtgtgtggggccgtgcacgctggggctgtgtgtgtggggccgtgcacgctggggctgtgtgtgtgtgggggccgtgcacgctggggctgtgtgtgtggggccgtgcacgctggggctgtgtgtgtggggccgtgcacgctggggctgtgtgtgtgggggccgtgcacgctggggctgtgtgtgtgtggggccgtgcacgctggggctgtgtgtgtgtgtggggccgtgcacgctggggctgtgtgtgtgtgggggggccgtgcacgctggggctgtgtgtgtgggggcatgtatgctggggctgtgtttgcggggggcgtgtacgctggggccattatgttttgtagaaaactgctggccacgccacaagtcaatttgtattttacttagtgaaggtatttttaaagcctgatatgttaaataaaatcatagcattgaactgacaagtctttttaattttcaggagggtttgcatttgtgtatgaagctcaagatgtggggagtggcagagagtatgcattaaaggtaatgaaccatttaacgccttctctggatttctgacgtatgtaaagggactgtctggtgacagtcttttcagggatgcgtccctgttacgtactttgtttccttttacagcctggacatacttgtcccttttgcttctgctgaatctcagcagccttgggcactgcaggagccttggtctccagctttgggcttcacactcctgtggccctgcctgccctgtggcaggggctgtgctgggggtgacctcatggtggggtcatgccctcttggcctccatgtgccaaaataagggctctatgaatacaaggagtttaaaagctgcttgtaaaaaatatttgttgctagcatttctgtaaataggggtcactgtgggagggtctgtactgtgcagttttgtcctgagacgtaagaaggccccatttgctgtcaccacgctgggcaccagggtggccccgcctttgagagtgggcatgagtgggcctgttgtcgtggtctgcacgcctgctgcccccgtgtctgcagagcattgccgctcttccttcttgtctgtctcattttactctggcccatttggggaaaggctcctgcttttgacttttcttgtgtccttgcatcacaaagatcttttgagggtcttgaacccccagcacgtttttacaggggtcagaggtggagacacacgaaacggggggagctgtattagacacattgcattgctctgttgcgtgcttatgtctgagatgatgcatcgggtggagtaggaaggtaaacttgctttcatcttttgtgtgtgctgtttcctgatacagaggctattatccaatgaagaggaaaagaacagagccatcattcaagaagtttgcttcatggtatccttttcctggaaccaggagccagcacggtggctttggcaggcacaggcctgcgtcaagctgtgaccgccagtggccaagaggctgctccgtgacgttgtctttcatgtgttaaaatcggctttttgcttttaccaaacctagttgtaggcgacttctaggaagaagcagttttttctgttttttttttactgccagggtaatagtagaagattcagaagtgttgggaatgaagttgttcctacccaagaggtctccctgcccagtggatgggctggttaccacagggggcccttgcccggcccggccccctcagctcctccggagacctggctgagagccgtgcagatggcctggctcccacaggccccgatgtggcttctcagccgcccctctcgtcccttctcaggctgtcccagcatgactgggcggggcatctcccggcgctgacagaggatctgggggctgcactccctgtccactgccacatgtccctcctgagcctggagtcttcggccctggctgccctcagactctgcctctctttcctctcctagctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcaggtgtgtgtggccggtgtgcctgcctttgtccccgccctctcctgcagctcctcctgcctctgtctgcctttctctcggtcgtccactgctctctccctcatcttccgctctgacgtctaaaattgtaagggttcgattcaagtattctgacttcagtgtgttaatattgtctacatttattttgaagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaaggtaacgtcctgtgaaggccggcttggtgccatctaacccagcagaggccggcttgatgcctcctaacccagctgcatggctgtgaaacatgcccggcatcttctctcaagctgtgttggtcttagcgggaagcgcgggcagctctctgacagtagttctgtgagaggcccacgctgacgcccagtgagcttcccactgtcccggtgggccacctgcatcgtctcctcgtggagctgcgggcagccagagagccgggctcccatcctgcctgtctccagtggcagcacggggtagagcgtggtggccttccgtgagtggtgtttagcaggggtggaggagcgtctgtccttctcagggctctggggtccctgtggggtggagcgtggtggccttccatgagcggtgttgagcagggtggaggagtgctgctgtccgtccttgtcaggggctctggggtcctggcaaggagaagagaggccgcagaggtggacaactccaggtccctctgtgggtgcccagcctcatcagggttgagcccaggaagatggcacaacgactccatggtccgtttgtcaggacaggaagagaggccggtgggttggggtggtgctttcggagagttctaggggcagagtggtctgtgtgagtgactgcgggggatgtcgtgttggtgtcaccggagcccacgctgactggccggagacctggcctgaccctgctgagcctcaggctgtgtctgcaaaggggaaacaagacctgtgcctcagagggcggctccacccccagccctgcctcgtgccgatgccctccagaactcctgtgccaggtgacgaggggaagtcgagcactcggggaggcctcagagctgtggcctggccggtgagggggtggtgacactagtgacccctgcgtctgtcccccaggcagggagagaggggagaggagaggccgggagcagcaggggagactgaggcagggagtcccacagaaggaagcctgtggggagggcacctgtagccgcgtgagatctgtcgtccacaagccagcccctgctcagcagccaggaggagctgttcccgcaggccggctagcgcaggcctgaagggacaggtaggggtggggcagcaggttagcagagagggcagcaggaggggcatgtgtccagaaatggagggcgagcaagggggttctgagctgaggggggacccctgcactgagcagggccctgagcgtcgtggaaggggccctgtgcttagtggaggggggactgcacttagtgggatgggggcatcccgtgctttgtggggggcctgcatttagttgggggggccctgagcttcatggagggggactgcacttagcggggggctctgtactgctgagggctgagggtaggtgtccctgtgctgagctgggggagccctgtgctgagtgagggagggtggactgtggggtgtaagctgcttggatatagcggctgcacctgtcagtgccctgttgggcagggtctcttctctgcagctgtgcctgggaggagctgggtgagacctgactgcctgcgggcccctggctctgcccatgcttctctgcctgggggtcccacctggcccttccttgatgccacacctggcagctggcccaggcccctctgcggccctccagcgcctgttgccagggttgtcctgacgtgggtggcggatgggtgcttgacgtggccgagaagtctcgggggttgggggtggtcagagccgcctgcaggctgaggagatgctgccaggtagccccagttcttcatctgacactgtggggatgtgccgcttgtgtttctcagtgttgtgttctgaaacgtcaaactggcggaaaagttgaaggcagcacaaggggcgtccattgtccacttcctgctcatggggttccccagacttgagcgtgtcccacggcggctttccctctctccattctaaccgtttaaaaataagtcgcagacgtcaagaccagaaagcctcataactctatacagcctgagagaaattccatgatggccactggtgtttgtgcccctgagaagatcctcgcgatttggtgaggctgtgctgtgtggtccgtgctgggcccttcccgtccctgtctctcccatccctgacacgccgctcccggcccctcccgtgcgtccatgcagtccgtgctgggctgtctcccccatccctgacacgtcgcacccggcccttcccgtgcgcataccggggcctcgtcaaggctcctgtgtgtgttcggttgaggtgtctgtcagtcaatctcttgttgttcatggcactgttttctctggatgtccctggactctgacacccgctcctgcgctgcgcttctagggcctcctccagagctgggaggtgctgaaaccagtgggattaagatttgtcgggagcacgcatcacgccgtggggcctcccgctcgtggtgttacttgtcagttttcattataaaagaatacatgctgattgacaaaatacaaataacacagagttaggccaggcacggtggctcacgcctgtaatcctagcactttgggaggccgaggcgggtgcatcgcttgaggtgaggagttcgagactagcctggccaacatggctaaaccccgtctcttttgtattgtaaaaatacaaaaattagccaggcatggtagtgggggcctgtaatcccagctactcgggaggctgaggcaggagagttgcttgaacctgggaggtggaggttgcagtgagccgagactcttgtctcaaaaaaaaccaacaacaacccagagttttatgagtgcttataaaaatgggattttactttatataattttcctttttaaaaaaattgaccgtatcaggcgtattttttttggagacagggtcttgctttgttgcccaagctggagtgcagtgattcatagctcactgtagcttcaaactcctgggctcaagcagtcctcccgccttagcctctggagtagctgggacttcaggtgtgcaccaccatgcccagctaattttaaagagtaaacttttcttagagacagagtctcactatgttgccaggccggtcttgaacacgcgagctcaagcaacacctgtagcactgggattacaggtgttggcccctgtgcctggctaagttttgtattttttgtagagatggtgtcttgctgtgttgcccaggctggtcttgaactcctgggctcaggtgatcctcccaccaaggcctcctgaggcgctgggatcgctggcgagagcaccctgctcaggcctctttccacgtggtgcggtcgcttcgttccatccagaaggctgcttggttttcctggtgtggatgcatcactgcgtcttctgtttgaggcctgcgggctttctcctggagctgcagcctgcctgctgtgtgagccttgccgcaccctctgcccagcacacttggagtaacttggataaaggccagacggggcttcctgtgggtctagtgatggatgttttgctgattatctccctcgtttgtcatttccgagatcagaaagcctttgcgaggggtaaatcttggttctagacattccggctttggaaggcttgagcaggacgggtgtgaaaactgaagctgctcggcgtccagtgtgttcccaggatatgtgcacgagggagcggcggggacagggccggggccagcggctcatcgctgaccctgcatggggtggtgtgggaaggagaggggccgggcccagcccctcaagtcataaatacacgaggcagactaacgcatgcgcgcgccagctcactcctggggactgcctgtctggagcagcatgtgcggctgagagctgagctgcagggctctgtggatggcacagctgtgccaggggagagccgtggcatctctgagaagcgggagggatgtgggctcccccgtgcagctgcaggttcagggctcactggaggaggcctggaggtcgggctccggggatgtgcccggtccctcccatgaggcaacccctccagtgtcctctgagggaagagccacataccggttccccactcagccacatacagaatttttacttttaaaaaccccatttattctcactgagaatgaggcactgaacagggggcccagttaccactgaaacagactcgcccatccatgatggccagcgtagagggcaagtcacccccactctgactccccgggcctggcctcagcctctcccgggtctgttcctctctttctgagcaccccattccttctatgggtgcccctcatttttcctgagagcccccctgtttctcagagggtcagcacaaagcttttgagggagctgtggtgagggctgagagggctttcacctggggttgagggccagggccggcagagctgggggagtgggagggcccctcagctgggtgcaggtgggggcagtgctgggctgtgctggggacacgcaggtgggtccggtctgtgagtcgattctagcgtggcccagcctgagctgtggcaggtcccgaccggctctcacaccatgccttcattgtcagtggaattgagtcggctacacgctctgctgtgtgcaggcatcgggggctcagtgactcgccagacacagctgatccatgcccatggcaggtggttgggtggctcgaagagccagggagagaatgagtcccaggagaagggtgcacgtttaggtggtgtgggcagagttggttccttgggaggtgagcagaaggggcggtctgggaggcatcctggccgcagaagcagcttgtgaggggtcctgaggcagggaggaagggaggccagtgtggctgggagcgcaagctctggcagcgtgggggagaccctgagtgtgggttccgtgggtggtggtactggccttggctctggggctgcaggggtcgtggccttcaggggtgtggagtgggatgagcagagggtgacggtggctgctctgtagagagcagaggcaggagcacggggctgaaaagatggggcacaagatgcagaggccccagggatgatgccacacatggactgtggccagctgaagtgggcaagacccagggtaagatcagggtaggagcaggatgggttgggtctgcacgtctgtgggggctgcataggggtgctggggtgactggcagtgtgaatgcttcagtccccagcaggtcctcagccctgcgtgctgccccggccccacatccctggtttcctggttgggccagggctagggtgcctggaaggtgccagccatggcaggacgggctccctggggtgtgggtcacgcacaggcactgatactgtcgtgaatgtgagaatgatcatttgtcatctgaggacactgagtgttcacttagaggtttgagcacttgtgtatttgtagtcatttctctttgtatccatgttaatgacatgcctggctcggttgccaggacacagatgtgattctcacgttaacggctcgccggctcggctgctgagatgccagtgtggttctcacgttaatggcttgccacctcggctgctgggacgccaatgtagttctcatgttaacggcacgccagctcaactgctgggatgccgatgtggttctcacgttaacggcatgccagctcagctgctgggatgctgacgcggttgttgcttcggtgacgcttgggcgtcttgccccctggcctctgctctgtgtgtgacttgactgtggggctgctccgagcccacccctgccactgggtggtggtcccacacacggggctgaggtgggcatcctcatacctgcagccctttctgcagcagctgaaggaaggaaaggtgggagcggcactcagggtgggcttaactgggactgtggctggaaaaggcagcgtggcctggtgtggtggcgtctgcagtaacgtggcctggggtgtggcggagtccgtagcatggcctggggcatggcagagttcaaagtgtggtgtggcgtctgtaatgtggcccaacgtggcagagtccgtggcatggcctggggcgtggcagagtccgaagcgtggcctggtttggcggagtccgtaacgtggcctggggcgtggcgaagtccgtagcatggcctggggcgtggcggagtccgtagcgtggcatggggcgtggcggagtccgtagcgtggcatggggcgtggcggagtccgtagcatggcatggggcgtggcggagcccctagcgtggcgcggcgtggcagagtctgtagcgtggcctggggccagggagggcagagcactgattgctccacggtgatgatgttaaccgtagagagtcgtgactgcaagttgtccaggttcttggcattttgaacaaactggacagaacgcccagcgaaacaaagaaagaatgaagcaacaaaagaacgaaagcgggaatttattgaaaacaaaagtacactccacggtgtgggggtggcccaagcagcggctcaagggcccagatgcagaatcttctcgggtccaaataccccctagaggtttcccactggccactttgtgctcacctcatgtaaacgaagtggtagcccgccatcagcctaatggttgcagaaagcagccaaccagaaggtcacactcctgtgcaaacatctgattggttacgaaaagcaatcagaagacagggtgaagttacagagttgcaaacgaagaggagatctgcagtcaggcagtttcccatctgccaggcagaaaaggtcaaagggagtcacctctggtcgttttgttacttaggtgtggaaagtcagggttttcctttccatttagttctgggaagtccgcgtgaaacagccctaggttccctgtctccggaccctgttctcctgcctccatgtgagtttcattctcttttagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggtagtggctccctccacacgcggctgccaaggcctctgtgtgcgggtcccactcggttaggagccgcccatcatccacagggacctcaaggtagcggctgctgaggcctctgtgtgcgggtcccgctcggttaggagccgcccatcatccacagggacctcaaggtagcggctgctgaggcctctgtgtgcgggtcccgctcggttaggagccgcccatcatccacagggacctcaaggtagtggctccctccacacgcggctgccaaggcctctgtgtgcgggtcccgctcggttaggagccgcccatcatccacagggaccacaaggtcgtggctccctccacacgcggctgccaaggcctctgtgtgcgggtcccgctcggttaggagccgcccatcatccacagggaccacaaggtagtggctccctccacacgcagctgccaaggcctctgtgtgcgggtcccactcggttaggagccgcccatcatccacagggaccacaaggtagtggctccctccacacgcggttcacagcctctgtggggggctcccgctcagttaggatgcaggggtgagagcaggtgaggctacaccatctcacctagaagatgtgcgtgagcctctcaacagtggaagcggatcttccagaaacgttgcttttccagccctgaagaaaattagcatctgtctcacaggcctttgccgacagagatcccgggatggccccgcctccctgctgggggccttcacgcccagttgggggtgctcacagcctggagcttccgtctggaataccaggtccccatgctggatgcttgctcactccagtttccgtggggagctgtggacgagggtgcccgccggtggtgtcagttcaggaccctattcctgctcaccccacactccttcctcggccgcccccccaccgccccccggtggtgtcactataggccccgcactcctgctcaccccacgctccttcctcagtcccctggtggtgtcagttcaggccccgcattcctgctcatcccacgctccttcctcagccccccagtggtgttggcccaggcccccaactcctgctcacccagtgccccttccttggcccctgggcagtcctggaccccacagtgcctccctggttcggcctcttggagctgggaggaagcctggcgctcctctgcctggccctgtctcaggcgctggggtcgggggccggaccccttgcctactcagcttgaggggagctctttgcacttcctgactgtccccccactgcacctccccttccgttcaccggcagactctcctgcccatctctcctgtcaccacgggtttctccgaggcgtggcatcccggggttggcgtgatgtgggcatgagccactggctgcatgtaaaagggccgtcctgcccaccacactgccacacagatgcttctagactggggctgggctcgcgctccatccctgcccaccacaccgccacacaggtggttctgggccggggctgggcctgcgctccgtgctgctgccggcactgcgcggtttccatgtgatgtggctgcttcccacagccccacagaggacactcctgccccgtgggctgtccatgccctgagctgcctgtgttgattttggctggcctggtggggagtatagtctgacgggttgtgattttgccttttcctgatgttaatgaagttgaatgtttgttatagtcattcgggtcttgctcttcagtaaacttccttttgtttcttgcctttttcaaagattttccactggcttgtgtgtttggttcgttggagcagcttgtgtattctcataatctgctaagtgtcgcctgtgctgccggcgtcttctggtttgtggcccagttttcactcctgctgttgtgttttttaaaaaacctaggacgttgtgaggcttctccattatctgtgaagcctgtgcctggcctgcccatggtgggcctcgtcctccgtgctgaggcttttgctgaagaggttttttggggttttttttttttttttttgagtcagtcactctacagcccaggctggagtgcagcggcactgacggggctcactgccgcctcggccgacttggcccaggtgatctcccacctgagcctcctgagtagctgggaccacaggcgcacaccacgcctgcctagtttttgtattttcagtagaaatggggtttcaccatgttgcccaagctggtccagaactcctgagctcgagtgatccacccgcctcagcctctgaaaggggtcgattccaggtgtgagccaccgctcccaggctgccaaagttttaaagccttatcactcccagatacttttgtccatgtctctggggacgtgaggacatttctgttttttttttttttttaggcggagtcttgctctgttgcccaggctggagtgcagtggcacgatctcggctcatgcagcctctgcctcctgggttccagcgattctcctacctcagcctcccgagtagctgggattacaggcatatgccaccacgccgggctaatttttgtacttttagtagagacagggtttcaccatgttgtctaggctggtttcgaactcctgacctcaagtcaccctcccgccttggcctcccacagtgctgggattacaggcgtgagacaccacgcccggccaggacattttttatgtggttttgacaccattatccgcagtgaggtgggaggaaccgagccttgtctcttgccctcctgttctcagccttccctggttttcccaaagtgtggcttctctcagacctcgctaatcgggagcggcgcctctggccacggcttgtggaggatgccctgtgctgtccttggctccccgccactgcccaggccaaggggacgaggaggccagtgaggccccagccccgtggcgtctcttgtggagcacggagctgtgtttcagatcctgctcccagcacccgcctcagctgctcctccagctgctgaaatctacctggcctgtgtccagaggtttcgttcatctggaattgaccttgtgtgacctgaggtgggagctgtatccttgtgtctacctggccctgcaccccgtgcatcagctcatgtctgcccatgcagccacctgggccccgcctcctctccagcgtctgctcgtgggtgcctaggaggcctcagagccccccagctctccccgtgtgccctaggtgggggatccaaggccgtggctctccacgtgtgccccgggtgggaggcccaaggccgtggctctccacgtgtgccctgggtgggggatccaaggccgtggctctccccgtgtgccctgggtgggggatccaaggccgtggctctccctgtgtgccctgggtgggggtgcctaagccgtgggcacccatgctgagctgttcttaactgcacaggctcattccgcctcagcctgcctcagcccacccagggccaaggctctggcaggcagcttccctctgtgtttctctggttagggctgccttttctctacttggctgtacactcctactttatagcacaggtgtcttcacgtagattttgaaaatgggtaagtgtggcctttttcgtttgtcccctgaactcagagggcctagaatgccagggtgtaaggtggccgactggacagatgccccatggcagaagcctgtgggcaccgccatagagcctgctcctgagccccaggccctttcgctcccatggccaccgctgtggagcctgctcctgagccatgccccaggccctttcaccccttctccttcctttcctccctccctctcttccttctgtttcttctttccttgtattttacttttctaaaagtacattctgcccagcacacagggttgcttttgagggaagcttcttcaaggttgcaagcaagacccctggtttccagaaacccatgcgcctgaggccccattctgacggaaggggctgcagggctccatgaggggccagtcctgcccgtggaaggtgctgtttgctgtctgggtggttcttcctgaggagtctctgagtggtggattttctcatgacaccgagaccctcctggttcgcatttttgaagtgtgatgggtcgtgtagcggggcttgagtgtgtattttaaggagaacagaaacagaagggttgaattggtgaagaatccgtgtctgtgagccaggcctgcacttcacagcactggccttgctgctgctccacagcggcgtggcgggaacccaggccagccctgcagcccgcgtgtgttcacctgtggcctccgccgtgggagtctggacggctgtttgcggaggggcaggcagcacacgtggccccactcgcctgccccgtgcgtcgtcctgctgtgcgcacagcttcgtctctgttggctgtagaatgggaacgggcacaggtggccccactcgcctgccctgtgcatcgtcctgctgtgcgcacagcttcgtctctgttggctgtagaatgggaacgggcacacgcgaggggatgggcactcctgggccttcagtggccgtgtgccactgcatctccccgctgtgtgctctgcatccgagccagggtcgctgatcttttctctgggcgtcctgtgaggggagcctcgccccacgctctgcatctgattttcttgctcagccctgtggttcagaggccccggtcctgtatgtggcccgcatctcctcgggggccagtggtggccttaggcttcactgggtttctctggtcggccatgggtggcatgtgtgtccgtttctttcccttgtttatggtgagccatcctgtctgcaccacgtggacagcctgttcagcttgctggtccgcggagcaggcgtcctctctaggactggggtctgcagggcgctgtggttggagagcgtctgcatctaaccctgggcgtccccttgcactcttggatgccacggctctgcactttgctgtcctggggcatggcgggtgctgctccctcagcctgtcctgggtgcccatggccttagtttgcattttttctcctgtcgatgaggctggcttatcagaacttgggcttcctctgggaaaatgcctgcctttcctcgacttgccttcctctcgctgcctgtgtgagcccatactgaccgcgtgcatgccgagcaccttccgtccgtggctggtgtgctgccctctcggagccctgtgctgcctgtgggagcccgtactgaccgcgtgtgtgccgagcaccttccatctgtggctggcgtgctgccctcttggagccctgtgctggcattgttcttcctctccagagggatgcctgtgctggccatcctgccacgtctgtgctgtctgtcttgttgaagaagccgctccttccctatctcagaaggagctcctctgggccatcttccgaaagatctgtggtttgcctaaatgttggggctgaggcttccttgattgtgtgagctgggggcgaggctttctcctttcgttccacatggatgcctggtgctggcagctgttttgccatggctctgccattaagatgggtgttgtgtggggcgtgagcactgtggggctgagtcactgcgttgctgccttgtcacgcgtgcagcctctggcgtccgtggcttctcagcagcactcgctggattccctgtttggcccgagctcccatgccctgttatcagagctgcgccagaaggtgtaatgtgggcttcacaattgtgtggccctttctagttctttgtgtctctgtatacttttttttttttgagtcggagtcttgccctgtcacccaggctggagtgcagcggcgcaatctcggttcactgcagcctccgcctcccaagttcaagcgattctcctgcctcagcctcctgagtagctgggactacaggcgcccgccaccatgcctggctaatttttgtattttttagtagagacgaggttttaccatgttggtcaggcgtgtctcgaactcctgacctcaggtgatccgcccgccttggcctcccaaagtgctgggattacaggcgtgagccaccacgcccggcctgtgagccccattattaactggattatctttctttgatttatgggtggtttttaattttctgctttttatttttctgaattacacatattacatttgatcagaagtaatttaagacatctttgaggaaggctcatttactgaactctgtgaaatccctcagcccctcggggcccgcttctcaggccggcccacccgccagggcccctctgcctaggcctggagcggcccctgcaccccgagctgctggtgcagagctggctgtgtccgcaggtgtgaggtgctgcaggcacccggcagccgtggccctgggcgagtgctgtctgcgaagggccctggctgtgtctcacacccgttcgttttccctgaagtcccatctctgtctacgccaagttcacggggctgtcttgtggaattttacaggttgagaacttgttgcttagtaaccaagggaccattaagctgtgtgactttggcagtgccacgaccatctcgcactaccctgactacagctggagcgcccagaggcgagccctggtggaggaagaggtgagctgagtggggcctatgctgggggaagctggcccttcccacattccacgccctgagtgcggagtgctgttttccgccggggtgctttgagtctcgctctgtcaccaggctggagtgcagtggtgcaatcccggctcactgcaacctccgcctcctgggttcaagcgattcttctgcctctgcctcccgagtagctggggttacaggcacacaccaccacgcccagctaatttttgtgtttttggtagggacggggtttcaccgtgttggccaggatggtctctatctcttgacgtcatttgtgatccacccgcgtcagcctcccaaagtgctgggattacaggcgtgagcaatgtaataaacagactttattttttagagcagttgaaggtaacaggaagtggagctgaaaacacagggtggccccatccatgccctctcacagcccctccttcctctgagcccctcacgtccttggctctcctccgaagcttcttttcccagagatgggcagatagatgccgtctctgcccacacgtagcctgctctcaccctgtgtcttggagctggaggagttaacttgcgctctctgcacttgggccttcttgctcttgtgtcttgcattggtagctgactgtcccggcctcaggcaggtcattcctggaaagcaggtcttcgtgcttttcagcatgagtggagggcgctttatcctgctttccgtaagctctcattttcccattccctttaagaaattgtggcctgcccaaggccgtgcgctgtcctgctgtataactgcagagcccacttgccccctgctctcctgtgaatctgcagctgaggatggggtttgtgtgtctgccgtgcacggagattcactgtctcctcacagctctgcggccccagcctctgcctctcacaacatgtctgccatgcacggagattcactctctcctcacagctctgtggccccagcctctgcctctcgcaagtgcctccgtgtgtttgtgaggctctccattgttaaccttgaaccagtcgggtgagcttgggtggacggcttcctcctcccagataccctcacgtaccctggggttctgggtgtcacagaagctgctctgggtgcggccactctggagcggggcccttgtgccaggtgagacacccttctcctcagcaagcggacttggtgcgcagcaggccaatacgtcggtgccgacatgccatgaagcacgggaggccgtaggagattgagggaggtgaatgactcagtcctcatcgtaaggagcgcgctgaggccgaagatgagcagcggagctggtgcatggggccgactggcctgaggtcatcccggggcatagtgtgcgggacaggctgcccctcagtctgctgtgcatttggaaagctgcacggaagtggtgcaacataaaaaatactgtttgtgggatgcaacttttcctttgaaatgtttgtattttttcagatcacgaggaatacaacaccaatgtatagaacaccagaaatcatagacttgtattccaacttcccgatcggcgagaagcaggatatctgggtgaggtctggcgcctctcagtggcagtgcctggctccgtgcgccctacttaacctgaggcggcgtgggccgggcacctgccactcggaactggcctgcctcctccaccccctcttcccctcccgtccccttttctttttcctttccttaagaatcactgtggctgccactgtttttttgggtttttttggagacagggtcttcctctgtcacccaggctggagtgcagtggtgtgacctcggctcaggctcaccgcagcctcccgcccctgggctcaagggatcctcccacctcagcctcccgagtagctgggaccacaggtgctcaccaccatgcccggctattattttgtatttttggtagaaggggtggtctcaccatgtcgcccaggccggtctcgaactcctgagctcaagcggtccacctgcctcagcctcccaaagtgctgcgattacaggcttgagccactgcaccctgcccaaccttgactacttctaatagggatgagtcgagtagcagttgggggcgtcctgtgcggctgggtctgcctgaggctcccctcggccccgtccatggcttgttgtgcatctggccctgagtgccttggcccaggagtgtccctgccacaccccagccttgctgcgctcagagccaggccagagtgagggctgagcctgatggctggggtggtctcctgcgtcctccctcatccctgcatctctccaaggccatgtccccattgaccgagggtgaccacgcgtggagggtgtcctgccttgtggttcttttgacgtccccttaccccgtcattcagccaccaggtgcggcagttggccctccgtagtgtatttgcctacggaccgggtcagccgtgccatcagccacagcacatgggctgaaggctgagacagcacgtggggctgcaggctgagacagtatgtgggctgtaggctgaggccctgtgtcccttgaggagtgtggaaggatggggccacgtgtgtggtcattgcctgtgttcttggcccaccctggtgactggtcctctgcacatcccgcacgaggacactcctggccggctcttgctcggcctggggtcccggtgtgagctcttactcttggctggataagatcctgatgccgaagtaatcaccagtcccttctctgggctcacatattgggtgattgacgagaagtcgctgattgttcaaggccagttctgcgaaaatcctgagcagactgaggaggctgcttcctgcagcttctgccctgtgccctacaccctgcatatggggtcagttctgaaaagtgggtctctgctgttgccaaggacaggacaggtgccttgcccctcgcatagcacacagcagggtctgtgctggtcccaccagctcatagatcttcagtgcatgagtgtgggaaccccggaattttgaaaggaacctttatttatttatttatttatttatttatttatttatttgagacagagtctcgctttgttgctaggctggagggcagtggcgcgatctcggcgcactgcaacctctgcctcccgggttcaagcagttctttgcctcagcctcctgagtagctgggactacaggcatgcaccaccacgcctggctaatttttgtatttttagtagagacgggatttcaccatgttggccaggctggtcttgaactcctgaccttgtcatccacccgcctcggcctcccaaagtgctgggattacaggcgtgagccactgcgcccggcctgaacggaactttttaatcttaagagcctagagtccgtttaacactgtcacctggacagttctttgcggtgaatagaagtggagcatccaggcctccccgtgccgtgggaagcacgccgccagctccgcacagtcaagtgatgtttgtgtaaccaccgactatacccctaggatccccaaggaaggagccacccctcggccagtcaccatgtctgcggtgctcctctcacgcccttgtccccttgggctcgggcatcacccctgctctcccctcagacctgggagtcacccctgcactccccgcaggcccaggagtcacccctgcgctccccacggctccgacgtcacccctgcattccccgcaggcctgggtgtcacccctgcactccccacaggcccaggcgtcacccctgcgctccccacggccccaacgtcacccctgcgctccccgcggcccgggtgtcacccctgttgttcccgcaggccccggtgtcacccctgcatttcccatgttcccgatatcacccctgtgttccctgcagtccccagtgtcacccctgcgctccccacggctccgatgtcacccctgcattccccgtgggcctgggcatcacccctgctctccccgcaggcccaggcgtcacccctgcgctccccgtgggcctaggcatcacccctgctctccccgcaggccctgggctgcatcttgtacctgctgtgcttccggcagcacccttttgaggatggagcgaaacttcgaatagtcaatgggaagtactcgatccccccgcacgacacgcagtacacggtcttccacagcctcatccgtaagtcccggtggaatgcgtgcgtggggcaggaccctggagcacagaccccgcgtggctctggagaccccgctccccttggggcactgctcacctggccccactcccgcccgtcaccatagttttgacaacatccctggggggggggtttccagagagctcccctgccgcccaccccgctggtgaatttgcggtgctctgagtggtgatttttgatcattttgttcggtttttgttcttccctttgccgctcccttcttgcttctgacgtcactgatgtgtgtagagggagtggcctctggtggtctgtgacctctgccagtgcagggggtgctgacccgcctggggaaccgtggggccgagcgcgctgtgcttctgctgcaggcgccatgctgcaggtgaacccggaggagcggctgtccatcgccgaggtggtgcaccagctgcaggagatcgcggccgcccgcaacgtgaaccccaagtctcccatcacagaggtgagggaggcacacgtgagccccaaatcccccgcagtggtgaaggaggcacacatgagccccagatcccccgcagaggggagggaggcacatgtgagccccagatcccctgcagaagggagggaggcacacgtgaaccctaagtctcctatcacagaggggagggaggcacacgtgagccccagatcccccgcagaggggagggaggcacatgtgaaccccaagtctcctatcacagaggggcgggaggcacacctgaaccccaagtttcctatcacagaggggagggaggcacatgtgagccccaaatccccccacagagaggagggtggcatgtggctgtgctgcttcgtccggaccctgcaccctgggggtctctgcccacttcagtggggagccacaagctcttgagggccctgggctcctgcaggagcagggtcaccaccgcagcccagggccgagaccccgggggcatgctgggaccattgccaaggtcttcgcactctgcacgcgctcctctggcctccttgaggtttgcaggcgcctttctagattcttcccctgacaggacagcatgaattgctcctgtgtctttgtttctggggtctggtgtccaagccaggtcagccagccctcagctctgggcgtcctggggtgtcctgagttgctctgcgtctgtgtttctgaccctcagctcagctctgggcgtcctggttgcagttgtgtcagggctgggcctggccagggtccactcccaggcaccggtggctgctggcagcatcagggcctgggggctgggagactgaggcccacagggccgtgtgctttgtggaagtgtgaggcctgggagggagcagcacgtgttggctggaagatgctttcctcagagtcttttctgacccagccgtggacagggtgcagcatctccatcaccagatcctcgaggcagagcagacacgcggcccggccctcacccacggggagcagggaggcccctgggcatcccagctcagggcccagtcaggacacgcagggcccctctgcagatctcgcaggggtctgtgtccaaggacccaggactcttggctcctgcattttgtccccttttcagcccttgggtcgtttccactccctggtagctggaagccggaacttccaggggccactgcagtggagctgacccaggcggtgggtgtggagcgtggggagaaggtcagagctgctgcccggagtccctgtctgaggacaggaccctgtgggacaaggaaggtttgggctgtgtggagggtttgcagttccttgggggccgcgtgggtacagagacctgggagcagggaagtgctgggaagcccagtgcagacggggagaggctgtggtgcccctctctggcggccatcatggtgggtgcaccagcagagggagccctggtgctgggtgctggaagcattttgaggtgtggggcgctctgaggcgggagagttgatgtcactggtggcctctcagcaagcttccctggggctgtcagagagcggcaggaagggatcactcctgggccgtcctgctctttagcagcctgggcctcgtgtccccctcgcttggtggctctttacagaaaatgcctgcccactcccccggaggtcacagaggacagtgggctcgcaggggggtgtgggcctcttgctttgtcgagtgcgctggagggattcttgatggggcgggaggaggtgccgctgggcagatgggcagaatcaggcccctagtgatggggcggggtcctcagtgcttctcatctgagtgcttctaggccgggaccccgtggggacagacgttagacccctgcttaagccaaccgactcccccagaaaacacagtccatgatggagctgagttcacaatgaaataaaatactgcccccaggaggtagtgagcctcacagggtggcccccagaacccaggagctgaagtgatggaacatcctgggacagacaggccatgtgtctgcttaatatggttgggcatgcgaggtggaggctgcagtgagcccagatcatgccactgcactccagcctgggagacagagtgagactccgtttcaaaaaaaaaaaaaagaaaaaaagcctgggtgcagtggctcacgcctgtaatcctagcactttgggaagccgaggcaggcgaattgcctcagctcaggagttcaagaccagcctgggcaacgtggtgaaaccccatctctactaaaatacaaaacaaattagccaggcgtggtggcgcatgcctgtagtcccagctactctgggaggctgaggcaggagaattgcttgaactcatgaggcggaggttgcggtgagctgagatcgtgccacagccctccagcactgcagcctgggtcacagagcaagactctgtctctaccaaaaaaaaaaaaaaaaatgttggttggacagactgggaagagagagaaaaggaaaaggaacagaagctgtagcccaagagtctgaaaagctgggctggagtgctgagcacctgcaacagccccaagcgaggcaggccgcggggtgaggggatgagggctgcgtgcgtttgttgagttccagctgatgcttcagcctgtgggaagttcctcccttgcactgtgtcatagatcagggggcagaaggatgggctctgagggcacccataccgtacctctgcccgacgtgggcaggcgtgagttgtcagtttagagaactgacctctgcattttcattgtcacagctcctggagcagaatggaggctacgggagcgccacactgtcccgagggccaccccctcccgtgggccccgctggcagtggctacagtggaggtgagtgccctgtcctgtgcccgccacctgtccctcgctcctgctgcaccccgggcacccgcagcacattgggatggagtctggggtccttctctcccggggcctcctctcccaccagagatgactgtgaggtcagggtccctgagcacaccctcaggttcggcagttccctggggctcacagagctcagcaaagctggtgtcttggtgcagttcaggagggggtcaggattcggactaaagccagccaagggaagaggctccagggcagggcccaggagaccgggcccgagtgaccaggcggcctcgctcaggggttatgtgggaggcagcctgcgccgtggccaagaccccagcatagatcacattgtcgtgtctggcacagcccaaggccccagggaaacagacaccccttttggggctggagggggcatcccaggttccttcccaggagctgggaatgaagggccaggcctgctgtgggcaaggtgaaccatttactacagtagcgaccctgaggccagggggcaggagcaggcattggacagtggagggcggtgggggaagacagttctgccgctagtgtgaggtggccccttctgccgcatgaggagtgggcacctgtgatgggcctgggtgtccctggagggccctcagctggtgaggagtggagagggccctggagacagacgctgcatgctcttggaactccgtgccgggagtgttccagaaggttccgggtgagccgtcgaggacatggccctgacaggcagcggctgggtctgcagctctgcatggcgctgacccctcccgacctcgccccgcatccccactgcggtgtgggaggtttcacctgggtccttcacctccgcttcccagggaggagctcagctccatgtctggggcaccccggtccgtgcagtgtgggtcccacacatgcaggtgtagtggctggctgggtctctgctggctggaggaagggtgagtcctcgagctgctgggttctgcagtgcccccatctgctcggtgctgcctgggcctcggtctcctgtctgcatgagggactttggccaggtgttttttttttaacaccacttgtgccaccaaagccgcctgtgaagacctcactcgcaggacccaccaggccaggggccaccactctgccttcacgtccagggtcatggtggcctgaagctgtggccgtgaggccggactatccccacagacagagtcccagccccagctgtgctgaggcggccacatagcccttccgcacccagattgaccatttcctgggtctctggaaaggctgaggacagggtagacctgccagtgctgaggcctggcttcccgctgggtacgtgtgggtcaggggcctggccataccacccactccctgctcctgctgcctgggcccagccagcaacctgcacctggggaggtgggaccgagcgcctggggaggtgggaccgagcgcctggggcctgggcccagccagcaacccgcacctggggaggtgggaccgagcacctggggcctgctgagactgtgtctccctgcaggcctggcgctggcggagtacgaccagccgtatggcggcttcctggacattctgcggggtgggacagagcggctcttcaccaacctcaaggacacctcctccaaggtcatccagtccgtcgctaagtgagtgtgaggctccagagccctggacctgccgcacgctcgttccaggctgcagccccggcccttgcttcctggctgcggtggaacagctggtcatcaggccccacaggggcccctgaggcagtgggacagcatcacccgcttctcccagggagtcggaatgagcccagcatcccacagagccaggcagatccctttcctttcatcgcctggggggcaaggccctgctgaggagatgcctgggccctcccctcccttgctgcaatgtcgcccctcactctggggcgttcctggcttgttcccgggactctgtaaattgggtgaaacctcggtggtggcgcctcactgagccagtccttgagttaaagccctagttactcagacttagaccaggtgagtcccagcctgtggtgggagaaagtctccctctgggtgggctgtccaagggcgcgtctgtgcgggggtggccccgacatcggcccacaggcccggcagcctctgctcacggaacactgggaatgttccagagtgcggcccctctgcgttgcggggtccatgcgctggctcttctgaggagctgaacgcccaggagcacgctggctgctcatctggccctgcggtcgcaccagctcaagggcgtcggctatgtcaggaaacagcctaggagctgggctggactggtgcccgtgatgcaggaactgcggcccctggtgggcccacgttccttccacagctggcgacaccttcgggctttttcttatgttttttgttctgtgctgtgatcactgttttgtgtccccagcaccaggtagacgtgtgtgcacttgtgcctgcatgtaccgcagcgtctgcacatgtgagcgtgggtgcatgtgtctttgagcatgtgtgcatgtgagggaatgggtgtgttaacatacatatgtgaacatgtgtgcatgtgtgtgtaaatgctggtgtgagtatgtgcataggcgtgtgtgattgctggtatgagcatgtgtgctggtgcttgtgagtccttgtgcttgtgaatccttgtgtgagctgagtgctcgtattgtgtgcaggcacgtgtatgagcacatgtgcatgttggagcatgtatgcgtgtgtgcatgtgtatgcatgtgtaggagtgcttgtgagtgcgcgtgagctgtgtgcatgtgtacacgtgtgcgagtgcctgtgagtgcacgtgaactgcatgcatgtgtacgcatgcgcgcgagtgcctgtatgagccgcgtgcatgtgtacgcatgagtaggagtgcctgtgagtgtgcgtgagctgcgtgcatgtgtacacacgcatgcaagtgtgtgtgagccacatgcatgtgtacgcatgcacacaagtgcctgtgtgcgtgagctgcgtgcatgtgtatgcatgtgtgcgagtgcctgtgagtgcatgtgagccgcatgcatgtgtgcacatgcgcgcgagtgcctgtgcctgagctgtgtgcacatgtatgcatgcgtaggagtgcctgtgagtgagcatgagccgcgtgcatgtgtacacgtgtgagtgcgcgtgagccgcgtgcatgtgtacacgtgagtgcgcgtgagccgcgtgcatgtgtacacgtgagtgcgcgtgagccgcgtgcatgtgtacgcgtgagtgcgcgagccgcgtgcatgtgtacgcgtgtgtgcgcgtgagccgcgtgcatgtgtacgcatgtgtgtgagccgcgtgcatgtgtaagcgtgtgtaggagtgctgtgcgagcgcctgtgtgtgtgagctgtgtgcctgtgagtgcgtgtgggccgcgtgcatgtgtaggagtgctgtgtgagtgcctgtgtgtgtgagctgtgtgcctctgtgtgtgctgcatgtttggctgtgtggttccattacctgtgtgccttgtccttgtgcaaccttttggaaagaaacctgctcttagtgggcctgcatatccccagagcaggacgtgagcccactcgcacctctgggcacctcctctgtgacgcctcctgcctgagttgtggctgacagaagatcagaggcagctctgtctgtctggtgccagcgcaccgcccactgggcccagggctgtggctcctgcagggtcctgacaggtgacactgcgtgtggagcgtcagcagggctagccatggacccaggggggtgagagactctccagcgtcatcttggtgagagtgatgttgggatcagagtggaaacaagacagagaggatgcggcagcaaagccataagtgaaagtcactaggaacggtcactttcggcatcagtgaaaatggtctccatggccgcagcacattgtggggacaggcagagtggagtcagcagagggaggaggcatgtggggcgttcagggagccgggcacagctccagagtcctccctgggggactccaggccacgctccctccccagcagctgtggggatggtgggagctgctgtctgctggaagcctaaggccgcaggggctggttctagaaatggctctgctgggacccatgggttccaggccctaggaggacacagtttggcttgagcaggcgctgcttgcatggcactcaggcacagctagctgctgcttgttaggggatggtgggaaccctcctgacacccccaggttccagctgagggcagccctgctgtttgttttgctctgccttctgttcacatcacgtgcttgaggcagatgaagctgcataacctcgtgtttgtaaagttgacttagaagcaacagtgagttctggttgggcctggaggctcaaaagatggctgggcacggtggctcgtgtaatcccagcacttcggggggccgaggagggaggatcacttgaagattgagacgagcctggacaacacaacaacacagcaagaccctgtctctacaaaaataaaaaattagctgggcgaggtggcgtgcacctgtggtcccagctacactggggcctgaggtgggaggatcgcttgagcccaggaggttgaggctgcagtgagttgtgattgtgccactgcactctggcctggagtgagcaagaccctgcctcaatttaaaaaatgaaaaaaaaaaaaggacagtgaattcatttgtgcttctggctctcccccacggacaagcccaggagtcaggacctgggtggccatgagcccctggctgccctggtgcttgctgttctgaagccagggcctcggggcctgagccctgtgtctgggccctggtttctgtcccgtcagcatccggtgcagccctagcacacacacacctgtggtacacgtgcctgaggcctacacagccaggtccatggggcccccgcagggctgctggggtgggtgagatgtgcgtggatcctgtggcactcaatgcccacctttgcttaaggcgtgtcagcttgctgtgcttgccgctgcctgccgtggtacaggagcagtgggggtttcaccatgttggtcaggctggtctcaaactcccaacctcaggtgatctctctgcctcggcctcccaaagtgctgagattacaggcatgagccaccgcacctggcccctatttttgtttttctaccggtgattagattataggtccagtagccatgctttgtgtggcctgtttgtctcttgctgcaaaagtggccaagcgtcaggctcaccgtgcctccccgtcttcccttgttgctttggaagacccgcatcctgtgtcagcacctgctcggtgggtttagacgccttttaaaacgtttgaacgcacggaagacccgcatcctgagtcagcacctgctcggtgggtttagacggcttttaaaacgtttgaacgcacggaagacccgcatcctatgtcagcacctgctctgcgggtttagacggcttttaaaacgtttgaacgcatggtcactttcaggcgatggttcggtcgtgtgtatttgggtcattcatctctctggacctttatccaggctttcctctgatggggacagcacctctgcgatgtgcctagctgaggttgctcctagcccagcctttctggtccccgcagcctccggcctgctctgtcctgggagggaggctcccttctgctccttccctcacaagaacagcttggccattcttacacagctgctgctgccagtgaattgtgggataaacctgtcagggtccttgcagagttattgagggttttgatctctgtgttaccgattccgtggacccagtgttgggggcagttggtctgtagagagttggctgtggccacagcaggggcttctaggcactcagggcagggggccctctctgcctccagcggcgtctgctggagtcgcactgctacaaccaccaggcctgggcagcgcgtggagcctggcatgacccgtgaccatcgtccaagccacccttgctctccagccctccccttccaccggtgttgccatccctctcccagcccactcctgggccgtgcctccctggagagcgcaggggaaggggcagtcagacagcggatgtctctcctgtctcacccatgcctccaccagctgcaggctgtcatttccatccgtttctgatgtaggggtcagctccacagcacgcacacagccgggaagctgcccacacgcctgtgcacacacacgttcctcctgggatgcggcctctacagtgagagccccacggcttctccaggcctcgggctctggcttaagccctgtgacctaactgcggagtgtttcttgtcataaccaagttctcttctttttaattccagttatgcaaagggtgacctggacatatcttacatcacatccagaattgcaggtatgcgtgccacatgaggctgtgggacgcgccccggcccttccctgtgtgcccagtgagtccctgttgtgtgtcagggcacaggtgcctctgctccagccttctctgtggccacagactcacaggggtgacctggggccccttggcaggcaggcggcctgtgctcagcacctccaggcgcagcagtggacagggtcagcgccagcctggcctcccatggctccctgaggtcatgccaggaacaacacaaggccgtgtccgtggaaaaccagggcctctgtgcaccaggcatcccagtcactcatcccgacacctggagacagggcaggtgtcagaaagctgtctcaggaagtcccagccaccggctgatgggcgtgtggctgggtccatgctcctaggtccacccaggctgggagtccacggagggtgagggggccggctgtgtgggcagtggctggtggagctgccggaggctgcgcttgcccgggggcgtcaggagcagcgaggccgcagcagcagcctggccacgaggtgcgcatctcccaggtgctgacgcaggtctgcttgtttcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtgtgtggccacaggctttgtcttggtgccactctggagcttccttccgctccagtgcaggggcatagctgagggctttggccagggtggggctgtgatgggggcggccggaggtctcctgaggggctgcagagcgtgggacaggagggggcgaggtggggtctctgttgctctgaggatgccgcttgccgggaactctggaggccccagctcctcactgcttcccaccagccagagggtgctcgaggccgaggcattccttccagacacgacacttgtcagtatgcaaagggacccaaagcccaggaacagctgactgagctctgtctgcaaggccagtggcagccctggtgctcaggtctcgcgcaggtggacgcctgttcatgacaccagctggcggaggcccccgcactgcaggcaggctgtccctcctagctgaccaaggctggggcggggctcctctgccgtccgtgccaccgtgccctgtccccacaggtctccgagtgtggctgggcagcacggcgggccccacacctgcacaccctgtacaacatctgcaggaacatgcacgcctggctgcggcaggaccacaagaacgtctgcgtcgtgcactgcatggtgagctcgagggccgtgggctggcgccgtcttctgtcaaagttcattatttcatgcatagttcaacaggatctgagcgccagtcatgagctggggcctgttcttcaccctgggacacggaagaaagtccctgtgcttggtgtctttgggtctggaggggacagatgacagatggccccgcccttccctccccatgtggcccttcctggccttgacctgcatgcccgtgtggaggccactccgctgtgtggggagcccacctcccctcctgctcggtggccacctaagagtcacttccagtttcccgatctgcagctcgaggcttagtggtgcttgagcctcccagggtgtggcagctgccactgtgggtgatggagttgaggtttccatgaggggtcttttgcggggtacggggcaccagcagagcctgttggagtggccctagccctgttcttcgttagggaaccttcagtctctgttgggctccattcttgcctcggcaggcacgttatgtagctccctaaacatatcccagcttcagagaggaacagccctgcgtccctgcagccacagggtgggtaggatgcccgaggaccccgcgagcccttgtcctgcatgagtgcgaggcgcacgcgagacgtgtctgtctgtcctaggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtactgcgtggccctccggggacaggggacagctctgtgggcccgtgtggcactgccgcccccgctgtggtgtctcctggagggccagtcggtgccgctgcaggcgctggtgggaaaggcaggcccggcctcgcggagccatggctgagccctgggcttacggccgcagagcccggggaggatgggccctcagccgcggtagtcctgactgctgtggggcagcacctgcccagcttgtgcatggatcctaggttctctgacaaatgccatgtatgtggtgggctctggtggataatgcacgtgaaaatgccgtgtggagcacctgacacaggtgccgtgtggagcacctgacgctgctcagacatgagtacagtcacagcgtgtttagggccctgccaaatacaggcttctgtgccgctccacctcagcgcgcagcaggctctccctggccgtgtggaggaggctgtttctcaaacgggagtgtggtcacagcgtgtttagggctctccctgtttctcggggctgcaggtgtccacgcccgaggagtccaccccagcagaaagcctcccctggccttggtctccatgaggacctggtgaggctggagcagcctcctagcctctgaaagagcaggtcttgacctggaccacagaggccccaagggttagggcccaggagcaaaggccggccccgtggccccaccgtggcgggagggaagaggagggacccaagcgtcaggggactccccattctttatcccctctggatggggcgcacagcctgtggacggggcgagggtcaggaggccattcctgctgctgtggatccccagggagggccccacctcgtttgctcacagccttggggggaggagatcattgccgccccatccagctttgtcttctgtgtgacccccggcaagaggagtgcaaagttgggagcccctccacacattgagctgaaagccattggcacccccaggccaggtgcggtggggcctgttcagcagggggcgtctgagaaccagggagtctctttccctgtggcatgtggctgggcttccatgacccccaaatcccacagctccttccttggaggagcagagagatgtgcagagtgctgctcccaccgggcagctagctggaccagcttcaagttcatggccttttcacatcactggcccagaatctaaggagagtcaggtgcctgtgggaggaggtgtgtgtgtgctgtctggggtggacgtaactggaccccagaagagaaggaggccagaaagagtccaaccggtggaggccaggtgtctcagtgggcgagtgaagccttcagggttgcaggactggaagggtccttgccctctggaaggcacagtctctgtgggcacccacaggacagatgggagagtgagggccgggcaagggggcgcagctactataagggaggcccagacctggccgagaccctttcttctgcctccagatggaggagacgagagaaagagctgcactctgtgactctgggggaaactgaagtaactaattgatgtgctgaggacgctcatgcagagtgcacggtccagtggggcattcgtcagagccgtggaaagaggaccctcatgcagggtgcgtggtccagtgatccacatgtcagagctgtggagagaggaccctcatgcagggtgcacggtccagtggggcgttcgtcagagctgtggagagaggaccctcatgcagggtgcatggtccagtggtccacatgtcagagccatggaaagaggaccctcatgcagggtgcgtggtccagtggtccacatgtcagagctgtggaaagaggaccctcatgcagggtgcatggtccagtggggcattcgtcagagctgtggaaagaggaccctcaggcaggtgcgcggtccagtgggccactcttcagagccgtggaaatgccaggaaataagcaaatggaaatccccgaaatgagaacgccttcgacatcgctgaggctgagtcagtggcctttggagccaggtcgagagatactgaaactgaatcacagagagaaagcgtggggtagaacaagcacccaagagctgcctccacctcaggcaggggcacacacacgtggagcccagaaagggaagagggaagcgggagcagtgaagaaatcatggctgagaatttcccagaatgagtaacagataccagtccacaggttcaagaagctcagaggtcaccaagcaggatgaaagcaagatgaacacatgaaaacccactcgggtgcataccggtcagaactcctgcaaaccgagcacagaggaagtgttggaggtggccagaagaagatgcatcaggtacaaaaagaaagatgtcagccgcaaggttctcgtcagaaagcctagaacaaacagtaagggtttttcttcggtgctgtaattaagaagtcaacaggaagtaaaaggaaaacataaaccttgtcaagagaaggcgaaaagaagaaaaaagaaaccaagaacagatcaaacaagtaggaaacagccagcaagatggtagattttaatccagccacatcagtgttcaggctgaacatgagtggttttgtttaaaagacaggcattgccatatgggacagaaacgcacagctcggccatacactgcaggaagtcctctttcagcacggaggcagaggtgggttcagaacaggatggtgggggaagagcgtactagtcattgctacatgacccgacacaacacactcgggcttagaaccacacacatccattctctcgtggtctccctggaccttgaggcttagctgggccctctcctccgttcaaggtgttggccgcactgactctgagaaagccgatttctctttcatttctgaatctgcttccttggccactcgggctgttggcaggatttatttgttgtggctgaaggaccggctgtcctggctccctgctgactgagctgggccacagtgtcctgtggctgggaagatggggtctgcaccgtcaccatagaagtggtgtcacctgcctggcccgcacaagctccgggagagggcctcctgcagggcatgggtgccacgaggtgggaggcagactctggggggtttatgctccacagaggcaccacgggaacgccagccacgggaaagccagagctgtgctaccaaggtcagagaaaacagattccattccacatccatcaggcaaaaactgatcaaattgaaaggagaaccagacaactcatttgtagggtagacctcaatattttcgtctcagtaatccgtagaacaagtagacagaccaccagcagggatatagaagaaccgaatgtgccaacccatgaaggctgacacagctgtagagcgttctaggacgttccacccaacaatagaaaaacacacatttatttctttcaaatgcacatggaatatgcaaggagaaagatcagatttggggctataaacacacctcaatacatttttaaaatttgaaatcagacaaactatgctgtcaggccacagtggaataaaaattgaaatcaataccagaagaatatctggaaaactctctaaatctccacctcccaggtttaagcagttctcctgccttagccctcccgagtagctgggattacaggtgcacaccaccaagtccggctgatttttgcatttttagtagagagagggtttcaccgtgttgcccaggctggtctcaaactcctgaccttgtgatccacctgccttggcctcccaaagtgctaggattacaggcgtgagccaccgcgcctggcctcaaaattaagcaacttctaaataacccatgagtaaaagtgggagtatcacgagaaatttaaaaatatcttcaactagggcgtatttttaagactctgtcttaaaaatacatatatgtatacacacacacatatatatataactaaatgaaaattataacatcagatttgttaggagcaactaaaacattgctacaagggaaatttctagcatgaaaaacttctattcgaaagacaaaatcagctgtgtggtcccctctcagggcacgtcacgtggtgacgcggcacgtctgcccccaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcggtgagtgcagctgcagccccacgctgtgctccctcctcctcacccctccggaaaaccgttaaagaggaaccctggccttgccggggacaggcgcttgctgaggcggacgtgtttggaactgtggcgtctgtggcaggtcacttgggatcctggtcagcagcaggaggtcacagggatccgagtgtccaggagacttgagaatgggatcctggtcagcagcaggaggtcacagggatccgagtgcccaggagactttagaattcttgtgaggctcttcatgggggttattctttattggttattacacattttagctaagtggacaatttctcattctgttttttgttgtttttgtttggttggttttgggggtttttaaaatttttctcttgtcattctgtccttagggactttaagattgaagatggcaaagcggtgattcccctgggcgtcacggtgcaaggagacgtgctcatcgtcatctatcacgcccggtccactctgggcggccggctgcaggccaaggtgagagagcctgtggcttgcccggtgctccccactcacgcctaggctcatggggggctgggggccacagtgcgctcacttctcaccgagggtccagggtgctcgctgtttggtgagtgccgtgggctctcatgtggcgactgccccacagcgccccctgcttgccccgtgcacttgacgcggcaggatctcaacctgaaaagcctggcgtttccatcgagactgagtttgagggtccacttggggcagcccccacggcagtcccgtgaagcagcttgtgggcccatgcgttctcctcagggttacctgccacacacagaccctctcccgcttcccccacaacatgtggcacgggggcgccgtccatgcctccagcaccatgagccgctctcagatctcgcccattgggaaaaattggcctgtggccccaggatctggattcaccctccacgtggggtgtcgtgtttgctctctttgcagatggcatccatgaagatgttccagattcagttccacacggggtttgtgcctcggaacgccaccactgtgaaatttgccaagtacgttggtaccgcttgtgctcggtggggagggacaggtgccctgtgccgcagcacctgcatgtgggccggtcgtgggagccccagggggagtggcgggctgtgtgactgctgcttggtggctctgggcctgttcctgggccatcctggagctgcgcgtgtgtaggctgctggggtggacccggtggctgctgctctgcccccccgttggtgtgtgtgtctgttagaatttagccctcacacccgggcgtggcgtaagcaggtgagcgggtggcggctgcatcttagcaaacgttcctgagcctgctgtgtgcagagtgccctgccaggcggaggctggagatgatgcggggcagtcctgtctggaagctcacactctgttgttagctccctctgtaaacaagcgcagccacgggatggcccccacccctgccatgcccagcacctgttagctctctgtcctcttgacgttggtgcccaacagcgcataccctgccctctgcaggctcaggtgcagatgcggtgagcagcagagcaggctctcacacccgggcgtcctgattctaactggaggtctgtctttttttttgagacagagtctcgctctaacgcccaggccggagtgcaatggcgcaatctcggctcactgcaactccacccaccaggctcaagcgattctctcgcctcagcctcctgagtagctgggattacagatctgcaccaccacgcatggctaagttttgtatttttagtagagatgggtttcactatgttggccaggctggtcttgaattcctgacctcaagtgatccacctgcctcggcctcccatttaactggagatctttctactcaatcacaggcaggcttatctgccaagacacagtggaacaaacattgttccaggagtcagagggggcacccacgggggctcccaagacagaggctgtggctgcagggcctgctgtgttccaggctctgtgctcttggttcctacccagtaaacaaagggaagccttgggccagccccacggggatgctggcggactctgcaccttgggaggggtgctggcctggcctgggtgagctcaggaagagctggcgcctgctgctgtcagggacggcctgcaccgggagaccggggtgtcttcttgtgtttttctgtctctgtgattctttttttacatctcttgtctttgttgtgtcttacgcttttctttttttaactcacatattcgcaactttaataattttgtttcttttttcctcctttggaggaagaaaaacacccagtgctcttagagttttcagccacggtggaggcggtgcttaaaatagtgttttaaagaccaaggtactgatgatgaagaggaaaatgtcggtgaaggacctgtcggggacttaaatgctggaggcaggaggcagggactttggtaactgattgattattcaagaaagtcgggggaatgatgggaatttcaccagagatctggaacataaaaaggagacagatgtgaattctagaactgaaaaatattacagccgaaatgaaggcttcagtacatgattaacagtggaataggcacagcagaacagactctgaattggtagaaaagatcttctgacagcagcgcagagaagaaaggatggaagaagacacgtacagagagggtcacgagagagactgtggcactgcaggggcctggcatgcttttacttgaagttctaggagaagagagagagtggaacagaaataatacttgaaaaatcattggccaaaaattttcctaaactgatggaggacgtcagaaccacgaaatcaagctctgcagacgccaaagaggatactttttttttttttaacaaaaagaagaaaagaggttcagtacctcagagcatcctggttgaattgctggaacccgaagagaacaatctccagcccgaggacaggacggggtgggaatgcatgacctgcagagtgacacccgaaggcagctgaggcgcgccgtctctaaagtgctgagagaaaaatacgggaattctatatccagtgaaattatccttgaaatatgaaagccagttaaggatgtcttcagccaagcaaaggatgagagagttgattgttggcagaactgctccatttcagcaagtatccaaggcaagcctgcaaagcctgcagcctagggaaggaagggcagggaggctggaatgcatgactctgtggtgaaatgacaccagcaccagctgcttaaaacaccaatactaacgtcctgtgggttttaaaacctgtttggtagtaacatatctgacagcaggagcaccagcgcgtgcgcacacacagacagcaggagcaccaacacacgtgtgcatgtacacacacacaagcaccagcgcgcacacacacacacagccgaggaggggattaaccgagtgaatgtgtttcaggagctccatcaccaggaagcagagaatgtaccaatccctagggcagattaaagatgcaatcaagaagaaaaatggaacaaaaaatatgtgatgaattcgccagaacaacgtagagataaacaaacaaacccaggtgggatatagatagaaaacagccagctggtagaccgacgccctgctgtgcctgtcagtcatcccattgaaggtggatagaagacacactccagttaatcgggctggattaaaaaccaagctcacacaaaactcaagtctatactgcttacaggagccatacttcaaaacccttgcacacgaagacctagcaaggctgaagtggaataattggaaattgcttaccatgcagaccataacaggaagaaggctggtgtcactgtccatatcaggtgggatagaccaaggcaggaggtgacgggtgacgttgcaggggcgagggcagtgacatggcttcagtacaggcagcacaaagggcagaaggaggggtgaagttgacaggcccacgctgatggccgcctctctccccaggcagtggaacaggtagacaagaacaggatatagtttttttttttttacaaggtttaaccaacttgacctgagttttgcaaacttcagcgaatacttggagaaatggcatctgttcaagtgggcgtttattaaagtggactccacgttgggtcatacagcaagtctcaaggcatctcaacagtggattaaagtgggaatcagtgacaggaaaacacccagagaccgtatgctcgttaagtgacctgtgtgccaaaaaggaaatcactgttgaaatgagaaaatattttaaacacattgataatcaaaataccacttaccagatgtgtggggtgcatctgaagcagggtttagaggaaatgtgtaacttcaaatgcatacattaaaaggaagaaaggttggttgcgcacagtggcttacagctgtaattccaacactttgggaggcaggaggattgcttgaacctgcgagatcaaggctgcgctgtgggcgagaggcgtgttccctgcgtggtgagcctgcgccgtgcctgggcgagaggcgtgttccctgcgtggtgagcctgcgccgtgcctgggcgagaggcgtgttccctgcgtggtgagcctgcgccgtgcctgggcgagaggagcacagggttgcagccatggcacagatgtaacagctgagcctgtcaggagtccgctctgccctgttggagctagtctggcaggagcctgcgggcagtgtcctctgcagtccagggctctcgggagtggccagccctgctcacagacctcattgtgccctcagcgccaggctgggtgagccgagcctgcaggcccagtgcccagggccatctcaaggggcagctgggggagggaggctgggcatgagcggcactccctctggggctgcccaagttcggtctgtcccaggacccaagcccgtctggccgacctggctccctgcacactccctccctccgtgcccctcccactgtgcctctccgccctcggtcgtggccggtctgagcctccgctgcggtggccgtcggattctctgctggtgcctgcaggctcctctgcagacgttgcctcctccacatctccacgccagctgtgccaccgctgtgcagtccctgccacccctgacgacagacagcggcacgcaaagaggctcgggcgcagggggaagctcgtgttggccccggctggagtgcacatcagtcccggcttcggccgtggccacctccgcccagagccttgagtgggcattgagggggcgctgctctgcgtgaggttggccacccctcagggcgggcacagggtgctctcccctcgtgcagggagaggatgttttagagggtgagcaggaaggggtgaactagaggcctttcacacatcacaggcatgtgtggagctcagagaagtgacagttaaaaccagccgtggctctgacccacacaggccgccgggcccgtctccctgccctccctcggcggatcccactctgctctgggtgttcctggccctgcagacactggcagcctgggtttcccaggaactggccgccactcttttgtgtttcttctttattttcttaggtgtataacattcaacatgtagagattttaggtggcgtaaaataagacaggcatggggagcctgctgcccgctggagagcccaggcttatcagtgcagtttatgacagtgggatcagagatgatcataggaaatgtgtgaaatagcctggaattccttagagagctgtggggctgggaaatggtcagtgtcaggtcacacctgcctccccgtgcggccaacaccccaaggcgggccctgctgacccctgcccctgctccccacccacatggccgacaccccaaggtgggccctgctgacccctgccctgctccccacccgcacggccgacaccccaaggcaggccctgctgacctctgccctgctccccacagctcagcctgggctgcctccccagccccacagtgaacacagctttgtttcccccggaatcatgttcccaattccctggcagccggattctagaggtcttggttttatgggcatctgttgacagttgtggatttttgtcagggcggacgtcgtcatttttatggaaaacacatttagtatcccagagtgcgtgctctgagctgccgggtggctgcagtctgtgtgtgctgggtagtgagggccagcgcctgccttggaaccctggggtcccacctcagagctgcctgcctgggtgccggagtctccagctgtgggatgttgtcccgtctgctctgagcacgtggcctcccctggagttgcaggaaacatggcggccccgcccggtgcccctctgccttgaacacagtcgcgggcatccccactgtgacgtccgaggagcgagtgaaatgatgctcttctggggccgtgaccgggggtgctggtgccctgtgggttcctgggacagctgctgggtcagctcacagggctccagcttccgcaggcgggggtggccggctgccctggttgttctcgccccgctgcctgcagctgccacctgtttccatgcacgtttctttagtgaatgtccaaggacttacagactacttgggtggccttcctaagtggtgtctacttgtaaccgcaggtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttggtaagatcccgcaggtgaattaggtgaaccctgttctggtgagtgtctctgtggagagagacacctttggctgagctctggcagggctgggccccacgcctgctgctgcacccaggccctgagcagcttgggctgcaggaggttttggaaactccgtcgtggatgttggacaccaccaccagctacaccagagaaggactcgcaggctgcaatttctgaggcccatgggcagggacggaggcagagggaggaaaacccaggctcctggagcgaagcggggttttgtcccaggcgtgtgtctgggtcagatttttgtcatgtgtgctggacacacgtccactctcactgtgagcctcaggcctgctggcagcatgtggaacagaaccctcgctcctgtcgctcttcacttccgagcagtttcgaaacggcagcccaggaagtgctggcaggtgggcccagggccgtccactgctcatgccacgcttgttctcggctcttggtttgcagtgtttgctttttctttctgagcatcttcagcgtccctgaaagaggctgtatgtgtgacctgtgcgtgctgtgtatgtgtccgtgggtggtgtgtgccgtgtgtgtgtgtgcacgagtggtgtgtgcattcatgtgtactgtgtatctgtgtgctgtgtgcattcgtgtgtacagtgcatctgtgtgtgctgtgtgtgcgttcgtgtgtaccatgcatcggtatgtgctgtgtgtgcgttcgtgtgtaccgtccatttgtgtgtgtgcatgcatgtgtactgtgcatccgagtgtgtgcatgtgtgtgtaccgtgcatctgtgtgcgtgcattcatgtgtaccctgcatctatgtgtgctgtgtgcattcatgtgtactgtgcctgtgtgtgtgcatttgtgtgtaccatgcatctctgctgtgtgtgcattcgtgtgtactgtgcatctgtgtgtactgtgtgcattcatgtgtactgtgcatctgtgtgtgctgtgtgtgcattcatgtgtaccctgcatgtgtgtatgtgctgtgtgtgcattcgtgtgtactgtgcatctgtgtgtgtgcattcatgtgtaccctgcatgtgtgtatgtgctgtgtgtgcattcgtgtgtactgtgcatctgtgtgtgtgcattcatgtgtaccctgcatgtgtgtatgtgctgtgtgtgcattcgtgtgtactgtgcatctgtgtgtgtgcattcctgtgtaccatgcatctgtgtgtgctgtgtgtgcattcctgtgtactgtgcatttgtgctgtgtgtgcattcatgtgtaccgtgcatctgtgtgtgctttgcattcgtgtgtaccctgcatgtgtgtatgtgctgtgtgtgcattcgtgtgtactgtgcatctgtgtgctgtgtgtgcattcatgtgtactgtgcatctgtgtgtgtgctgtgtgtgcattcatgtgtaccctgcatctgtgtgtgtgctgtctgtgcatccgtgtgtaccatgcatctgtgtgtgcattcatgtgtactgtgcatctgtgtgtgctgtgtgtattcatgtgtaccctgcatctatgtgtgtgctgtctgtgcattcgtgtatactgtgcatctgtgtgtgctgtgtgtgcattcgtgtgtaccctgcatctgtgtgtgtgcatttgtgtgtactgtgcgcctgtgtgtgtgctctatgcattcgtgtgtaccgtgcagctgtgtgtgtgcattcatgtgtaccctgcatatgtgtggcgtttgatgcctcagtggtgggttccttgtgcgtgttcatgtgtgcgtgtgctgtgcccaagtgtgcacgcatggcccagagtggcatccgagtggatagcaggaatctgttcagagagcccctccccgtcatgtcattggtctgctttaccgatggcctggcctgccacggtgctggcgcccgcctggctgcacttcccagctctggggtcagtgttgccccgaggctgctggccagtgccagtgccctgacgccctccctctcctgcagggaagccggagcttccccggcagcctggctccacggctcagtatgatgctggggcagggtccccggaagccgaacccacagactctgactcaccgccaagcagcagcgcggacgccagtcgcttcctgcacacgctggactggcagggtaggcagcgtccctggacctggccacttgcagagggcaggcccctggtctggaggtgcccctggggcagggcaagcgtcttgggagacgggcctccggcagagctgagttgcacctcagtggggctgtgcacccggcatgtcagcctgttctttaatggctcacgagctaagaatgatttcatatctttttaaaggtgaaaaaaaaagaacatgcccacaaagtctgaaataacaaccctcgctcttcatcccagtctgtgggcctggggaggctggcagcatgggccatgctggcggggcccctgggtacaggggaagggcctgggcggagggacagactgtcaccacctggggatcccacacctctctttgcccacacccccagtgggctcccagcccctctgaggcttttcaggaaaacacctgggcgccatcactggacctcaccccagacacaccccaagggatgcacctgccacttcctgtcccagcacccctggccttcccatcgggctcgtcccttctgccgcctgttcccagagcacccttgattggtgttcctaccccctagtgctgccatgtggcccccacttgactcagcctgaggcaccgcagaggcccaggcggagagagccacaggcagacccttgaggcagaggctggaggtgggtgtgctggagacgcctcaggaacaacaccccaccgcccgcccagaagcttctgcagcactcgccagggccctgggccaaggaggcgctgaggggccgtgccatggggacattggtgctggccatgtgggttcgccaaggccctgggctgaggggacgcgccgtggggaccctggtgttcctgcagcacttgccaaggccctgggccgaggaggtgccgaggggccatgccatggggaccctggtgctggccacgtgtgttcaccaaggccctgggccgaggaggccctgaagggacgcgccgtggggaccctggtgctggccacgtgtgttcaccaaggccctgggccgaggaggccctgaagggacgcgccgtggggaccctggtgctggccgtgtggtctcactagcctgtggttttgtttccttttcgcagaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggtacgtgtttctgttctgaaggcgagtggcttcacagtagatgagtgatgaggctgagtcattctcactgcatgggcgtgtttcgaaggtgcttgcaggaagggaacgtgcccttcccccacctcccccaggagcagcctcggggtcatgtcagggttctgtgctgcccacctgagctcacgggccgggagctactggcttctccatctcagcagtgttgctgtgtccctgggaaagtcatcctgaggcgtggggcacggggagcccctgggctgactgcctcagtgcccctgcgagggcagccgtggggtctgggctgcccagctggagtggcctcttgggcaggcctgactccagagctgggctcctttgtcttcaggcagccgggctgagtcctccccatgcccgcctgtccccacagctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggtaagtgcctctcgcctggcagccagctctccatggccgcctccctcaggaccgcagcctctggtgggaaacagagctgtgggtctcaggcagtggtggggctggactgtgtggcctccgggtgcgctccttgcggcccaagcatcctgcaggacgtcccagaggtcaggacagactgctccctgctctgtctccccaaaccatccccaaacctggaacaggttgtggggccctgcagtgcctcagtcgtctgtgactggcaacaggtgtttctccaggcctcctcaggcccaggccttgcagctgttagcagagaaggccacctgcacccagagcttgtgtagggaccagaggtcagagggaggcagctgggggacccagggtccgggaagctgacctggtctgggtgtagcaggggccgtggggcaccgtatccatggggaggaggtcaggcgccggggcacagcatggcttgtttagacagacgccggtggggccaggccctgggagagggctgcgcgcccctccagtgtggtcctaggggaaggagcctgggttctctctcctgaggaggcagcagcgtggtccacggcgtactctggggtgatgatggtgaccattgcaggatggcttgtgggcgggtgtgtggagtgcagccttgcagcgttggggcgggtgccgccagaggtgtgctgcgtggccagagccagggcagacaggacctgctgggccctctgtctgccgaaggcagctcagccaggtggagccacctcgggctctggtgggttttaggagaggcgggaacgcaggctgtggggatggcggcagaaagtggggtcctgacaaacccttttggatgggaatgcgcagatgcttgttctcagcctggcctgcgagctgctccgcctgctggtgcccctacgtccactcgctcagttctgtgtgatgggatgcatcctcaggacccttcaggaagagagaggccgtcagcccagcctcagctcagcctgggtgcaagaggtgtccgctcctagggccctgagcacagcctggcgccccgccacatttgcctgctgctgagacaccaaactgtgctctcttctggttccttcttcccaggggatctgccaggagagcccagcaagatgacagcctcgtccagcaacccagacctgctgggaggatgggctgcctggaccgagactgcagcatcggcagtggcccccacgccagccacagaaggtatggccaccacccaccaaggacagggctcccagacgtgcagctgctgtggcccgtctctatttcacacgtacctgtaacagggccctctctgcgcagagaaggaaggaagggctggggcgtgcttggtggtgcgggctccgcacacaaggctgtggtatgactgcagcggcctcactcacccggtgtgcctggggtacgtggggacacagacttggtgtcccagagctgcagtggctcctgagcatcagcagcacccccgaagggtcctcctcccacccggcagggcgtctgcgtctgtgatgcgatttcatgccccacactctgtggaccacgtgctggctctgcctgtagcaccccgtggctcttccctcctgaaggggtttgtgactgaggccgaccccatgggtcttgtctcggtgttgcggccgatgccccatgccctgtcaggaagggggtcatgtacagcagtcgtgtttgcgacgccccgtgccctgtcaggaagggggtcacgtacagcagtcgtgtctgtgagcgtctgtccttcccgtcaccctggagccggccctcccgcggcgtctggtagcgcggatgcgtatgctgcagctgcgtcttgggccggcctcagcgatgtcgcgggtttgcttccagaccacagtcaaagcgaacacccctagaaagccagtcagattttgttttcccagtaagcataagagttaagggggttttttgtgtggggttttgtttttgtttttgtttttgagacagggtcttgctctgtcacccaggctggagcatagtggcgcaatctctactcacttcagcattgacctcctgggctcaagcgatcctcccaccccagcctcctgagtaactgggactacaggcatgtgccaccatgcccagctaagttttaaaatttttttgtggagacaaagttttgccatgttgctcaggctggtctagaactcccgggcttaggcgatgcatgcacctcagcctctcagggtgctgggattacaggcgtgagccactgcacccagctaaaagttatatttacattatactgtagtctggttttttgtttgtttctttgggagatggagtcttgttctgttgcacaggctgtggagcgcagtggtgcaatctcggctcactgcatcctccacgtcctgggttcaagtgattctcctgcctcagcctcctgagtagctgggattacaggtgcctgccaccacgcccaactaatttttgtatttttagtagagatgaggtttcactatgttggtcgggctggtctcgaactcctgaccttgtgatccacccgcctcggcctcccaaagtgctgggattacaggcgtgagccaccacggcctggccatagtctgttaagcgtgcaatagcattatgtctaaaaaataaatatagttaccttgatttagaaatacttcattgctaaaaaatgctaacgatcctgatcttgctggtgggggtcttgcctcaatgtggatggctgctgactgatcagggtgctgattcctgaaggctggggtggctgtggccatttctgaaaataagacgatgaagtttgccacgtgattgtctctccctttcacaaaaggttccctatggcacgcagtgctcttggatagcgtttacccacatggagcttcttccgtcctcccaaacctgccactgctgtgtcaactaagtttaaggaatattctaaacccttggcctcatttcagtgttcacagcatcttcaccaggactcgattccatctcagtaaactactttctttgctcatccgtaagaagcaactcctcatccattcaggtttcatcctgagattgcagtaattcggtcccatctgcaggctccacttctaattcgagttctcttgctgtttccaccacatctgcagagacttcctgcactgaagtcttcaactcctcaaagtcatccttgagggttgagatcagcttctcccaaactcttgttcatgttgctgttttaacctcttcctgtgaatcgtgaatgttcttaatggcatctagaatggtgaatcctttccagaaggttgtcagtgaactttacccagatccatcagaggaatctggccgctatagccttagaaatgtgtttcttaaatagggagacttggaagtcgacacgactccttgatccaagggctgcagaacagatgttgtgttagcaggcatgaaagcagcgtgactgtctgcgtacgtctctgtcagagcttttgggtgaccagctgcattgtccgtattgtcagcgaacagtcatattttgaaaggaatcttttttctgagctgtagatctcaacagtggacttaaaatattccataaaccatgctgtacacagatggctgccatccaggctttgctgtgccatttctatggcacaagccgagtcaatttagaatccttttttttttttttgagacagagtctctctttgtcgcccaggctggagtgcagtggtgtgatcttggctcactgcaagctccgcctcccgggttgacaccattctcctgcctcagcctcccaagtagctgggactacaggcgcctgccaccacgcccggctaattttttgaaacccctagagacggggtttcactgtgttagccaggatggtctcgatctcctgacctcgtgatccgcccgcctcagcctcccaaagtgctgggattacaggcgtgagatcatcagtgatctcagccggatcttagcagatgacttaggccgtcttatatctgcatggagagtctggcgggtgcagccgcttcatcagtggtctcagccggatcttagcggatgacttaggccgtcttatatctgcatggagagtctggcgggtgcagccccttcatcagtgatctcagccggatcttagcggatgacttaggccgtctcatatctgcatggagagtctggcgggtgcagccccttcgtcagtggtctcagctggatcttagcggatgacttaggccgtctcgtctgcatggagagtctggcgggtgcagcctcttcatcagtggtctcagctgcatcttagcagatgacttactgcagcttccccgtcagcgcttgctgcttcaccttgcacttgtacgttgcagagacggcatctttccttcagcctcagcccctgctggcttcacttttcttctgcagcgtcttcacctctttccaccttcatagaattgaaagagttgagaccttgctatggattaggctttggcttaggaggatgttgtggctagtttgaccttctctccagatcacccgaacttcctctgtatgggcagtggggctggtccgaccttctctccagatcacccgaacttcctctgtatcagcaatagggctggtttgtgttcgtatcattcgtgtgttcactggagtggcattctcatttccttcaggaacttttcctttgcattcacaatttggcttgctggtgcaagaggcctagcttgtagcttatctcagctttcttttttttagagacagggtcttgctcttgttgtggctggagtgcagtggcacgatcatggctcactgcagcctcaacctcctgagctcaagggatcctcccacctcagcctcctgggtagctgggactacaggcactcatcaccatgcccatctaattttttaaatttattttttgtagagatggggtccgtgttgtccaggccgaccttgaactcctgggctcaagcaccctccttcctcagctgcccactgtgctgggaacacaggcatgagctgctgcacccggccttcctctgcttttgacgtgccttgctcactaagctcagttgttcctagcttttgatttcaagtgagacacttgcaactcttgtgttcacctgaacgcttataggccgttgtaggttctgaattggactgatttcagtaaagttgtgtctcggggaatagggaggcttgagaaggagcgagacggggagtggctggtctgtggagcagccacagcgtgttgtcagttaagctcgccgtcttctatgggcacagtccatggcaccccaaaacaattagagcagcagcatcaactcatgggacacacatcaccaaagcagatgcaatcatgaagaagtttgaaatatcattacagttcccaaaatggggcacagggacacagagtgcacatggcgtgcggaaaatggtgccggacagagttgacacagccctcagcaggtggaacacacactgtctgcagagctccgggaggcacagtgcacgatgtgccagggcctgggtgcccgtcccctcgagtgcacagtgcgaggtgcgccagggcctgggtgcccgtcccctcgagtgcacagtgcgaggtgcgccagggcctgggtgcccttctccccgtgtgcacagtgcgaggtgcgccagggcctgggtgcccgtcccctcaagtgcgcttcaggacgtctttgcccaggggcaactgccatctccggtttgtctcctggttggatgatcactgtgaaggtgtctcgccagtttgatttctttcttatgaatgaggttgactcttagtttgagtggttttggttacgtgtatttcttttgagaatcatttcatgttctttgcttattttttggcctcaggaattcatctttttcctcaaatagatccacgagggctctttatacatgaagagcctggttttaatgactgcatggcactctatcaagtagctctaccacggttttttttttttttgagacagagtgtcattctgtcactggggctgagtgcagtggcatcattttggctcactgcagccgtcaacccctgggctggagcgatcctcccaccgcagcccccctgggtagctggggccgtcaacccctgggctggagcgatcctcccaccgcagcccccctgggtagctgggaccacatgcatgaaccaccgtgcctggatgatttttttattttttgtagagacagggtatttctatgttgcccagcctgtattttatgattttatacttaggatattctcaaatttatgctattataaagagtatcctgaagagcattcacattttagatagattccagaaagtggtactgcagaatcataatcataatgatatgagcatggtttggttctgggtgtgagctgtgaagctgttttccctgaggagcagcatggggcatggaggcagcgtccgccacacacacctctgtcctggctggtctcgtgcacgcaagccatgcaggtgccagctctcaggcaggagtgaggctgtcatgtcgtaaggaggcgccatcggaggtcccaggaggatgtgtttcgcttcagatggtgcttgttctaatgccctgtgccccttctccaggccccctcttctctcctggaggtcagccggccccttgtggctctcaggccagctggaccaagtctcagaacccggacccatttgctgaccttggcgacctcagctccggcctccaaggtaacgtggagggcactttgggggtgtggaagctgtttccttgtaggaggtttattctcgtctatctgactctgagctgcccaaagtgaagtctttgcctctgttcactaagacccccaagcccagagcacagtgagcccaaggggacagcgtgtctgcacctgttccaggcgactgccaactggcaagctaaaaccgggagttgctgacactggcactgctgccagcccccaccggcattgtggtgcgtgatccatcctgtcctcagggccatgggggccatcggggaggcggggtctctgcatggaagtggggtgtagctgggctctgctcagtccccgaggctgtgctcggagcgtgctagctgtcggccacaagaaccgagcccaccctctccagtcctgcgtctgcctcaggcccggcccgggcgctgtggtctgagtctccggtcccacgtctgcctcaggcccggccccgggcgctgtggcttcaagtctccttgggctgacctgatgcccctgggtctctgggttcactcccaagatgcatccccctggggtccctgtggcttctcagaagaagcgtcggcggcggggggatgatcatctgaaggggcctcccttgcacttgcctggccgtcgggtggaatgctgggtgggaagtggctccaccttgggatgcttgttggtgccggtgacccccggacgctccagcatgcagccccaggctatggcatctgctcctgctcagctccgggagcatttcccgtctcctcatcgtttctcctgtccttccctgagtgcctcaaattcctgtgagcaggtgtcggcgttggatctctagggctggcttcgagtcctcactctctcccgggctggctttgagtcctcactctgctcttgcgagctcacatctgaagtgccttctgttctgtcatgaagtcccaagagttttttcgtctttgaatgttctttttatgtttcaggtggttttggggatttactatgtcttgaggacatccatgagcgtttctgtcggtgtggttttgtattttatttccctttgtggcctctgtcttgtgttgtctgagagcacggtggggttgcgagggccgtgccctcgggaggagacctgcgtgtgccttgactgccctgggcagccggcactggggcagaaggagtggactcccagggatccccgccgtttgtgtcccagacacagccccagccctccgcctgctggctcggtgggcggcctgaaaccatcctgccttctaggaagacagcaattctggaagagcaaagccgatacaactgaaggaaaaaatagacaaacccaaatcatagctggcgacgtcagcactgctgtcccgacacatgacggagcagctgtactgaaggctgcaaggatgtagaagggcagaggcgccagccagcagggcccaccagctgcaggcacggacctttccatgcaccgtgggagcctcctccacacaggccctgtcctcagagaactaggattctgcagcatgccgtctgaccacaatgaaatagaacggaagaatcttcacacttgggaacaaaacagcacactttcaaacgacacctgggccagagaggaggtctcaagggagacgatgcgtggagctgagtgaagatgcaagtgcagcctaggaaagcccagggccccatcaggcagtgtggagacacccgcagccgtgggggcttgctgtggaaaagctggaatgccccagcagtaacctgagctctctgcacaagacatttggggggaaaaaaagggagcgaaataagcctacagcaagcggaaggaaagaaagaatgaggagccacgggcagtgcagtggaacacagggacagaggccagttctgaagcccacagacctctcccggggctgctgggaagagtgacccaggtcatcgatatgggggatggtgcaggaggcaccactgcagaccccgcaggctctacgagggtcacgggtgcaggcgcctctgtgcagtatgcttgacgacttacgtgaaattgataaattcctcaaaaccagttcctgccacaacttacccaatatcaagtagatcctttgaaaaattctataaatacaaagaaaataaattcataattaaaaacttcccaaaaaggaaacctgcggacccacctgggccactggagaatttcaccgaatgttgaaagagaatgccaattccaccctctcacaggaagcaggagagacggagcactttctaattgattttacgaagctcatactatcaccctgataccaaaatcagacagaaacagcaccggaaagggaaactgggactatattccccatgaatatacacacagatcctcaaccaaacttcagcaaataggatttatcggtatataaagagaattctacaccaagatcaagtaagatttattccaggaatccaaggctgacatttcagaattgttaacaaaatctatttaggttgctgcgaaagtaattgtggttttgccattgaaagtaatcacaaaaaccgtaattacttttgcactaatctgatatcatattaactggctgaagagtcatgtggtcacatcaacaaggcagaaaaggcatttaacaaaattcagaaagtcagcaccttttatggcagcactgtcagccagtcatgagcagaacgtcgtcagcttggtaacaagcatgtctagagacccacagccaggccaggcggagtggctcacaccgtaaccccagtgctctgggaggccaacgtgggaggatttcctgaacccaggagtttgaaaccagcttgagcaatatagtgagacccctgtaagaattagccagctgtggtggtgagcagctgtggtgagcagctgtggtggtgagcaaatgtgggcagctgtggtgagcaggtgtgagcagctgtggtgagctatggtgagcaggtgtgagcagctgtggtgagcaggtgtgagcacctgtggtgagcagctgtgagcacctgtggtggtgagcagctgtggtgagcagctgtggtggtgagcaggtgtgagcagctgtggtggtgagcaggtgtgagcagctgtggtggtgagtaggtgtgagcagctgtggtggtgagcagctgtggtgagcagctgtagtgagcagctgtggtgagcaggtgtgagcagctgtggtgagcagctgtggtggtgagcaggtgtgagcagctgtggtgagcagctgtggtgagcaggtgtgagcaggtgtgagcagctgtggtgagcaggtgtgagcagctgtggtgagcaggggtgagcagctgtggtgaggtgtgagcagttgtgagcagctgtggtgagcaggtgtgagcagctgtggtggtgagcagctgtggtgagcaggtgtgagcagctgtggtgagcaggtgtgagcagctgtggtggtgagcaggtgtggtgagcagctgtggtgagcaggtgtggtcccagctactcagcaagctgaggtgggaagatcacttggatcgcttgagcccaggaggtcaaggctggcctgagctattattgcatcactgcactccagtctgggcagcagagcaagaccctgtctccagaaacctgcagccaacatcttttttttgtttgtttgttttgagacaagagtcttgctctgttgccctggctggagtgcagtggcataatcttggctcactgcaacctccacctcccagtttcaagcaattctcccgcctcagcctcctgagtagctgggattacaggcatgcaccaccatgcccagctaatttttgtatttttagtagagacatggtttcaccatgttggccaggctggtctcaaactcctgatctcaagtgacctcccaaagtgctgggattacaggtatgagccaccctgcctggccaagccaatatcatttttaaccatcctcctaaaatcaggaacagggcaggagtgtcttttctccacttgtacttgtcggaagtcccagctgctgccatttggcaagaaaaggagatcaaagttacacgcactacaaagggagaaataaaattactcctgtctgcagatgacacgattgtctgcgcagggactctgaagcaatctacaaagatcttttagaactatgagttcagtaaggtcgcaggataccaggtcaacacacaaaaatctgtcctatttctgtttacttgcaattatataaggaagccaacatttaaaacagtaccatttacaatcaccttttttttttttagaaaaaataaacatttaggtataaatctgaccagacatgtctagggcttgtgtggtgggactacaaaaccaaccgtggcgaaagagaccagaggagatgcgagtgaagggacggacgctgcactcacggcctggaggctcccgagtaaggtggccgttctcctgtgtgcatctgtagcctaacgcagttcctaccaacgcctcagcagggattttcctagatacaaatgagcttactgtacagtgtatttgaaagacagatggactagatgcctggaatagtttatttttttgagatggagcctcgctctgtcgcccaggctggagtgcagtggcctgatctcggctcactgcaagttcccttaccgggttcacgccattctcctgcctcagcctcctgagtagctgggactacaggcacccgccaccacgcccagctaattttttgtatttttagtagagatggggtttcaccgtgttagtcaggatggtcttgatctcctgacctcgtgatccgcccgcctcggcctcccaaagtgctgggattacaggcgtgagccaccgcacccagccatgcctggaatatttttgtaatggaaaaatgaaatgggagaagtcactgttcctggctttgaggcttactctgaagccacaaatcaacattgcggcgatggcagacagacgcgtctgtggagagaagagaggactcaggccacacaagagagaccagcggagctttgacagaggcagaaaacccgttcatcagatggtctggagcacctgggcagcggtaggcaaagccctaagccctcgttctacagaacagctcatcagaatgcagggcctttaggtgaaaacctttgtggcctggggctgggcagagttcgtagactcgccacccaaaccacacccataagaggacaggtggacccaacttcagagctctgagcatctgagctgcggactgggagaagatatttccaaaccacctatttgacaaaggactcatctacagaatataaaaatacagtcaaaaacaaactgaaagcaatccagttagaaaatgggcgagagcgcagggtcctctgcctacgaaaaccagagacctttgttcacttgtttatctgctgaccttccctccactattgtcctgtgaccctgccaaatccccctctgcgagaaacacccaagaatgatcaattaaaaaaaaaaaaaaaagaaagaaaatgggcgagagacggccgggcatggtggctcatgcctgtaatcccagcactttgggaggctgaggcaggcggatcacctgaggtcgggagttcgcgaccagcctgaccaacatggagaaaccctgtctctactaaaaatacaaaaattagctggacgtggtggcacaggcctgtaatcccagctactcgggaggttgaggcaggagaatcgctggaacccgggaggcggaggttgcgtcagccgagatcttgccactgcactccagcctgggcgacagagcaagactctgtctcaaaaaaaaaaaaagaaaatgggcaagagacatgaagagacctccagcacattgacatccgatggccaggaagcacaggctgagacacccagcatcaccgaatgctggcgcggaggaggccggagcgcggaggaggcccgaacacggaggaggctggagcgtgtgtctcacgcattgcccggggggcgagccgcgtgcctcatgccttgccggggggacttgccgggggacgagccgcgtgcctcacgccttgccggggggacgagccgcgtgtctcgcgcattgccccgggggcgagctgtgtctcatgcattgccagggttgagccgtgtctctcaggcattcccagggagtgacaagtggcagggccgctctggagaacaggtggtcggtttcctacgaagctaaacacacagctactgagctaccgtgggacatttatcccagagaaacggaaactctcattcacacacaagtccgtaacaggcgttcagagacgtgtctgttgtagccaaacagtggcatcaacccaggtgtcctacaggtgaacggttcaataggtggtctgcacaccacgagatggcccttggcagggagggggagtggcggatgccccgagccctagtgaagagtgccagtccagaggctgcagctgttggtccccttctagaacataactaagatgacagtctgggcatggtggctcacacctaccatcccagccctgtgggaggtgaggccagcgggtctcttaagcctaggagtttgagaccagccatagtgagaccatctccaaaaaaaaaaaaagatgacagaactgtagtgaagcattcaggtcgtgattgctgtggtgctgagaggaatccgtggtgcggtcagtggcgcggccccgcactcacacacacgagtccagctggccacgtctggtgcatctgtaggtggcgcggctgcccgggctcagtgcttctctgaggttatgagagacgccctccctgggggatgctgggcgcaggtgctcagggtatttacagcttcctgctattctgattattccaaaataaaaagttaaaggatcgggccaggcacggtggctcacgcctgtaatcccagcactttgggaggccgaggtgggcagatcacgaggtcaggagatggagaccatcctggctaacatggtgaaatcccacctctactaaaaaatacaaaaaaaattaaccgtgcgtggtggtgggcgcctgtagtcccagctacttgggaggctgaggcaggagaatggtgagaatccgggaggtggagcttgaagtgagctgagatcacaccactgcactccagcctgggtgacagagcgagattccgtctcaaaaaaaaaaagttacgggatcagccctgatttgatgtgctgcgagaggcagtggccacgtgacagatggtggtggccctctaggacgctacagacgtggggacactgccccaacccccgtggacaagccccgggtctgccttggctcctgggggtgacgtggggacactgccccaacccccgtggacaagccctgggtctgccttggctcctgggggtggggtgctgcctccacagctgccctgtcctggtgtctgccctccatccagagtgttcccgtcgccccagcacctggcctgtgctccagcccctggagaccttcacacgtgtgggtggagccggcacctctggacggcctcgagtgatcggtgttctattttgcaagcgcatgttttccaatatacgtggtgctctgcgttatagaaacagtagttgcccctcatggacaaccagatgccgagtttccgatctccatctccacaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttggtgagtcccccactctctgttgctgtggagtttgcagagacctccctgaattggctaaaggtagaacctatgttgttttcttcatctcagagcccagtcctgggacaggcacggccaagccactcagagaacgacgcggtttccgatgtgtgttcactggtctctctctgggtcaggcctctgggtccctcttgttccagtgacaccttcttgacctgtttttaacaaatggcctttgcaaccctgtcttgtcttccctcttctttactctggaggcatcaggatggtagccctgttcccgggggcagcaggtggaattgggcctgtgtgtctctgcagaaagtttctgttcttaactgggctttgtggctcacgcctataatcccagcactttgggaggctgaggcggacagatcgctggagcccaggagttcaagaccagcttgggcaacagtgatacctcctctctacaaaaaatgtaaaaattagccaggcatggtggcgcatgcctgtggtcccagctacttgggaggctgaggcaagaggatcgcttgaggccgggaggcaaaggctgcagagagctgagatcacgccattgcactctggcctgggtgacagagtggagaccctgtctcaaacaaaaaaaagtttctgttcttttctagctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaaggtgggtgggtgggcagctcttcctgggagcccagaggcctcaacccatggcccctggagcatctgctgtgccttatggagccggcgtctccagacagcaacctttcacccctggagcatctgctgtaccacatggagccggcgtctccagacagggacctgtcactgccgatgggcctggcagccctcaaggacagggtggcctgaggccaggggggcagggcagagtcaggccccaggctgtgctgctccccacgtgcccagatggctcagcgctggtgggggtggggtgggcgggcgttacaggagtgagtgccccggggtgtttgcagagactgttgagggcaggcgtctcttgggggctgctctgggtactgagcctcccaacccaggacgctcactggggggtgaggatgcagcggtcaggctgtcactgtgccggccctgagacacgccctgctctgtggcttggccgatgcccagctctgcaggccacatgcgcctgtgaccttggggtcctttcacaggcaccagggaccatccccttctccctcggagtctggggcctgggatgggccaaggggttgcaccaccagaaccagggtttgtgtcctcggtgaacatctggctgagacgagggtccctctggccccaggccctgaaacatgaagaccacctggccctgtgtcgtccggagtgggctctatatagttgagggcagggcgtgcagtgggacagtgtctgtgagccgggctgagcccaccccacgtgaccaggcacttcctcagcgtcgtgcctcagtttccgcggtgcagaggaggagggcaggcaggtgcccagggctcggcaagctccgtgtctcccgcagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggtgagcagagctgccaggcggccgcttgaggccttcaggggcggggcggggggggggtcctgccccgcccgcccccgcatgcttataagaggcgcttacaccgcctgtcacccataggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatg

SEQ ID NO: 38797 - DNA, 2569 bp, Homo sapiens; identical to SEQ ID NO: 36678

SEQ ID NO: 38798 - DNA, 9569 bp, Homo sapiens; identical to SEQ ID NO: 37895

SEQ ID NO: 38799 - DNA, 3571 bp, Homo sapiens; identical to SEQ ID NO: 36615

SEQ ID NO: 38800 - DNA, 7576 bp, Homo sapiens; identical to SEQ ID NO: 38125

SEQ ID NO: 38801 - DNA, 29701 bp, Homo sapiens; identical to SEQ ID NO: 36741

SEQ ID NO: 38802 - DNA, 28875 bp, Homo sapiens
ataactcgttgcgggctccgcgcggtcccacttcccggctcccttcgcctccaggatgcgctgagccctacaacacccccagcggccgccggctcccccacgaggtgaggtggcggggggcggccgccggggctcggacctgcggcggggcgccgagggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccaggggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgtttgccttttaccagggcactgaaggcataaaacccttagttaatgcttaactgagtgaaccatgaaagtcatgtgactccaaaggtcgactctagaaatgcggcagtccatgtagcactgtgatgtagaaattctatgatatatgggtcagtgttcacaggcagggagagggggagtcttcaacatctttgaattaaaaagcatctggggcaaaaacaaataaatacacacatatcagtgaactgctttaagttcagttagagaaggtgagattaaagaccagaagaaactcgagggagactgctgtataagtcccagttatctttccaaacagacaggttcatcacagcagtgaaggctagtcttcatctcccttcttgtgggattttctacattaatgtgcagatctgcccttggagaatggggcgtgcatgattgggctgtggtttgctggagtttcatcttactgaagttgcagacactgtgggtttctgtgacaatggtttacactgaaagtagcaaagtcaaggcatggtctggtatcagcatgccagaataaaacacacagacagctttttaaaaggtctgtgtccgtcctatctttagcctctcctggttgtaacttgaagtgactttgttgccgtgtttgttttgaccaggccgggacagtatggagagtatctttagatgtgacttatctgggttgcttagcaacagcatgcttcagattagaatggaagaaagttcctggatgtgaggagatttgaatgataaaagatacttacacctaaaaggagaccaggagggattgtgccctgttcttgctaactgggtgctcgtaactggagacggggtgtacctgttagcggtggttagacgaggtggatacagaatccagaatggtcacattgcagccatagggaacagatagatgcagagaagaggcttcagccctctgagttagggcagtgcatggccttgctctgctgaaatagcccagaggtcccatttgcttggtgacatctctcacttgaatagaaagctggctgtttatcagacactgttttcttaaatggcagctcctccacatctgcgtcatctccattatctcccctatccatctctttttggaaggaatccacgaagccctcatgactgtttgtttgtttttgtttttttgttgtcgttgttgttttttggagataggttctcactctgtcgcccaggctagaatgcagtggcgtaatctcggctcaccgcaacctccacctcccaaactcaagtgattctcctgcttcagcctcctgagtagctgggattacagtcatgtgccaccatgcctagctaatttttttgtatttttggtggagacggggttttgccatgttggccaggctggtcttgaactcctgacctcaagtgatccgccgcctcagcctcccaaagttctgggattacaggcgtgagccattgcatccagcccgccctcatggcttttacacctcttttcctggtttgcagaaagcaaggctggggtgtggaccctgcatcgaagctggttctgcttatgtccatgtgaagtgctttcaagtaaaatgctgatctgcaaaaagatgctgaaagtcctttgtctctttctggctaagttcaaatgccgaatttgattcagcaaatagttgtgagtgccttgaagtgcaaagaatgatccaggatcaggactccttccctacatatcattattttgatatgtatgtatgtatatatgtttagtgacggagtcttgctgtatcacccgggctggtctcaaattcctggcctcaagccatcctccaacctcagcctcctcagtcgttggggttacaggagtgagtttgccaggctctatatcattctttttagcatgacctctgataggaggctggcaggacagttcaggacttatcagaagcccaaatatcttacactgctgattaaagagagacctgtgtttgaaaaccaaacgggcatataataggattaacattctgctatgaacactaaggcatttgcgtagtgcttgtgggagtgataggaagggggtctgaaccgggggagccagggctttctgcaggaagtggtttggggtccttgtcaacagtgaatgctgcttaatggagccagagtgcccccctgcggaggtgggcagagaggtgccagtcaccccaaggtgccacagctctaagctgagatggtcagatagagggaagcaaacaagggccactccctagtcccaccttgtcagcagctcagacgggattccccatctctatctcagccagggagaagccatcgcgagaactggctatgagtgcgacagcttagagatgttgcaatgtctcttcaagttaggagtgaaattattatccattttgccccaaaatggactcttaaacccccatacacttggaatagcatgtattttgtgctttgaagccagaaataaacattctaaacaaagatttaaagttgcaatgaagaggaggtggttgtggacagacatgcagaacaaatgtttgagaaatgttccctttgcttccacagaaaaacaaaagaaaggcattttctcgtgtttgacaaaccatgttaaaaaaatattcttggccaggcacaggggcccagcactttgggaggccaagtgggcagatcgcttgagctcacaagttcgagagcggcctgggcaacatagcaaaactccatctctaaaaaaatacagaaattagccaggcatggtggtgcgcatctgtcatcccagctacttgggaaactgaggtgggaggatggcttgagcccaggaggtggaggttgcagtaagttgagatggtgccactgcattccagccggagtgatagagccagaccttatatcaaaaaaaaaaaaaaaaaaacctttcagtgctattttttgtggtatagttactgttattaaaaagcaaatggcatttctctttttttgtttactgtattcctgaaatagggtcgatttggccagcaaagtattgacactggggcccatcttgaaaacaactaactattgaagaaaataatttcattttataaaatagtagttgggtaattctcccttaggtaccaaaaagggctcttttctggaaaatgttaatgcaacaatatttccctcattcctttggtgttcatgggtgttctattgaatgctgttccattcttatttctttctagaagatagctcattctgactcctgctgtaaactgttcagagattattctttccagagtctgttacattcagaatgtcttgctagtctgtcacttgctgcccttctctttctacttagtttcagattactttgcatctcctctggcctcccgtttttaaccttttcattgatgtatacacacagaaaagtgcactgcttgatgagttgacatggcatgaacataacctgtacatccccaacgccagaagacccatgggcccccttaccaggcaagccctcttctattaagaaaagcgtttttcttgttgtaagcacaagaaaccactaatagtaattatactagggatggggcgcatacaggattcggaatttttgctttgtgttgcacatgaattcttactttactatgaacatgggttgctttgacaaatttaaaacaaaggcctgaaaggactccccttactcaagaaaaggaaaatgccttttttaaatgtttttttgaaatggttgtcttaaaatttctaaatattttttaaaattagattttatatagccacgcaaattgttctttaatggttatgtaggaatacaggctgcttggcctcccttgtccacagcctcctctttgtttctttgcgactttgactctgtgtttagaacatttatttccgggatgagtgcacaaaacaccatgctactccaaggcacagagtttcagagtcagcgctgagtctattttagagcaaaatgggtaacactactcataatttgaaaacacactattaaatacccaagctgttgctaactaaaagcagcctgtgaggttattttaatataaaaatgcaagctgaggccgggcccggtggctcatgcctataatcctagcactttgggaggccgaggtaggtggatcacttgagctctggagttagagaccagcctggccaacatggtgaaaccccgtctctacaaaaaaaaaacaaaaattacctgagtgtagtaacttaatgtctgtactgtcagctacttgcggaggctgaggcaggaggattacttgagcccaggaggtggaggttgcagtgagccaagatcgtgccactgcactccagcctgagtgacagagtgagaccctgtgttaaaaaaaaaaaaaaaaaaaaaatgcaagctggcgcggatgcagtggctgagacctgtaatcccagctacttgggaggctgaggtatgaggatcctttgagtccaggagttggagaccagcctggacaacatagggagacccagtctctacttaaaaaaaaaaaaaaaattcaacctagacttggtggcttgtgcctgtaatcctagctatttgggaggctgaggttgagggatcccttgaaccctaaagttcgagaccagcttgggcaacatagtgagatcctgtctcttagagaaagaaatctatgtgtgtgttcgtcattttgacatacaacatcttcacttttttctgacaatgaaaacaacccaaggttattgcaaaaaaaagatccagtaatacagaaacaagtgatacagaatggaaccgtctgctgcaattgctggggcagattcaggcagaaatttggattacttttattttattttattttattttattttgagacagagtctcactctgttgcccaggctggagtgtagtgatgaagtctcggctcactgcaccctccgcctcctgggttcaaacgattctcctgcctcagcctcccaagtagctgggattacagccaccatgcctggctaatttttgcatttttagtagagatggggtttccccatgttggaactcctgacctcaagtgatctgcctgcctcggcctcccaaagtgctgggattacaggtgtgagccaccacgcccagctagatttatatttgatagttatttgattccagaggatcttaagtgcaaacccagagaagcagagagtaaaaagcaaaaaggcaacaaaacccagcagatggtgagggaaagggaagaagccagggaggggcaagtggggacaggaagtgctctgaaacccgaccctctcttgctgggctttctccttttaaactgaggagctgctgtgtccatctcgcccgctgcttcctaggcggtacagagggtttcctgtagccttaagttttctctccgagaacagacagattcttggttgagccttaaacagggtccagtcttgggtgttagtcaagaatgctgttcaagtaaatacgttttactatcatttgactcccatgtgcccccaaacctggtattatttacaggtagttttgttgttgttttgtttttaaaccaaacaggttgacccattcactcaatctgagttaggaaatatattccaggcacaacctatcaggcggttgcctgcaagatcccagctgaaagcatcgctgggacaaaggtgatgctttggcagccaccctgttggctccgtccagcccacacctcagttgtctcaagctgctctttcagtgggaatgtgagatctggtagcagaggctcatttcaccccaattttctatttcagaaaaaggggccgggtgcagtggctcaagcctgtaatctcagtactttgggagtctgaggcgggtggatcatgaggtcaggagattgagaccatcctggctaacagggtgaaaccccgtctctactaaaaatacaaaaagttagccgaatgtggtggcgggcgcctgtagccccagctactcgggaggctgagacaggagaatggcgtgaacccgggaggcggagcttgcagtgagccgaaattttgccactgcactccagcctgggcgacagagcgagactctgtctcaaaaaaaaaaaaaaaaagaaaagaaaaaaggaaactcatccgaagcaagagaggcagccacggggtcccatcttggcagcacatcttctggtccccggtttagcgttctgtccttctcttgggtcatgttcttgtctctgttcttcctcatcccttcttcgtccttgtcatcgccacttctgacactgactgagtggggccacaaaaggtgagtcgtccttccggctgcccccaccacaatccagccctggctcaagagcagggaaggtgctgtcccccaggctgcagacgggggttagtacagcaacctcagacagcttcctctctggggggaccctgcgtgtcttgggtgcagtttcgaggaggatgcagagggatggatccctgccttcttctgtgtgacccctgcggtgggggagcatccctgctcagcccaggggatggcacttttcatgtttgccgtgagattcctctagcaaaagcagtgggttttgtgagtacttaggtaatggtgccagaaagcaccatgacaccctggtatgtccgccccatataatcagagaatctgactctgctcactgctgagaccccgatacccagggtagggcctgaattttcaatgcaattgcgataaattaatgactaaatggattctcagtttgaaatgtaaggcgtgacagaacgttcaacccagggaagattgagtcaggacccgggaccttgccggaacacctgtggccgttgctgctgttaactgaggtgtaattaacatgcagccaagtgcacagcttcacccagcagatccgtacgttttgacaactgtgaaacaagacgtagcacatcgccatcgcgcttctcagctccgccttcaccactctgggtgccagcaccggcaatttgtttggccagttccagagtgtcataaaaacagaatcctccattgtcactcctctgtccttgaagagatatgcatcgagttgtatgcggccactctgcgggctcccctcggcacatgatggtcttcagagagaggctgtttggaaatagagtggtgggtgtttgcttcttgtcacccggcaaatgattcatttttctgctgctctgacactttggaagaagccagggatgctgaggagatggcttgctctcacgtgggcagctgctcctttgagaaacaagccatgcgcagtgttagctgctgacatcctccacttttagcccttgagcccatttcactgatgagcaagacagtggcctgtatctgtcactaacgtgcttttctttttctcccctgttccccaaagacaggagtgtggagttcatgagtgttggatttttcaagctagtaaaccttgcagctgcaagtggtgtttaattcttgtggtatggatgagcacatgctaatctcccttgagcttctcttgagcagaagcctggtgtgctaacgggcaggactggggtggtgctttgagaggaagagggggaaggtggcccgagagggagatctactgagatgtgagctgcctggagtttggggtggggattcctggaggggctctggattttgcagagggacagctgttggtgcaccttcaccagtgtgctgggacagaaagtggggtgagtgggtgagtgaggaataagtgtttgaagggcaggagtaaagcagaaaggtggcagcaggtgttgagctgcaagtggttccattgcctggaaaggaggtggcagggaggcctgcccaagatgggtgcctgcagggtgcggacagcctgtcagaggtgcggaaagcctgacattgaaaatgtcagacagtgggtgcttgggccagagagaaagagcctgaggagctggaccaggggttggggggcggcctttagaagcagcgtctcatgcagccttcccagcgatcctgaggtaggtgggagaatcttcaggccacggctgagaagctgaagcgtgtggcgggagatccgtctcagaacacctgagatccctgcagggtctgggagcatgttaggggctcagagtgcaggtagggactggcagggaggagctgtgggcgggaagagagagaagggagggcagggcagtgtggccatggccagctgaacactgggagtctgctcctgaggtcatggatggaggccaggacacctctcaagccattaagagggtggcctttccaagcgcagcatgacttgttggtcttgaagcagtgccttcgaaggaggaggagtcccccgtggacttggggcattaggacagggactgccaaggagagagggcactaggaaacagggttgtttttggcttttttacctggggtgcaagtggagcaccctgtgggcatcatgagggtgtcaggaaacccttctggtaactgaaacgcagtccattctgtgtcccccagattctgagttttcagcacctgacagtggcgggggatggcagacacacctgtgggtgctggagacatcttggcggcccttcctccagtttggcatcatagtcccctgtgggctgagcacatggggctcctggacagttgttaccgatggagggtatccaggttcttgacatcttgaacaaagaattggacaaaacggcacaaacaaagcaagaaaaagatgaagcaacaaaagcagatttattgaaaacgaaagtacactccatagggtgggagcaggccctggttacagaattttctggggtttaaataccctctagaggtttcccattggttatttggtgcatgccctatgtaaatgaaagtgacctgcgatcagtctgattggttgaggaaagcagccaaccagaggctgaagtgaagttacaaagttacatcctatgcaaatatctgattcattgtggaaagcaaccaatcagaggctgaagtgaaattacaaagttgcactcctatataaatgaagacttggccggagaccagcttgattggttgcaggaggggaccaatcagaggtactttcagttcttgatctgcttggtagaaaagcaggtcggtgtgaagggagtagcctctggttcttttgttacttggggatggaaagttggggttttcctttggatttagttctaagaagtcagcatgaattggccttaggttccctgcctccagaccctattctcctgcctcacagtgatgttgatcagggggctcagcttggctctgccagttcagacaccagccccttccagctactgccagtccttggaggaaagcagtcttggtaccgtgtccggagaggtcatttccatgtaaaagaaatatgaggtctacaggcagctcaggagcacggagttgggggaagcagagaaggtgtgagtgccgaggcgcaagcacggcttttgtttgggtcaagcaggatcagtgcctccctccttgcatcgctccacctccggaaggcggagaactgcgatgcagacccaggaggccagccaggagagatttctcaccccaggctcgagcctttgaagctccaggttctaacttaaaaattcaagggagtggccgggctcggtagctcatgcctgtaatcccagcactttgggaggccaaggcaggtggatcacgaggttagggatcgagaccatcctggccaacattggcctgacaaggccaacaaccttgtctctactacaaatacaaaaattacctggttgtggtggcacatgcctgtaatcccagctacttaggaggctgcggcgtgagaatcgcttgaactcgggaggcagaagttgcagtgagccaagatcttgccactgcactccagcctgggcaacagagccagacaacatctcaaaaaaaaaaaaaaaaattcaagagagtttcgcattctcccgtgcaatacttccctgcttgttgtagtagagatgcgtcctgtgcctttttaggaacatgttctgaaagatggcttgggcaactgtgactttagtgctctatccccccagcactgccctggtacccatcctgtttagagggctcagagcagagagcacctgcctggcagggcccgtctctgactttgccttgctgctcctcccagcactgccctggtacccgtcctgtttagagggctcagagcagagagcacctgcctggcagggcctgtctctgactttgccttgctgctccccccagcactgccctggtacccatcctgtttggagggctcagagcagagagcacctgcctggcggggcctgtctctgactttgccttgctgctccgcacagcactgccctggtacccatcctgtttggagggctcagagcagagagcacctgcctggtggggcctgtctctgactttgccttgctgctccgcactgcactgccctggtacccgtcctgtttggagggctcagagcagagagcacctgcctggcggggcctgtctctgactttgccttgctgctccctgttatcagcactcttgtccctgtgtcctccgggtggcctgcagggcaatggaagatgagtacttagtagaaggttctaggtgggcacatgagggttccttgccagcaccagggctttgttcacacaggtgttgcatgaagccatccagccaagagccagggctccatgcctctgagccctcaggcactgcatcatgctgggcctcagctccatacctgccgcgtgtctgtctcaccatcactgtgctcaaggaaggtcgccaccagatgctcctctgtgcgccgggcctgctggggctgccctggggcctggaaagtgctttaagcaggtcctttgtctcgtgtcaggggatgggctccaaagttagtggttggaactaactttgccatctgctggagggctttgcccctgccatgccttgagcccacacatactccaggggtgactgacacagttggttttgcatcagaattggccattgccacctctgaggggctgggaaatgggtgaccctgccccacagtgcctgcactgcccccagcagacaatgctgggggagcagcttcccaccaggcctggcttggggcttctccagggaagcccaggtacacctcccagcctgtaggtgaaggtgcctggaatggaactcgctattcccagaggcacagagctcccgtcacagcggctgggtgacagcagtaattctcgcagatgttcaggccctgggaccccagaagtgaaatgacccagggcgtcagcaggaaaggaggccccactttttcaggacctctccctccaaccagctccacgtccttcccaaagctgggcccagcgtggccctcatagccagctccgtctctctctccttgggcctgctgtgactgcaggcacggatacactggggagacgggatgtagaaagctgtgggaagagggagcaacggcagggcaggggccagtggggttggggggggccgctggccctgcctttggatcatctccgacttgatcagcatgaacccctgactctagagggaggctgatgggccagggcacatgtgggtccccctcactgcctccgcagcagtggacctacagccatgctctttgaccccatctcttcctttcatgggcacacaggtgacccgagtctctgtttcgtgcaccttcctgcctcttctctgcccctcagttgggctgagacacatgaggtgctgtgatgcatgctgcatttggccctgacttaggtgtgacgcgtttccatttttaaatcgagtgtaaagaactggcctccagaaacacggaagcacttttagtagggatttgaaaatccgcagatcgttgtgtatctcagagcccagtgtttttcttgaaattcacactggaaacaaatgaggatactgggggaaatgtgcagtcccaggacatgagagatgcgagcttattacgaatctgtctttggtaccaagccacaatatagagatttgtgaaaatctttaaaaatcaacttgactgggccgggcgcggtgctcacacctgtaatcccagcgctttgggagggcaaggcaggcggatcatgaggtcaggagatcgagaccatcctggctaacaaggtgaaaccccatctctactaaaaataccaaaaaaattagccaggtgtggtagcaggcccctgtggtctcagctactcgggaggctgaggcaggagaatggcgtgaacccgggaggcggagcttgcagtgaaccgagatcgcgccagtgcactccagccttggggggcagagcaagactccatctcaaaaaataataataataaaaagatctggaacgttttcgtcccctcaggaagtcatccctgccccaggcatccacggaggtcaaggccttgccaaccccacttcctgggtccagctctcaggtggttctccctgtggcctccagacccgggctgtaccggctggtttcgcaggttgcctgtgctcatcctgccctctccggtgagagctgagccggtggtgtttttttcagagccagctggccctgcaggagctcagaaacctgggcggctgggcctatgggctctggagttctgcccagggtggccaggtgggcagcctttcccccgtgctggttcctgtagcaaggaggaggccgtgtgctggggcccttgtgtcaggagctgtctctggaaaggctgaatcgaggaaccagcctctgccttgtccgtcgatgttgtggggttagtggctttgtcccagagtttcaaagtgtgggtaagtggtttctgggtttgccagttttcttagcccttaggggaaagggggtgggagcctgccctcagctggcttcgtaaaaacacagtatctgtgcttgagttacacgcccggcgtccttttgcgttttgagacctcagtggagtgtgcgggccctgagtagtatgcacccactgacagtgaaccagatgctgcccccctgcggttccagtgtatgtcagtgccagccacgtgcccaggacccaccgttcccagggatacaagatcccgtggcccatggtggcagctgcggcacacagcgctgctttccagagctctcagtgcggacaacagaggccttgcattcagtcacctggaaaacccaccatccacattggaaacccagtctctccggaatgagaaatttggttggttttctttagctttttgtttttttgtttgttttgtttattttttgagacagaatctcactctatcgcccacgctggagtgcagtggcacaatcttggctcactgcaaccttggctcactgcaacctctgccgcccaagttcaagcaattctgttgcctcagcctcctaagtaactgggattacaggtgcctgccactgcgcccagctaatttttttgtatttttagtagagacagggtttcaccatcttggccaggctggtcttgaactcctgacctcatgatcggcctgccttggcctcccaaagtgctgggattacaggcatgagccaccgctcctggccctggttggttttaattaagaacattttcaaacatccacgtggcatacccgttatccagatctaacgcccattaatattttgccacttttttgctccaactaaattaaactaaattctggaacattctgtcattttgcccctgcatattccactgtgcatctgttaatataaaatatggactttttgtacataaccacaagactcttctcacacctgacaagattaacaccttcatctgttcttttagaggttttgttcctttgtgtgttctttgtcatctgttttgttttgttttgttttgtttcgtttcatttcgtttttgagtcagaatctcaccacgtcacccaggctggaatgcaatgacaccatctcagctcactgcaacctctgccacccgggttcaagcgattcttgaacctcagcctcctgagtggctgggatgacaggcacaccaccacgcctggctaatgtttgtatttttagtagagatggggtgtgttagtccattttcatgctgctgataaagacacaccagagactgggtaatttataaaggaaccaggtttaatggactcacggttgtacatggctggggaggcctcacaatcatggcagaaggcaaaagtcacgtcttacatggtggcaggcaagagagaatgagagccaagcaaaaagggaaaccccttataaaaccatcaggtctcgtgggacttattcactaccacaagaacagtatgggcgaaactgctcccatgactcagttatctcccaccaggtccctcccagaacatgtgggaattttgggagctacaattcaagatgagatttggggagggacagagccaaaccatatcatagtgtttcaccatgttggtcaggctggtctcaaactcctgacctcaagcagtccacctgcctggacctcccaaagtgctaggattacaggtgcgagccaccatgcttggccccagctttttgttgttgttgttgttgttgttgttgttgttgttgttgttttttgagatggagtcttgcactgttgcccagcctggagtgcagtggtgcgatcttggctcactgcaacctctgcttcttgggttcaagtgattcttccacctcagcctcctgagtagccgggattataggcacctgccatcatgcctggctaatttttatatttttgtagagacagggttttatcatgttggccaggctggtcttgaactactgacctcaggtgatccaccagccttggccttccaaagtgctcatattacaggcatgagccaccattcccggcctatttttaaagggtctggagtcaacagtgcatggatccagaaccgtgggaacaaaggggtgggcacaagggcggggtggggggtgtgagtttagagaggcttctccctataaagctgagcatgaactacttggcacacctgacgttgaaccaggagctgagaaccacacaagttaggagtcagagcagagctgctcaggacgtcagtgctggccctgtcccaggtcaaggggataccccgggaagtggctggactgagccaagtatcagctagtagtgggtgctcaaggctggtgtagaggggcaccgcctccctgccagcactgtcctgacacttggaccccatcagctcgttccagcagagaaccaccctggggaggggcctagctatctccactccgcagagaaggctccaggaatctgattaactaaggctgagccagcagagagaccagattcagcgtctaaattcctccccttgtcaggaaagggaaggttgtgcagaaacctggacagtggacgccgcgggcacttcccacccatggcagcaggagggcgggagctcagagaggctgggctcgccctgccagtggagtggggactgccagataaaagacgaggtctttcctgggcagtgagtgagtcctgggggcccaggggcttgcctccacaccttgcacctgcccccagcagctttcagctgcggatttcacggcctttcctgattgttgtttgactccgtcatttctgttggtgattccaaaatggtgactttctaattcagtcattatttctacttttattagctggcattcttctgtaaagaactttcctcaacgctgagatgaactacgcagttcctcctaaaaaaggaggatgaatgcagcatcttttcccatttatttatgggtttgtttatttatttatttttagagacagggtcttgctatgttgcccaggctgatctcaaactcctgggttcaggcgatcctcccacctcagccttccaaagtgctgggattacaggcatgagccaccacacccagccttccatcctttccttttttttttttttgagatggagtctcactctgttgcccaggctggagtgcagtggcgcagtcttggctcactgcagcctccacctcccgggttcaagcgattctcctgcctcagcctccacagtaactgggattacagttgcccgccaccaagcctggttaatttttgtattttttgtagagacagggttttgccatgttggccaggctggtcctgaactcctgacctcaggcagtccacccaccttggcctcgcaaagtgctgggattacaggcgtgagccatcacaccaggccccatcctttccttttaacgactaatttccaacttaaagaaccaaggcttctgttttccccttctcggtgcccagcacttggccggccagccttcctccctccattcctctcttcctttctatacaaacttccttgttaaataaaacaggggggctgctcctcccgcccctggattggatgcactttcctgatttaaaggagtccttggccactcgtgaccccgacttgaactgtggtgtcccccaaagtctctttctttccgcccaggagtgttcacttgctgggcggggaggagaaattggggtgtgacccactcagcacaaacccacgccctggtcataaagccgcaccatttcccctgcaaatccagccgttcactgccccggccaccgggctgctttgaagggggatgaggcatgggggctgctgaacccacaactgtcactggcagccactggctggagttgagagaagtcaggctggctggggccgttgaccctcggaaggaccactgtcataagatgtgagaccagtcaggggcagctcagatggggagagaggctggccagggcttccttcagctggggctgagcagtggagggcctggttccccatcctgcctgccctcctgggcctgggtcttcccagcgatgggggcgactgcagcgcctcttgggagggcgatcgtgagaggcagaggcctctgagtgctggctgaggggtgtccacccgtgggacatgctccgtgctcttctgtctcgcctgcctcacaagctgagcatgaggaagaccaggctgtgaggtgacgcgtcccccccacccttccccacaggtgtgaatgacagaggtggtgccatccagcgcgctcagcgaggtcagcctgcgcctcctctgccacgatgacatagacactgtgaagcacctgtgtggcgactggttccccatcgagtaagtggagcggattgcagggttggggagagcccgtgagcctcaggtgcagaagctgggcggcgggggtgggggcctcttgggcccttaggaccgtgctgcaaagatgggaatggcctggaggggccacaggggtcccaggttacccacctcatctagggacccctgctgctgggctctttccacctctcagggtgtgcagagttccccagaagggctctgtgagaaatttcagttacagagctatcgggtgtggtgctatttataattcagaaaatttagaagccactcaagtatcttcacagcaaggagttggttacatgcattagagtaattagagtatgtgcatataaaagtgcaatattattcagccgggaaaaaaaaacctgtcaaagagttatattttttgatagagaaatcttttttacaagatattaaaggagcctgtaatcccagcagtttgggaggccaaggagggcagatcacctgaggtcaggagttcaagaccagcctgaccaacatggagaaaccccgtctctactaaaaatacaaaattagccaggtgtggtggtgcgtgcctgtaatcctagctacttgggagactgaggcaggagaatcacttgaacccaggcggtggaggttgcggtgagccgagattgcgccattgcactccagcctgggcaacaagagcgatattccgtttcaaaaaaaagaaagaaagatattaaaggaaaaaagtcagtctagaaaatagtatgtaccacgatcctatttttatttgaaaacatgtacaagataaaattttataatgataggtatgaactgagcgggggtgaaaaaaattttacaagggggtatgtaccatttaacagtgtttcagtatttgaggtgggtagattaatattaggccctatgattgtttcttcttgtctgtcttgcctacaatatatgcacatacagcttttttgatgaaaaaagttgacacaaactttgaaaatggaaaataaacaagatcttgccagccaccagcatttccttgagtgttcacctcagactgactgaacctcatgctcttggcagggcggtggcagggacccctgtgcgtctttgtggaagcgggaactgtcacagtccaggtgatgtgggctggcggtggcaacatgagttaaaaaactgttcttggctgggcgcagtggctcacgcctgtaatcccagcactttgggaggccaaggtgggtggatcacctgaggtcaggagttcgagaccagcctggccaacatggtgaaacctcatctctattaaaaatacaaaaattgggccgggcgcagtggctcacgcctgtaatcccagcactttgggaggccaaggcaggcctgaggtcaggagttcgagaccagcctggccaacatggtgaaacctcatctctattaaaaatacaaaaattgggccgggcgcagtggctcacgcctgtaatcccagcactttgggaggccgaggcgggtggatcacgaagtcaggagttcaagaccagcctgtccaaggtggtgaaaccccgtctctactaaaaatacaaaaaaattatctgggcatggtgcaggcacctgtaatcccagctactcgggaggctgaggcaggagaatcgcttgaacccaggtggcagaagttgcagtgagccaagattgtggcactgcaccccaacctgagcgacagtgagactctgtctcaaaataataataataataataataataaataggcctggtggcacgcacctgtaaccccagctactcgggaggctgaggcaggagaatcacttgaacccgcgagtcagaggttgcagtgagctgagatcacaacactgaactccagtctgggtgacagagtgagactccatctcaaaataaaaataaaaacgtgttcttcagcccagcaatttaactgctggaaactaatctagagaaataaaagctgcagtgagtgcatagatcagactctgcccagggttgcctgagagccagtggagccacgctggaccgtgggccttggccatgtgagccacccagcctgcctgtctctcctgcagttctcgtgggcctaaggtctcaggttcccaagactgtgacatgaaccgggctgtgaggcagcaaaactaaccctacacaccctagaaactccatgtgcctctgtcctcctgaccttgtctctctggggctggggctggattcgcctgttaatgaccatgtcctgggcctttatgcccactgttttttttgcctgctccgctcagaggggtcttggcctcattgttgatgagcagccgttagcagcctcagcctcacattccccttaagggcgggttcctccctgtcagggaaggcattgtaaactcaaacgcctgtcagctgtgaacctggctcttcctggaatcactccactcccctagtcttcagtgtccagaagtctcacagattctcgtaggcactcctccagtgtccaagggtgagaagggccctaaaatcttcactcacctggtggaggaacagggccctgctgctgactctccatgagttgcttccatggagacagtttcatgtcggataaaattatttttcccgggccaggcgcggtggctcacacctgtaatcccagtactttgggaggccaagacgggcagatcacatgaggtcaggagtttgagaccagcctgaccaacatggagaaaccccatctctacttaaaaaaaaatacaaaattagccgggcgtggtggcacatacctgtaatcccagctactcgggagaccgaagcaggagaatcgattgaacccaggaggcaacggttgcagtgagccgagatcacgccattgcactccagcctgggcaacaagagcaaaactccgtctcaaaagaaaaaaattcccatcagagatccccagtcctgtctagacagatcactgctttaagaaggtggctgtgacagttaggtagagacttaagtgatgggcacactcctcggcagccttagagcagcaggcagaagtggcccagagctccctgtggttctgatgtctagagcacgaccatagttggacttgacctgtggcaggttcacctgagtatgttctgtttctcaggtacccagactcatggtatcgtgatatcacatccaacaagaagttcttttcccttgctgcaacctacagaggtgccattgtgggaatgatagtagctgaaattaagaacaggaccaaaatacataaagaggtacgtacgtgtgtgcagtgaggacttggcagtcactgtcattggacgggccaagggggcttgcgatggaatcatgctgcctgctccacagccgtcgtccaaggagcctgtgacccaaggaatccaagtggccaacgacacttgtccctggctggtgcttttctgtgtgtgtgtgtgtgtgatttcatggtgcgtgggcctccagtcgtgcccagcagcaggcttcataaccactgtcgttctgaagcaggcatgagcgcagatgatgcattgagaatctgcagttacaacgtgctatgaaaatacccctgatttgtgttggcggcagtgtcatagaaaccgctaagactgcttcagcttgttgaaggaaatgctagttacagttagaggtcagggaaagtacagagataattttttttcctctaacttcacagagccctttaagatctaagaaccctttgggcatccgtggacccacctcagtctcacttcaggctagcaaaccccagtctgaatgtaaacagtaagaccatggccatattgttccaaatggttgagtttagtcaagattctgtgtgatgatgttggtcatcccagcatctgaggtaatgtttaccacccgaggatttagccaaggagggaaaaacccaccaacaactggcagatggttcaatttgtttggcttgaggttatttctttaaaagttagagaaggggccgggcgcagtggctcatgcctgtaatctcagcactttgggaggccgaggcgggcagatcatctgaggtcaggagttcaagaccagcctggccaacatggtgaaaccccatctctactaaaaatacaaaaattagccgggcgtggtggcaggcgcctataatcccagctatttgggaggctgaggcaggagaatcgcttgaacccacgaggcagaggttgcagtgagccgagatcgtgccattgcactccagcccgagggacaaaagcaagacttcgtctaaaaaaaaaaaaaaagaagaagaagaaaagttagagaaggcctgggcacagtggctcacacctataaccccggcattttgggcagatcacgaggtcaggagttcgagaccagcctggccaacatcgtgaaaccttgtctctactaaaagtaaaaaataaattagccaggcatgatggcgcttgcctttaatcccagctactcaggaggctgaggcacaagaatcacttgaacccaggaggcagtggaggttgcagtgagcggagattgcacttttgcactccagcctgggtgacagagtgagactctgtctataaataagtaaataaaagtgcaagaaggcctgtctctccctttaaggacccgaatccactggcatctaccctgttttgcctgtggtcatactctgtctggcacagcttttttctcctgagtcactttttctgccctagcttcctcctgagcttttttctttgatttttaagagctaagatgtagcagaaagcaagtgtcaacattcttttctctcctcttttttttttattgaaacggagtctcactatcacccagggtggagtgcagtgatgcgatcctgatcccggctcactgcaacctccgcctctcaagtaggattttagacgtgcgccaccacaccaagctaatttttgtatttttagtggagatggggtttcaccatgttggccatgctgatctggaatccctggcctcaagtgatccgcctgcctcgcgggagtgctaggattacaggtgtgagccaccgtgcccagcctgatctctcttgttaatgggacacgtggtcccccccttcccccaatgactcattcccctgaaccccatccccctccgggtggctttcctgagtgccccctggtgactgtgtgcctgcccccaggtggcggctgggtctcttcctcctctggaatgtgtttgtgttccctcgaggccgacatggggaccctttggctcatgttcccggctctcagtagagggccctctggcctgcacgctggcactcattcatctggccccttcctctcaggcttagtgagttcaaggtcagggcaaagtagaccctgttaagagatgtcagctggggaacagacacccttcctgcaggcctggagtaacaagagtgataaggacgccttcctccctggactgacatatctgggtgaactgtggcttgaagagggctgggagagcagggagcctggacaggctgaccccagcccagcacgtgggagcagaaaggccttcttgttctttacgagttggaagatgataagagcctcatgctgatcagattcatgactcccacccggaattccatctctagaaccaagagatggtgggtggctttacgcaggtgtggcggtgtcctctgcctgtgggggcagcagaaggggttggacggccgcccaagtctcactcctccaagatcacctggggcagcgtgcgattctttaactgaacctctaaaactttgcatttgtccactgtcctgcatccaggcctaccaggtgacatgcgtgcattcccatgaggcccgcgtggtgctgtgtagttgctgccttcatgccataactttaccttgtgctggcatcagagcctcattcccgtccttggctaggcctcccacacacccctaggagaagctccttttgtgtgtgttcttcttttcagctgtttttcaccagaagggcataaacgctctcatttccttggggagtgggggcccctctccagtacctcttgattctgcccctcccagtcggtgtccctctggctgtcgtgggaagtcggtgcggagcccgcctgggccgggctgtgcagtgagccgtgcaccagacgtgtgagcctgactttctctctgactcttcctctaggatggagatattctagcatccaacttctctgttgacacacaagtcgcgtacatcctaagtctgggcgtcgtgaaagagttcaggaagcacggcataggtaagggcagccgggcccgcggcttggcgcccaccccacccccttgccctaccccacccccatcccatctgcacccagtctcttccctggccccaacaactctggctcgtgaacatccctcagtctcatcttccatcctcgttcccgtcttgggccagaccttcatcatccctcccctgccagcacacccaccaccttcagccatcctctttccacatgcccccaggcctttctgctgcagcctcgctcagcccccaggatggagctgaggaaactggcacctctcacttctgctgccgccacacgcacaactcgtgtattcactgctcacgattcagagtagaaagcgtgaacacgcacgaggaagcaacactcaccgtttctccgatgtcccaccccactcggccacacggccagtgagcggcagagtcttaattaattttaaacccaggcccatctagtccatgttttcctgggctcacatttaccctgtttgttgtctgaaagggagtctccatgcgggcccagcccatgggagggcgctaccaggccacctctgcagtccctcccagcagtctgtagctaccaggctccatctggccatgagattttagggactttgacagtggtggtgaagaaaggctggtctctgatacggtgggccgagacatctccgagagactcatgcaaagcccccatcctagcccagtcatccttccttcctaactgctctgcctgcattacctttacctcttctccccaaggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttatatccttaacttctgggggagagggactgtggcttcctgtccataaggtggcagagccagtgagcaagttggagctgtggtccccctcagatgatgttcaggtggccaagcttatggatgcttctctcccttacctgatcgtgttgtgggtaaacctgacacacatttgggtaaatcgagttgcacatattaccatgttgcccaggctggtctcgaactcctaagctcaaatgatccgcctgccgcagcctcccaaattactgggattataggcatgagccctgcacccagctggagagcctcctgctccacttgcactggggatcagcagtgcacaaaacggacaggatcccctgtcctcccagagcctgtgctagcagaggggaaacaagtgcggagagaagagatttttactttttttgaatacttgggttcaaaccttccttataggatgcatgacccaaaggtatgcccttccctgcttcttcctccttaactttcactggcccctgacaggtcagagggaagccaggaaactttataatagtcagaatgtggcccaaaaaaatgctgtgcgtgtgtgtgtgtgttttcaaattcatgagtctaggatttattcattacatagaataataagcaggaaagagaggggtgaccccacactccacaggccgtctagcttatgtgaagacaggcatccagggggtcagcactgttgaccccctccttgtcatatggacagggctctgtccctcttgctgccacaaaggttgagaatctagggagaaccagaagcacctgcccttctgccaggccccttccccaccccccgtgcatccctgggtgtggtgtccacatgcctgctgcctcactcagaaggcccttctgtccccagaccccaccctctgttgttttgcacagcagaggccacttcgtctcatgagcctttccagctctgcagaggcttagcgggctctcagcctccgaagcctggcttgccatctgcacacagtcccacaggccactgcgcgggcccctgatgactgtgccctggcgagcgtggtcagggcaagtcggaatcttccttaacagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagtggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattgg

SEQ ID NO: 38803 - DNA, 1662 bp, Homo sapiens; identical to SEQ ID NO: 38394

SEQ ID NO: 38804 - DNA, 216393 bp, Homo sapiens
ttgagacggagtttcactcttgttgcccaggctggagtacaatggcatgatcttggctcactgcaacctccgcctcccaggttcaaacgattctcctcctcctcagcctcccaagtagctggggttacaggcacccaccgccatgcccggataattttttataatttaatagagatggggtttctccatgttggtcaggatggtctcaaactcccgacctcaggtgatctgcccgtctcggcctcccaaagtgctgggattacaggcgtgagccaccgtgcccagccttgatacttgattctataggaagaatctaagaaaactaaggctcagcctccccagctcaaggaatccttgccaaatactcaagctcaattcaacaatgcttttctctgtcacaggcagcagtaccctggaatcctatacacacatttaaactgtgtgtgtctgctcaccaacatgtaagcaactgaagatcaggaacctacattattcatctgtattctagcatctaacattgttgacaactggcagcaataaatattcgttcaagtgaacacctatagagtagcatataccatttgcgcagggagaaccatcattcaggcctaatctgcagtaatgtaaacttagcattcacagaaataacagagaatatactaccttaagtttttctcttttttttttttttttttttgagacaaggtctcattctgtctgcccaggctggagcacagtggtgcgatctcaggtacctcactgacctctgcctcccctccagggttccagcaattctcccgcctcagcctcccaagtaggtgggactataggcatgtgccaccacacccagctattttttttttttttttttttttttttgagagagtctcgctctatcacccgggctggagtgcagtggcacaatctcggctcgctgcaacctccgacttctgggatcaagcgattctcctgcctcggcctccggattagctgagattacagaggcgtgccaccatgcctggctaattttttgtatttttaatagagacggggtttcaccgttttagccaggatggtctcgatctcctgacctcgtgatccgcccgcctcggccccccaaagtgctgggattacaggcgtgagccaccgcgcccagcccacacacagctaatttttgtattttttggtagaggtagggtttcaccatgttggccaggctggtctcaaacacctgacctcaagtgatccacttgccttggtctcccaaagagctgggattacaggagagagccactgcgcccagcccatatactaccttaagtttttactaatgtaattgttgcctcactcccacaaatcaaaggaaactttcatcagtgtttcaaaacttagggttggcatagcagtcatggaatacatatttttagactttccaaaagccccaaaaagttacattttatcctacaataaattagcaatttacttagcattgatgaaaattacctgaactaagtaacagcagtagttatttcttgcttatcagatgacctgactggcaattatatctgataaataattgagaaaataatcatctgagaaaaggattatcattcagtagtgtacttcagtcacaatatgtaaatacacaaaccctgactggatgggaaaagaggctataaaaatacttcagtgacaatatgtaaatacagaaaccccgactggatgggaaagaggctataaaaatacattttgtgggcctacagcagctgctcacgcctataatcccaacactttgggaggctgaggtgagcacttgaacccagaagttgaagaccagcctgtgcaatatgatgaaaccctgtctctacaaaaaaaaaaaaaaaaaaaaaattagctaggcacggtggcacaaatctgtagtcccaggtacccaagaggctaaggtggatcatctgagcacggggagttcaaggctgcaatgagctaggattgcaccactgcactccagcctgggaaaaaaaaaaaaaaaaaaaaaaaaaggtcgggcgcggtggctcctgcctgtaatcccagcactttgagaggctgaggtgggaagatcatgaggtcaggagttcaagaccagcctggccaacacagtgaaactctgtctctattaaaaatacaagcctcccctctccccacggtctccctctgatgccaagccaaagctggactgtactgccgccatctcggctcactgcaacctccctgcctgattctcctgcctcggcctgccaagtgcctgcgattgcaggcgcgcgccgccacacctgactggttttcgtatttttttggtggagacggggtttcgctgtgttggccgggctggtctccagctgctaaccgcgagtgatctgccagcctaggcctcctgaggtgccgggattgcagacagtgtctcattaactcagtgctcaatgttgcccaggctggagtgcagtggcgtgatctcggctcactacaacctccacctcccacccgcctgccttggcctcccaaagtgccgagattgtagcctctgcccggccgccaccccgtctgggaagtgaggagcatctctgcctggccgcccatcgtctgggatgtgaggagcccctctgccctgctgcccagactgggaagtgaggagcgcctcttcctggccgccatcccgtctaggaagtgaggagcgtctctgcccggccgcccatcgtctgagatgtggggagcgcctctgccccgccaccccgtctgggatgtggggagcgcctctgccccgccaccccatctgggatgtgaggagcgcctctgcccgaccgcgaccccgtctgggagttgaggagcgtctctgcccggccgacccgtctgagaagtgaggagcccctccgcccagcagccgccccgtctgggaagtgaggagcccctccgcccggcagccaccccgtctgggaagtgaggagcgtctccgcccggcagccggcccgtctgggaggtggggggcagcctccgcccagccagccgccccttccgggagggaggtggggggcagcccccgcccggccagccgccccgttggggagttggggggcgcctccgcctggccgccgccccgtccgagaggtggggggggcgcctctgcccggccaccccttctgggaagtgaggagcccctctgcccggccgccacctcatctgggaggtgtacccaactgctcattgagaacgggccatgatgacgatggcggttttgtcgaatagaaaagggggaaatgtggggaaaagatagagaaatcagattgttgctgtgtttgtgtagaaagaagtagacataggagactccattttgttctgtactaagaaaaattcttctgccttgggatgctgttaatctataaccttacccccaaccccgtgctctctgaaacatgtgctgtgtccactcagggttaaatggataaagggcggtgcaagatgtgctttgttaaacagatgcttgaaggcagttaagagtcatcaccactccctaatctcaagtacccagggacacaaacactgcagaaggccgcagggacctctgcctaggaaaaccagagacccttgttcacttgtttatctgctgaccttccctccactattgtcctatgaccctgccaaatccccctctgcgagaaacacccaagaatgatcaataaatactaaaaaaaaaaaaaaaaaaaaaaaaatacaagccgcacacggtggctcacgtctgtaatcccagcactttgggaggccgaggcgggcgatcacctgaggtcgggagttcaagaccagcctgatgaacatggagaaaccccgactctactaaaagtacaaaattagccgggggcatggtggcacatgcctgtaatcccagctacttgggaggctgaggcaggagaatcacttgaacccaggaggcggaggttgcgttgagccaagatcacgccattgcacactagcctgggcgacaagggctagactccgtctcaaaaaaaaaaaaaaattagccaggtgtggtggcacgtgcctgtagtcccagctactagggaggctggggcagaagaatcccttaaactcgggaggcggaggttgcagtgagccgagcccacgccattgcactccagcctgggtgacagaatgagactctgtctcaaaaaaaaaaaaaaaaaaaaaaaagggacagaaaacaaacacacaggccagccaactagaagactaaatataatggcagacatatatccaaaatatctgtaattacaacagatatgaatggtctccatgctctagttaaagaggttagctgatggctcactcctacaatcccagcactttgtgcgggtgaggtgggaagatcacttgagcccaggagttcacgaccagcccagccaacatagcgatacactctaattaattaaaaagaagttagcaagttgctaacttaacaaagcaaaatccagctatgtggcgttcatgaaagatatatctagaacatcccactacaattggctaaaactaaaaaggcaacataaaatgttggcaaggatgtagaactcttaaaccactcagtctttgagaatgaattcccaattcttagggcatccactctgtgtataagctgaactttttccagacacctagaatgaaattcattatgtaccatccttgacagatttgagaaaatagtaactcaactttctgtgttctgtggttcagctgacaagcctgagaacaactgtgcaacatgtggaaaacactttagcattacttagtaaaagttacacataccctacatacaaaccaaaaattccactctcagttatgtagtcttgagaaaatggactttgtttgttgtgggcagggtggcaaatgtccacatgaggacaagtaaaattggtaatctcaaaaaactggaaatgagacaaatatccatcaacaatgaaatagacaacatatggcacatccttacaatgtaacctcatactactataagaaatcaacgggccgggcacgatggctaacacctgtaatcccggcactttgggaggccgaggtgggcagatcgctggaggtcaggagttcgagaccagcctgcccaacatagtgaacccacagctctactaaaaatgcaaaaaaaaaaaaaaaaattagccaggcatggtggtgcctgcctgtaatcccagctacttgggaggctgaggcaggagaattgcttgaacccaggaggcagaggttgcagtgagccaagatcgcaccattgcactctagcctgggcaacaagagcaaactccatctcaaaaaaaaaaaaaaaaacaaacaagagtccatgaccagcctggccaacatggtgaaaccccgtctctactaagaatacaaaaattagctgagcatggtggcaggtgtctgtaatcccagctactcgggaggccgaggcaggagaattgcttgaaccaaggaggcagaggctgcagtgagctgagaagccgagatcgtgccactggcattccagcctgggcaaaagagcaagactccgtcttataaaacaaaacaaagaaaaaagaaatctacatgggggctgggtgcagtggctcatgcctgtaataccagaactttgggaggccgaagcaggcagatcacctgaggtcaggagttcgagaccagcctggctaacacaaggaaaccccgtctctaccaaaaaatacaaaaattagccaggcatggtggcgggcacctgtagtcccagctatttgggaggctgaggaaggagaatcgcttgaacccgggaggtgaatgttgcagtgagccaggatcgagccactgcactccagcctgagcaacagactgagaccctatctcaaaaaaaagaaatcaacatggataaatctcaagcatgtaagagtgaaagaatcaagcatcagaagaatcatacaattcttacattgagaataagactgaaaatgggcactattaaaccatatgttgcttacggatatacatataaggtaaaattattgtaaaaaagtaacagtaggctggggtggtggctcatgcctgtaatcccagcactttgggagctcaggtgggcggatcatgaggtcaggagtttgagaccagcctggccaacacagtgaaaccccatctctaccaaaaatacaaaaaattagccaggcgtggtggcgggcacctataatccgagctactcgggagatggaggctggagattcgcttgaacttgggaggtggaggttgcagtgagctgagatcgggccactacacttcagcccaggcgatagtgcaagactccgtctcaaaaaaaaaaaaaaaaaaaggaacagtagaacctgcagagtgactcatacctataatcccaggactctgggaggccaagcaggaggatcacttgagtccaggagttcaagaccaccctgggcaacatagctagaccttgtctctattttaaaacaacaacacaaaggaatagtaaacctataatgtagggtaatggttacctcaaggaaagcgaaaagaaatgccttgggagctggcatacacaggagacttccaggtagcagtaatgtcctatttcttggttgttcattttactttttttttttaattttacatatggggccaggcattaagctcacacctgtaatctcagcactttagtaggccaaggcaggaggatcactttagcctaagagaccagcctgggcaacatagcaagactcctctctacaaaaagaaaaattagctgagcatggtgatgcatccctgtggtccaagctactcaggaggctgaggtgggaggatgccttaatcctgggagatagaggctgcagtgagccatgatcatgccaagacactccatcctgggcgacaaagcaagaccctgtctccaaaaaaaacaactctacatatgtgtttacccccaaccaccttctacgttatacaatgacaactctacatgtttttatgcctcatatatcatctacggtatgtatgctgttttttgggtttttcttctgagacagggtctgtcacccaggctgaagtgcagtggcacaatcacagcccactgcagtctcaaccacccaggcttaagcaatcctccaacctcagcctcctgagtagctgggactacaagcacaccatgcccagctaatttttgtatttttagtaaagacagggttttgccacgttgtctaagctgctctccaactcctgggctcaagtgattcacctgcctcggcctcccaaagtgctgggattacaggcatgagccaccacacccaaactatgctgtatttttcaataaaaatcagcaagtatgcaaagtatgatcctattatttatggagatagggtctcactctgtcacccaagctggagtgcaatggcacaatcatagctcactgtggcctcaagcaatcctcccacctcagcctcacaagtagatgggactctgggtacatgcaatcatgcccagttaatttttacattttttttatagagacagggtctcactatattgcccacgctggtctcgaactcctgctcaagaaatccttccacctcagcctcccaaagcgttggaattacacgcaggagccatggagccaggctccaactttttttttttttaaacatatactccatgtttcagggggaaaaaaaaggccaggcacagtggtccacaactgtaatctcagcactttgggaggccgaagcaggtggatcacctgaggtcaggagttcaaaaccagcatggccaaaatgacaaaatcctgtctctacaaaaaatacgaaaattatcagagcacggtggcaggctaatcgcttgaacccagtaggcggagattgcagtgaacagagatcacaccactgcactctggcctgggtgacagaatgaaactccacctcaaaaaaaaaaaaaaaaaaaaaaattagccgggcgcggtgactcacgcctgtaatcccagcactttgggaggccgaggcgggcagatcacacacgaggtcaggagatcaagaccatcctggctaacacggtgaaaccttgtctctactaaaaatacaaaaaattagccaggcttgacagcacacgcctgtagtcccagctactcgggaggctgaggcaggagaatggcgtgaacctgggaggcggagtttgcagtgagccgagatagcgccactgcactccagcctgggcaagagagcaagactctgtctcgaaaaaaaaaaaaaattagctgggcgtggtgatgcatgcctgtagtcccagctgcttgggaagttgaggcacaagaatcacttaagccagggaggcagaggttacagtgagccaaggcaccacagcactccagcctgggcgacagagaaagactgtctcaagaaaataaaaataaaagaagaagccaggtgtggtggctcacgcaagtaatcccagcactttgggaggccaaggcaggtggatcacctgaggtcaggagttccaagaccaatatggccaacatggtgaaatcccatctctactaaaattacaaaaattagccaagtgtgttggcaggcgcctgtaaccccagctactcaggaggctgaggcaggagcatcacttgaacccggtgggcagaggttgcagtgggcgaagatcgtaccactgcactccaacctgggtgacagagcgagactccatctgtaaataaataaataaataaatgaagagtattacctagtcttaaataaaacacctactctactccttaatgtgagccctatttcatacttcaaatccaaatagttaactggattccaattcaattatgctatgtccagcatgaaaattagttatcaaaaaatggaaacttatcaaacattgtttacaaacgggtaaaaaaaggctgggcgccgtggctcacccctgtaatcccagcactttgggaggccgaggcgggcggatcacgaggttaggagatcaagaccatctggctaacactgtgaaaccccgtctctaataaaaatacaaaaaattagccgggcgtggcggcaggcgccagtagtcccaggtactcgggaggctgaggcaggaaaatggcatgaacccagaaggcggagcttgaagtgagccgagattgcaccactgcactccaatttgggcaacagtgagactgtcttcaaaaaaaaaaaagggtagaaaaaaataaaaattaaaaaaaaaatttttttttgagacggagtcttgctccatccaggctggatgaagtccaatggcacatggctcacagcaacctccacctcccaggttcaagcaattctaccgcctcagcctctggagcagctgggactacaggcacgcgccaccacaccaggctcatttttgtatttttagtagagacggggtttcaccatgttggttaggttagtctcgaactcccgacctcgtgacccgcccgcctccgcctcccaaagtgctgggattacagacatgagccacagtgcccagtcacaaaagaaaatttttaaggagcatctttgagaaacttaaaaaatgtcaagtaaactcagcaggaaatatcagcataagtggtttacattaaaattgtaaaaactaatctgataaatttgattctttgagttagtaaaaaaaggatcctattcctaaatacttgatagttggggcaaaattacttcaaaatctaccacaaagattacatggtgatattccctacatgtcctccctctctttgccttccttcaggttgtatctccactctttggaaaaaacggctgcttctaaaatctatcagagatctactaacttaccagtcaacaccatgggtaccataacacttagcttttaagaacgctccatttactcaaaataacaactaagagctccatttactcaaaataacaactaagaatgaacgggtatttgctgacatacaggtttctcacaaggaaaaataaagacagatgtgcttaagggcagagaactttacaatctgtaaatgcctgcagactgcttctttagagcaggcattaacccttgctaatatacttaaccacccccaccccccaaccccacaaagtgtcttattaacaaaggaaatcttaacaataaatcatcatttaaaaaaaaaaaaaagaggactgggaaatcaacaattcaaagctaacattttagaagtaaaggcttcatgccgggcggggtggctcacgcctgcaatcccagcactttgggaggcaggcggatcacggggtcaggagatcaagaccatcccggctaacacagtgaaaccccatctctactgaaaaatacaaaaaattagccgggcgtggtggtgggtgcctgtagtgccagctactcgggaggctgagccaggagaatggcgtgaacccgggaggcggagcttgcagtgagccgagatcaggccactgcactccagcctgggcgacagaacaagactccatctcaaaaaaaaaaaaaaaaaaaaaaaaaaaaagaaggcttcacttcagaccactccaaaccttcaagaaaggtttgtactttctacacatattttatacttaagagggtagataccgggaccagttcccatcacaatacaagtacatattgaaataaacctattagtctacatgttctcacaccatcacaccatttctccccatacaataaaagtcactcaggctaatactaagagagacactcctggtgatcactacatagactgcactagtaaccaggaaagggaagcagaggtgttattgttgttccaatatagttctaaaggcaactccatgtgactactgctgatccagcccacatttaaagggaggacagaggaaaccagagcagcaggaaacaggcaagagaggcaattaccacaaccctttcccatggcctcattctctcccatgccaccactttcgggcatatttcaatcacaacaaaaaccttccttctctgaaaggtttcataattattgagggtgagaggcaacagggaagcaaatgggggaaatcagcgctgtgggaaaatctctcgtcacacgtatcaactagccataagtaggaaaatcaggagtatgctggcagcaagcaaaagggcagtttgggaaactaatcacttctgcctaatgataagagaagccttcaaagcaatggaaggacaaccctagcgaaggggctccacaggtgagtgtattgaaggaaactatcatctccagggagtggaatacattccctttcctgaggtaaaaggggaacacaccaatgtaggatacgggagagcttaggtatcatgttcaacttccttccacctttcacaaactggcactaaaacggatacacaattcacagtgaaaagtgaggaatgcaataactagtcgcataccccttgttgaaaaaagtgctgtcacaacggaagaggaatataagaactgggttcacccaagaaattatatgcccttcaaataaaagataatctttggataccttatggagacctgaaaaaaccctcaactagctgagcaccgtggtgcacactgtaatcccagatactcaggaggctgaggtgaaagaatcgcttaaacccaggagctggaggccagcctgggcaacatatggagaccatatctctaaaattaatagtaattttttaaaatctctcaactgttaggatacactggtgctgtagaaagacaataagcctaaatactggcaaaccatataccttccttgaatgtgaggtaaaaacaatatccaatagaagtggtagtaaatgactggattacatcaaacaggaaataacagtaataatgatgggatcaacccctaaagcgagcaagcattagagaccagagtggtgacagttgagatgcgtgggcaactaattagactaaaaactcaggggaaaatgtggaaaagccgagtgggaaagtgattcagaggcaaacaactgagttgtaatgcaccaatgaaagaataacattttgagtatgtattattaacagagagagctttgccgtttacaaagcgctcaaaaacctacattaaataatgaactgtgatataaccagactacaggaacggcgggtgtggaggaaaactgagtcccaattgagaccaatgccctacagaattgaaaagaagtagaactgaactgtgactccgggtaagccaggaaaggttagagagcgcataagttggggctataacagggccagtcccaagactagctacgggcgtgaaagcggaaaggtgatgagatgggaccgacagcgtggcggggaagctccagtctactggcaggcaccgaggtgggagagaaaaccacaccctccagggcagaaacccgaaaggggggaggggaggcacccctggggctgggtggggcccagccgacctggacgggggaaagtaggaagaagcacagggcaacgtgaggggaagaggaaggagggagcccgggcctggacgtagagggaccgtggacctggcgagtgaagctcggcccggtcctcacgggtgggcgccggggcagtctgcaggcggtggggtttcagacgagctgaacccagaattagaaagcacacgctgcagcgctcagggccctggaagagggaaggagagggagaggatggcaattaccgctgctgctctcggaggacccaagacccgctgccgccgccgccgctcgttacctgccaatgtgcctcttacaaagcggcggcggcggcacaggctgcccaacccgtcacgtgacctcgcgtcacgggcgaaggaggagccacaacacgtcgctcgtgcgcggcttcagagtcagcctaggcggcgcgcggcctcttccagccaccacctccaccccaaccccgcgaagccaaccgcgtggaggtggggaccacagaaaggaacaaataagggagacttgataatatgtattgtactcggagtcatcaggagagtattacccaccgcatacaaggtgcccacaactgcagctcgtcgtcgcgccgtgatgacctcacaaagcaccacaggttactcccctgtggccgccctgtgctcatcacgtgatgtggtccaaccactcagggcaagcctggcctcccaaatgttgcacgaggggaccacgactcccaacatgctgcacagccaaggcgacccctaccgcagcctttctccagcgggcttctagacgaaccccctagagaccttagagccgagggaaggccgggacggaaagcggactaagctggcttgaaggactaataccattggatgccgcccgccatgtggcggagcgtggtgcctgctgggaggtgtagtcctggcggggggtggggttccgctcccacgttcctgggctcgctctgcgccctgccccctgcgcgggaaaacgccaacggctagcagcgagagcctcggcaaggcggaaggtgcgcccacttttagtctttttcagtgcggttttacttttgccctcccaagccccttctgggtgaaaagactagaatctactgaacgcctactccaagtcagccgtttatttctgttatatcatataatcaactccttgagtccaggattttccctatttaaggatttaaaaaaagaaccttagagttgtttgttgaccgaagagacccaggttttctgtctttagaaaattaatgacctcctctcaataggatctgacctgttgtcaactccaagaattacgaataaataagatgatggtttataattgtagcatggtgttttaaagtattttccatttactggcctgtttggatgtgagggcgttctggctatcttgtcaccccatagatcgccagggctgattcggctgatctggctgtctaggcgggtggccccttcctcccgcacctctccatgtgcgtccctcccgaagctgcatattcggtcgaaaaggaggagcatcccccatagaagaggacaagtcaaggatataggagtagctgcacgcccgtgttaacaagctctcaaggtcctctaaacaagctctcaaggtctacttactggcctgttttatcccaagctagttacatacaaggactttgcagtcccggcatgccttatctcaattggagctttcctctgtaataacacttcaccggcttgtgaaaattaaatgagattatgtaaaatgcctgcttgacacataataaaccctcagtaagtatcagtaatcattttcacactctacccatcgggcccaaaaggtctaagtaaggtagaaaggggaaattagcttatactgaactttgtacagggcactatgctaattactaatttgctagttattaagtaaaacaattgacatcttaaacagccctatctagttcaaataaagcctttgttattcatctgaattaaagaatgctgccgggcgtggtggctcacacctgtaatctcagcactttgggagccggaggagggcggatcacaagatacggagtttgagaccagcctgaccaacacggtgaaaccccgtctctgttaaaaatacaaaaaaatgtccgggcgcggtggctcacgcctgtaatcccaacactttgggaggccaaggcgggccgatcacgaggtcaggagatcgagaccatcctggctaacacggtgaaacccagtctctactaaaaatacaaaaaaattagccgggcgtggtggcgggcgcctgtagtcccagctactcgggaggctgaggcaggagaatggcgtgcggagtttgcagtgggtcgagatcgcgccactgcactccagcctgagcgacagagcaagactccgtctcaaaaaaaaaaaaaaaaaatagcctggcgtggtggcacacgcctgtaatcccagctactcaggaggctgaggtaggagaatcacttgaacacaggaggtggaggttgcagtgagccaagatagcaccactgcactccaggctgttcgacagagcaagactctgtctcaaacaaaaaaaaaaacaaagaatgcttaaactgtgcctttaacaaacagaactgggccgggcgtgatggctcacgcatgtaatcccagcactttgggaggccaaggtgggtggatcacctgaggtcaggagtttgtgaccagcctggccaacatggtgaaaccctgtctttactaaaaaaatacaaaaaattagccgggcgtggtggcgggcgcctgtaatcccagctacttgggaagctgaggcaggagaatcacttgaacccaggaggcagaggttgtcgtgatccaaaattgtgccactgcactccagcctgggaggcagagtgagactccatctcaaaaaaaaaaaaacaaaaaaaaaacagaacttatcatcatcaccattcatgtgtaggtgtatcttatctcacctcttttgacaatgagctaggattgtgtcttgtctgttcgtcttcctcctgtttgccctgctgctttatagaaatgtgtgggagcatcagagataaaaaccacccttgagagtcaaagacttaatggacagatcaggccaggcatggtggctcatgcctgtaatcccaacactttgggaggccaaggcgggcggatcacctgaggtccagagttcaagaccagcctggccaacatggtgaaaccccgtctctactaaaaatacaaaaattagccaggcatggtggcgggtgcctgtcatcccagctacccgggaggctgaggcaggagaatcacttgaacctggaaggcggaggttgcagtaagctgagatcatgccattgccctccagcctgggtgacaagcgcaaaagtccgcctcaaaaagaaaaaaaatgacagatcaggagaaaaggattctgaaaggaatatacaaacttgataacagtggctggctctgaggggtgggaaagaggtttgtgattggggttgctggcccaaagggactgcagtctaacgttttcgctttttacttggagaaggcactggtatataacttacgtaattataagattaacttggcccagcgcggtggccaagcactttgggaggccaaggtaggcggatcacaaggtcaagagattgagaccatcctggccaacatggtgaaaccccgtctctactaaaaatacaaaaactagctaggtgtggtggtgcacctgtggtgcgcacctgtagtcccagctactccagaggctgaggcaggggaatcacctgaacccgggagtcggaggttgcagtgagccaagatcgagccagtgcactccagcctggcaacagagcaagattcctctcaaaaaaaaaaaaagaagattaactttatgaggtcgggcgcagtggctcacatccgtaatcccagcactttgtgaggccgaggcaggtggatcacttgaagtcgggagttcaagaccagcctgaccaacatggagaaggcctgtctctactaaaaacccaaaattagcctggcatggtagtgtatgcctgtaatcctagctactcgggaggctgaggcaggagaattgcttgaacctgggaggcggaggttgcagtgagctgagatcgtaccattgcactccagcctgagcaacaagagcaaaattctgtctcaaaaaaaaggaaaaaaaaagattagctttatgaaaaggaagaccagagaccacgtgttagctctgtgaccctgtacaagctgtgtcacttctccaggcctcaatttcttgttaaattcattttcaaaaacatctgccttttctgtgtcagggacactgtgctggttacttttattacattatcatttattaagcaagaagtcctaccaagaacctaggatcagagaaaataagaacatcaaagccctaaaacctcactgattactgttattgggacctggatgcaacagaactagcctttccctccccgtccctcacacaaaggatatcattcaccttatccacccagcttgactctgagacattgactctgaaactaaaactaatttcacatcctgtgactgcaaaggacatccccatctttttttttttttttttttttgagacagagtctcactctgtcgcccatgctggagtgcagtggcgcgatctcggctcgcggcaagctccgcctcccggattcacgcctttctcctgcctccgcctcccaagtagctgggactacaggctcccgccaccatgctcggctaattgttttaatattttttagtagggacggggtttcaccgtgttagccaggatggtctcgatatcctgacctcgtgatccgactgccttggcctcccaaagtgctgcgattacaggcatgagccactgcacctggccatccccatcttttttaccagtttttgtttgcttcagtcttcttgctggactaaagtgagcacataatgtcatggaagatacactggagaatttatcagaaacctgggttctgaagtctgtacaaatgggtggcaatatgatagataggtgtgtgaaatcattcttttttttcttagacagggtcttgctatgttgcccaggccagagtgcagtacctattcacaggtgtaattatagtgtactatagcctttagctcctgaactcaggcagtcttcccacctcagcctccagactagctgagactacaggcagtgtgccactgcaccgggatctggaatcagtaattcttagatgaggcccgtcttcagaaacaaccagtaatagtaataggtggctgagatttaggaggatacaatcaaggcatataaactccaaagcagaacaggtgtggtgcctcacgcctgtaatcctatcactctaggaggccgagatgggaggctcacttgaggccaggagttcaagaccagcctgggcaatatagcaagactccatctctatttatatatacatatatttattttcttaataaaaaactccaaagcagaattttcacaaactagataaagctaatcacagttgaaatctttttttttttctttttttgataccgggtctcactctgtcgcccaggctggagtgcagcgggcgatctcaactcactgcaaccttcacctcctgggttcaaccgattcccatgcctcagcctcccaagtagctggaactacaggcaggcaccaccatacccagctaatttttttttttttgagactgagtctcgctctgtagcccaggctggagtgcagtggcgcaatctcggctcactgcaagctccacctcctggattcatgccattctcctgcctcagcctcccaagtagctgggactacagggccccgccacgatgcccggctaattttttgtatttttagtagagacagggtttcactgtgttagccaggatggtctcgatctgctgacctcatgatccacctgcctcgacctcccaaagtgctgggattgcaggcatgagccaccgcgcccggctatacccagctaatttttgtatttttagtagagacgggttttgctgtgttggccaggctggtctcaaactcccggcctcaggtgatctgcccaccttggcctcccaaagtgttggaattacaggcgtgacccactgcacctggttcacagttgaaatctaatgtactctcttaattgtaaaataaatgtcataatcaaatgcattataccctgcctaaagaatgtgataatacgaggtcaggagatgagaccatcctggctaacacggtgaaatcccgtctctactaaaaatacaaaaaaattagccgggcgtggtggcgggcgcctgtagtcccagctactcgggaggctgaggcaggagaatggtgtgaacctgggaggcggagcttccagtgagccaagatcatgccactgtactccagcctgggcaaaagagcaagacttcgtctccaaaaaaaaaaaagaatgtgataacagagaggaaaataggcttcctagagtcttaaaaaaaaaaaatgaaccttaataagcaaaagcgtatgccttgcaagaaacagggtggcctaaccagcacttagaacattttgaccccttagcagatttctgcctttagcagatgaagatgggtgttccatgcctattaaccataaggttccctaacctgtgttccatgttttcaagcaacctactgattagaatttggctgctatttaatactttcctccagagaagtgaatgtgctgttgaccagagaaccatatgttatttggcttgactgaaaattagtgtactggccaggcgcagtggctcatgcctgtaatgccagcactttgggaggctgagctgggtggagcacctgaggtcaggagtttgagaccagcctgattaatgtagtgaaaccccatctctactaaaaataccaaaaaattagcatggcatggtggcacatgcctgtaatcccagctactagggaggttgaggcaggagaattgcttgaatccaagaggcagaggttgcagtgagatcgcgccattgcactccagcctgggcgacagagcgagactcctttaaaaaaaaaaaaaaagctaaagagaaaggaaaggaaaggaaaagaaaatgaaaattagtgtactggaagccaggcacaatagctcatgcctgtaatcccagaattttgggagtccaaagtgggaggatcacttgagctcaggagttcaagaccagcctgggcaacatagtgagaccccacctcttttttttttttgagccggagtttcactcttgttgcccaggctggagtgcagtggcacgatcttggctcactgcaacgtccacaaatcccaaagtgctgggattacaggcatgagccactgcgccaagcaaccccacctctatttttaagaaaacgaaaaacaactggccaggcgggttcaagtgatgctcctgcctcagcctcctgagtagctgggattataggtgcatgccaccaggcccggctaatttttgtatttttagtagagatggggtttcaccatgttggccaggctggtcttgaacttctgacctcagatgatccacccaccttggcctcccaaagtgctgggattacaggggtgagccattgcgcccggcctgagatgctgaactttaaatgcagtgaccaaaagaagtaatcataatgtcactgtgtgaggccttttgggcatggtgacttacacctgtaatcccagcacttttggaggcctaggaaggaggatttcgaattgctctagtattgactttggaaacaaaagacatcgttctatttatagcattctggttttggtagtagtatttccatttacaaaatatagtaattctcaatcgccgataatgtcaaatcctagaaaacacagcagtcctacatgtgattttaacatcattctcaaagagttgttggccggagactcatttcacgaatccaatttttccaaaatagacaattctgatgattcagatgatcctgatcttagctctgtttagaaataactccaagaacagttttttaaattttatgttcacattgaaaaccagtcagatttgcttcggcctcaatgagcatgtttatgtgaaattaaatgagcactggcagcgagctgcacttttttttttctaaaccaggaaagggttaaaaacctttgcttaggccagacacagtggttcatgcctgtaaccccagcactttgggaggccaagaggggatggtcccttgagcccaggagttcaagaccagaatggccaacatggcaaaaccccatctctactaaaaaatacaaaaattagccaggagtgatggtacacacctgtagtcccagctactcaggtggctgaggcacaagaatcactggaacccgagaggtagaggttgcagtgagccgagctcataccactgcactccagcctgggcaacagagcaagactctgtcaaaaaaaaaaaaaaaagaaagaaagcaagcctggctgggcgcagtggctcatgcctgtaatctcagcactttgggaggccaaggagggcggatcacaaggtcaggattttgagaccaggctggccaacatggtgaaaccccgtgtctactaaaaaaaaatttaaaaattagccgggcatggtggtgtgcgcctgtaatcccagctacttgggaggctgaggtgggagaattgcttgaacacgggaggcagaggttgcagtgagcagagatcacacggctgcactccagcccgggcgacagagcaagactctgtctcaaatatatatatatatatattacaaaaattagctgggtgtggtggtacatgcctgtagtcccagctacttgggaggctgaagcacaataatttgaacccaggaggtggaggtttcaatgagccagattgcaccactacactccagcctgggcaacatagcaagactccatctcaaagaaacaaaaccaaaaaaaaaaaaaatccctttgctatggccaggcacagtggctgatgcctgtaatcccaggattgggggatgccatggccagcagattgcttgaagccaagagttcgagaacagcctgggctacatggcaaaatctcatctctataaaaaaaatgcaaatattagccagcgctggtggtgcacacctgtagtaccaactactaaggaggctgaggtgggagaatcaattgagccttggaggtcaaggatgcagtgagccatgatcacatcactgcactccagcctgggcaacacagcaagacactgtttcaataaaaacaaagtctttgcttataagccattcaggaggtcactttttttttgttttttgtttttttgttttgttttgttttgtttttgagatggagtctcgctctgttgcccaggttggagtgcagtggcgcaatctcagctcgctgcaagctctgcctcccaggttctcaccattctcctgcctcagcctcccaagtagctgggactacaggcacttgccaccatgcccggctaattttgttttcgtatttttagtagagacggggtttcaccatgttagctaggatggtctcgatctcctgacctcgtgatccacccgcctcggcctcccaaagtgctgggattacaggcgtgagccactgcacccggccaggaggtcacgttttaagcatgagctgcctgattcttcttgcttggtgccctgaaaataaatgccctcctttctcccactacaaaacctcaatatacttgtttggtttactgcaccaggcaaatggaccctagttcaattcagtaacaagttcagccttggaaacatagcaagacctcatctctaaataaaaataaaaatagaccaagcatagaggctcacatctgtaatcccagcacgttgggttgccaaggtaggaggatcacttgagcccagtatttcaagaccagcttgggcaacacagggagatctcatctctacaaaaagtcaaaaaattggccaggggcagtggcttacgcctgtaatcccagcactttgggaggctgaggcgagtggatcacctgaggtcaggagttcgagaccagtctgaccaacatggagaaaccccatctctactaaaaatacaaaattagccaggcgtggtggcacatgcctgtaatcccagctacttgggaggctgaggcaggagaatcacttgaacctggcagatggaggttgcggtgagccgaaattgtgccattgcactccagcctgggcaataagagtgaaactctggccgggtgcggtggctcacgcctgtaatcccagcactttgggaagcagaggcaggcagatcacaaggtcaggagtttgagaccagcctggccaacatggcaaaaccccgtgtctactaaaaatacataaattagtcgggcatgatggcacgcgcctgtagtcccagctactctggaggcttgaacctgggaggcagaggttgcagtgagccaagatcatgccattgcactccagcctgggcgacagagcgagactccatctcggaaaaaaaaaaaaaaaaaaaaaaaaaagagacttcccctgacaggaatagctaaaagtaagtaaggaggcaatttgttagcaatctagggaaaaagatttagaaccacactgcactccatatacctgttaatttaaatatcagagagaggctctctaaagaaaatggtatttattcaggaataaggcattgcaatgggaattcacataccatagtaaactatgtgtgtattcgggaaagtaaaggaggacaaagattttcaaaggaaagataagaattgcacaattgttttgagataattatccttggctatgaatccaaggattaataaaaaggatcatgctagtttgaggttgggcaggcagttgttgggcaaatgtcctttgcagaagtattttttgtatacgattgtgggccgttgtccaaggttgcagtttggcagtcttctgtgacagtttctgttatcaggcatttatgtatcagaatcttctcttcatggtcttcctcagcactatttgtcagagtttttttcttcttcttgttttcacacaagtgactcgattttgattctgacaacgttcatataccaagtggcttaagacaatagggaaaagctaacatttgttgtctgtcaggcacagttcatcttatctttatcccaattataaatattcaaggtaatttgtctgattttacaaaacagggagtagaggacacattaaataggtgacccaggattctaaacttttattccaaagcctgtgctctttctactaagccaagctgccactctatagaaaattgtcattttttttctttttttgagacaaggtgttactctgtcacgcaggctggaatgcagtggcgggatcagggctcactgcagcctggacctcctgggctcaggtgatcctctcacctcagcctccccagtagccaggactacaggtgaatgccaacacgcctggttaatttttaaatctaatttaatttaatttttgtagaaatggggtcttgctatgttgcccagcctaatcttgaactcctggccccagtgatcctcttgccttggtctcccaaagcactggggctacaggcttcagccaccatccctagccctctatgtaacattaaaaagaccaaaattaatgatagatcaggggagaaaaacacaaatttataaattattaatatttttaccataaaaagaactcatacaaattgacaaaaacactgaaaattcagtagataaatggacaaacataccacagttcccaaaagtgggaatacagctaaccagcaaacaggtggaaaaatattatacctcactagaattaattaattaattaattttttttgagacagagtctcgctctgtagcccaggctggagtgcagtggtgcaatctctgctcactgcaagctccgcctctcgggttcacgccattcttctgcctcagcctcccaagtagctgggactacaggtgcccgccaccaccatgcccagctaattttttttgcatttttagtagagacggagtttcaccgtgttagccaggatggtctcgatctcctgacctcgtgatctgcctgcctccgcctcccaaagtgctggaattacaggcgtgagccaccgtgcccagcctactttttttttttttaatgatactttaagttccagggtacatgtacacaacatgcaggtttgttacatatgtatacatgtgccatcttggtgtgctgcacccattaactcgtcatttacattaggtatatctcctaatgcaatcccttccccttcccccctagaatttattttattatattttatttttttgaaacatcccactctgtcgccgagactagagtgcagtgacatgatcacgactcactgcagcctcaacctcctgggctcaaatgatccttctgcctcagcctcccaagtagctgggactgcaggcatgagccaacaggcccagctaatttttttattttttgtggagattaagtttcactatattgtccaggctggtctcaaattcctggactcaagcgtttctcccacttcggcctcccaaagaggtgggattacaggtgtgatacagagcattcagccactacaaacttttttttttttttcgagacagtcttgctctgtcgcctgggctggagtgcagtggcgcgatctcggctcactgcgagctctgcctcccgggttcaagcaattctcctgtctcagcctcctgagtagctgggattacaggtgcatgccaccacccctggctaattttttgtatttggagtagagatgaggtttcaccctgttggtcaggctggtctcgaactcctgaccttgtgaactgcctgccttggcttcccaaagtgctgggattacaggcgtgagccactgtgtctggccgccactagaaatttttaaatgcaaataataataacaatacacatgttggccgggcacggtggctcacgcctgtaatcccaccactttgggaggccgatgtgggtggatcacgaggtcaggagattgagactatcctggctaacacggtgaaaccccgtctctactaaaaatataaaaaattagtcaggtgtggtggtgggcgcctgtagtcccagctactcgggaggctgaggcaggagaatggcgtgaacccaggaggcggagcttgcagtgagccaagattgagccactgcactccagcctgggcgacagagtgagactctgtctcaaaaaaaaaaaaatacacatgttgcccaccaaattaataaagagtaaaaataatgatgctacccagtgctaatcaatgtttactaaaagaagcactcttgggccaggcaaggtgactcactcctgtaattccagtactttgggaggccgaggcaggaggactgcttgagctcaggagttggagaccagcctgggcaacatagtaatgccccatctcaaaattttaaaaaggcacgctcttatttgcgtaataggaatacaaattggcataaactttttggaaaaaaaaagtcataatatattaaagcattcaaatccattctcatactcggccctaaggaaataattttacaaatggaaaaattgttatgcagaaaaaacatttctctcaggtttatttataactgcaaatattggaagcatctgacatatctgactgtagagaaatggttaagtaaattatggtattcatgctagatcccatattatgcagcctttataaacaacattttcaaaaaacatgccaggacatgggaaaatgcttgctgtgtacatttaggtataaaaagccaaaaccaaatctgtgagtaaatataactatgtaagaacagtatgcataagaaagaaagtctataaaaatacatcaaaagagtaataacatgggccgggcgcggtggctcatgcctgtaatcccagcactttgggaggccgaggaaggtggatcacctgaggtcgggagttcgagaccagcctgaccaacatggagaaaccccgtctctaccaaaaatacaaaaaaattagccgggcatggtggcgcatgcctgtaatctcagctactcaggaggctgaggcaggagaatcacttgaacccgggaggcggaggttgcggtgagccaagattgcaccattgcactccagcctaggcaacaagagcgaaactgggtctcaaaaaaaaaaaaaatagtaacatgggctgtgtttagaaaatggcaatttagataacattttcacttctctgtaatttcaaattgcttttaatactcaggtcttacacccagcgaggtggctcacgcctctaatcccagcactttgggaagccaaggcgggtggatcacgaggtcagaagttcaagatcagcctggccaatatggtgaaaccccatctctactaaaaatacaaaaattagccgggcatggtggcgcgcgcctgtagtcccactactctgtaggctaaggcaggagaactgcttaaactcgggaggcggaggttgcagtgagccgagattacgccactgcactcccgcctgggtgatacagcgagactccatctaaaaaaaaaacaaaaccaaacctcaggtgttacttttatgatctaaataatgtttaagcaaatatttagggctattgaaggttgtacgctttcagagagaaatccattgtatatgaatatgaacataatagcttatgagggaagatcagatttctaggatgttgtatggactgaattatgatcctcccaccccagttcatatgttgaagtactacagaatgtgactgtatttggaattaggatgtttaaagaggtaattgaggtaattaagtttcaattaggtaatcgggctcggccctaatttaactaatccaataggccttttttttttttccttcttgagacggagtcttgctctgttgccaggttggagtgcagtggtgtgatctcggctcactgcagcctccacctcccaggctcaagcgattctcctgcctcagcttcccaagtagctgggattacagacacctggaactatacccagctaatttttgtatttttagtacagacggggcttcaccacgttggccaggctggtcacgaattcctgagctcaggtggtccgcctgcctcggcctcccaaagtgctgggattacagacgtgagcccctgagcccagctaattaaaaaaaaattttttttgagacggcacgatctcggctcactgcaacctccgcctcccgggttcaagcgattctcctgccccagcctcctgagtagctgggactacaagtgtgtgccaccatgcccagctaattttttgtatttttagtagagacggggttttactgtgttagccaggatggtttcgatctcctgacctcatgatccacccacctcagcctcccaaagtgctggggattacagacgtgagctactgtgcctggcttttaaaattttttatagagacaggtctagctatattgcccaggctgatcttgaactcctggcctcaagtgatcctcccacctcagcctcccaaagtgctgggattacagccatgagccactgtgcccagccaaaaaaaaaattttgttttttaaataagcaatgtatagtctacacccagtatccatgggatatttattccaggacacaatcctcccccagtataccaaaatccacagatgttcaagtcccttatattaaatgacatcgtagtatttgcatataacctaagcatatactttttattttatttaatttatttgtttattttgagccggagtcttgctccatcgcccaggctggagtgcaatggcacgatctaggctcactgcaacctccgcttcccaagttcaagagattctcctgcctcagcctcccgagtagatgggactagaggcgcacaacagcatgcttgtttaatttttgtattttttgtacagacggggtttcatcatgttggtcaggctggtcttgaactcctgatctcaggtgatctgcccaccttggcctcctaaagtgttgggattacaggtgtgacccactgcaccaggcccagaatcagaacttaaactcaagtcttcctaaatttaaacacagtgctttattttctccaacaccattagtgtttttgccttctcctcctccccactggacataaagcttcttgaaaacaaggactgcgttttttcatgtgtgtatttcttttgtcatagagacgggatctcactatgttgcctagattggtctcaaactcctggcctcaagtgatcctcccacctcggtcttgcaaagtgttaggattacaggcatgagccagtatgcctagcctcatgtctgtatttctagcacctagcatgagatttagctcatagtaagcacaaaataaatattttttaaatgaagagcgatgtttctgaagacatattgtaagatgtctctgttttgcactttcacattttgcttacagggaggattgtagaaagcaatacacgcccacctacatatacaagttagaatttatcaaattctagaggtgaaaggaatttaagacgagtttgacctaggatttattgtttccccactatgtgcctagctgtgttctgggtgctgtgaagaataaaaaaaaaaaaaaatctttgacacaatgtttcacaatgctagcacaatacagtatgttctaaataaatgtctaatgaaaaaaggaagagagacagactaggagaaggttacaggccaggagtttgagcccagcctgggcaacactgggaaaccccgtctctacaaaaaatacaaaaattagctgggtgaggtggtgtggtggacagataatccaggcagtcaggaattcccgatctgattgtacaggatcttatatgccaggctaaggaatttatttcctcctgttactaatccctgctaaaatcctctttctataaaaatttgaatgtcaataggggtctccagaagtagacctccttagaggtctactcctccagaaaagcctccttagagatacagaggaatgaagtgctaatggtgggatgacaggtggtggtatgatattttagatgaggaggccacaccctcagatcctctgctgatatgccgccagttctgccaacttgagggtgggccagctgtggtcactaaagaaagaacacttttgatggcactcacttgcatatcaactttaaattagttaacttaagcaaaactcttccattgctcttccaagaatgaacacatggtagtcatgaggagaaatctgttttttttttctcgctctatcgcccaggctggagtgcagcggcgcgatcttggctcactgcaagctccgcctcccgtgttcacaccattctcctgcctcagcctccccagtagctgggattacaggtgcctgtcgccacacccggctaatttttttgtatttttagtagagacggggttttactgttagccaggatggtctggatctcctaacctcgtgatccgcccgcctcggcctcccaaagtgctgggattacaggcgtgagccaccgcaaccagcccgagaaatctgttctgatgaggatgagtataattcccagcccagccagaaaagaaaacatgccgcccacagcacactagggagggaagaagggggcttgacaacctgtttggcccagaccttccccaacattcccccagtcaaatgataacctcctagcagcttgggccttgtttcaggccaaagatagttcagtatggccttctgcaaggacagaatggctacacctgtgggctccttaaaagcaagaccaggccaggcagtggctcatgtctgtaatctcagcactttgggacgaaggaggatagcttgaacccaggatttctctcttttttttttttgagatggggtcttgctctgttgccaggctagagtgcagtggtgcagtctcagctcactggaacctccaactccctggttcaagcgattctcttgcctcagcctcccgattagctgggattacaggcacgtgccactacgcccagctaatttttgtatttttagtagagacggggtttcaccacgttggccaggagggtctcgatttcttgacctcgtgatccacccgccttggcctcccaaagtgctgggattacaggtgtgagccaccacgcccggccaagcccaggatttcaagaccagtctgggcaacatagtgagaccctgtttctaaaaaaaaaaaacaacaacaacaacaaaaaaacgccttttggctgaaaaaccacaatacttctcaacatttctgatactgagctctgctcttgggaaaactgtaatggtcatatatcttggaaatgactcctgagcccaaatccatcttcctggcagtgaaggaaatattatcattattttaaagaggaagatttgaggcccagagagattaactgctattctttcctctccctagaatgcccctttgacaagcaattattgttgttcactaaataaatgcctgagactatattaggtagtgggagacaatatatcatattttgtcttcagggtcttcataatctaacaggtaaacagatatgcaaatcctttaagtatgtggaaatagagaattgtaccagaaggggcagggcaccaggtaaggcctcagagaggagaaactaagtgtgcaggatatgaaaagattgagatttctccagttaggtttggttgtttcttatcaagtacaaattcctgaaagaaatcttaaagagctcaacttttcaggctgggcatggtggctcacgcctgtaatcccagcactttgggagctgaggtgggcagatcatgaggtcaggagtttgagaccagcttggccaacatggtgaaaccccgtctctactaaaaatacaaaaagtagccaggcatggtggtgcacgcctgtagtcccagctactcgggaggctgaggcaggataatcacttgaacctggaacgcagaggttgcagtgagctgagattgcaccactgcactccagcctgggcgacagagtgagactccgtctcaaaaaaaaaaaaaaaaaaaaaaaagggggctgggtgtggtggctcaagcccgtaatcccagcactttgggaggccgaggagggcagatcacgaggtcaggagatggagaccatcctggctaacacagtgaaaccccgtctctactaaaaaaatacaaaaaaattagccaggggtgatgtcaggcgcctgtagtcccagctacttgggaggctaaggcaggctaatggcgtgaacccggaaggcggagcttgcagtgagccgagattgcgccactgcactccagcctgggtaaaacagggagactccgtctcaaaaaaaaaaaaaaaaaaaaaagagcttagctcaatttttcaagccagataatactatgggtcaatggtcactctaggatatggagattttcaccctggtccagtcagctgaggttggtggtcgtagcaggtcatgtgacctgcccagggctgcaccttcagtaggggccatcagtgaccatggcaggtatcaggggaagactttcctggtttctgaagtatgagtaagaagagagttcctggccgggagtggtggctcacacctgtaatcccagcactttgggaggttgaggcaggtggatcacctgaggtcaggagttcgagactagcctggccaacatggggaaacctcatctctactaaaaaaatacaaaaaattagctgggcacagtggcaggtgcctataatcccagctactcgggaggctaaggcaggagaatcgcttgaacccaggaaggagaggttgcggtgagccgagattgcgccgttgcactccagcctaggagagagcaagactccatctaaaaaaaataataataagtaaataaaaaaaaagaagtcagttcctaaacagcctagagatgcattcagccaaggtccccaggcttaggtggaatgtacctccaacaggtgctggggccttaaaagctcacgctgggtgcagtggctcacttctgtaatcccaacactttgggaggccaaggcaggcggatcctttgaggctaggagtttgagaccagcctgtgcaacatggcaaaaccccatctccactaaaaatacaaaagttagcaacatggtgagaccgtgtctctacaagaaatttaaaaattaaccaggtgtggtggcacatgcctgtagtcccagtggacgactgcctgaacctaggagtttgagagtagcctgggcaacatggggaaaccctatctataaaaaattttatatatatatatatatataaattagctgggcatggtggtgcacacctgtagttccaactattcaggagactgacctgggaggaccacctgaacctggggaggtcaaggctgcagtgagccatgattgtgccagtgcactccagctgggtgacagagcaagaccctgtctcaaaacaaacaaaacaaaacagcaacaaaaaacaccacacaataaaaaactcaacaatcaacaaaacaagccctaatatgtagcatgtgctgatttctgtggcataaatatccctaccacagcctatttaaagttacaggatatggccgggcgtggtggctcacacctacaaccccagcactttgggaggccaaggctgttggatcacttgaggtcaagagttcaagacctgcctggccaacttgtcaaaaccctgcctctactaaaaatacaaaaattagtcggtcatggtgatgtggacctgtaatcccagctacttggaaggctgaggcaggagaattgcttgaacccaggaggcagaggttgtagtgagcaaacattgcaccactgcactccagcctgggcgacagagagaaacctgtctcaaaaaacaaaacaaaaaataaataaaataaaataaagttacaggatatatcaagctacatcaacctacaatataatgctggaagtggagagtgaagtagtggagaactctgactccagtgcaggcaagttactttatctctctgggcctcagtttcttcatctgtaaaatgagatgatactaatgcttcctccatagagtcattaaggggattaaatgtgaatatatgaaaatgacgtatggcagaggctaacattccgtaccttttagctattgttagcctctactattaatttactgtgtgaccttgggcaagactctttctatctctgcatcttagttccttcactttgtaaaacaaagaggttttattgtaaataatctttgacatccttccagctctaaaaatcctagtgccatctctgactccagtaaaagagaacctcagcctccgtctctggtttatgagcacttttcctgaaatcacaggtataagtcacctgggtgatgcaagaaacatccaggtggattctgtccaaagttgattcattccaaaatgtaaagttaaaaggccgggtgtggtggctcactcctgtaatcccagcacttttggaggccaaggcagacggatcacttgaggtcgagagtttgagacgagcctggccaacgtggtgaaaccccatctctactaagcaaacaaacaaacaaaaaatacaaaaattagccgggcatggtggcgcacacctgtaatcccagatactcaggaggctgaggtaggagaattgcttgaacccaggaggcagaggttgcagtaagctgagatcgcaccactgcaagactctgtctcaaaaaaaaaaaaaaaagtaaagttaaaagtaattatcaggccgggcagtggctcatgcctgtaatcccagcactttgggaggccgaagtgggcagatcacctgaggtcaggagtttgagaccaacctggccaacatggtaaaacaccatccctactaaaaatacaaaaattagctgggtgtggtggtgcacacctgtaatcccagctactcaggaggctgagacaggagaatcgcttgaacccaggagggagaggtcgcagtgagctgagatcataccactgcactccagcttgggtgacagagcaagactccatctcaaaaaaattaaaaaaaaaaagaagtaattgtcagcctttgcctcactcagtctgggaaaacttctctggggccaaagcttcccggcatctgggactcttttcctctaactggcaggcccaggtgctggtcagttctggctgagtcatttgtaaacctgctaggtgcctggtttagaaactttctgattcttccctcttgggagggtcctaggggaaaatgtctttttctttttttctttgtttcatggagagaaacaaaaacagaaagaaacagaaatacagagagaaacctagaggcactattaatagaaagagactgagaaaaaaacaccaggagaaagatttttctgacatttttttttctaacaagagaagacaaatacaaacagagctgaagataaaataaaagctgattcccaccacaactctgcagaatttcttggaaaggatcatgtttcaaataaatacacatgcagtacagatggcggtatttcttgcttttttccctactcttaactctgggatattttgagcatgcaccttcctccagcccaaatgcccagtggaataatcttacctacgtttccattcaggcccaatcctcctggttgaattccataggagttagaattattatcaccttttatcaccttagaaccaaagattctaagagcgaaaaatgactttagagcacacctcctcttcctgcaatattttacatatgagaaaaccgaagctcagagaggttaggtaacttactgagatcctacagacaaatgacagagccaggttagatggcaatctgtagtaagatacatgtccttatttatcaggtccccagcaagaaatagatggataattgaggagagtttaataacgacaacgagagatgttacagtgcccgagggccagtgacagtgtggaaacctgatcactattgggcttcaggggacaacaggaagggagcagcaaacaaatgagaagggtcacctgacaggggtctgcagtgactccacttttaggaaggtggggtgtcagtggaaaataaataacctctttttttttttgagacggagtctcactctgtcgcccaggctggagtgcagtggcacgatcttggctcactgcagcctccgcctcccgggttcaagcaattctgcctcggtctcccaagtacctgggactaaaggcacgcgctgccatgcccagctaatttttatatttttagtagagatggggtttcgccatgttggccaggttggtctcgaacacctgacctcaggtgatctccccacctcagcctcccaaagtgctgggattacaggcatgagccacggtgcccggccataaataacctcttgtcccaatcctctttcctcctaatctccattgggagaatttaaccagaaggcagaggacaagaaggcctactgatagaccaggagtacccagtagggcagagagtagatctggaggggtacatggaagcacacctatcatcactttatttattattattattattattattattatttgagatggagtctaactttgtcgcccaggctggagtaaagtggtgagatcgcaccactgcactccagcctgggtggcagagcgagactctgcctcaaaaaattaaaaaaaaaaaaaacaaggaagagagaagctggagtcttgggacctatgagcagatagtttagtggaagcctgggaggccctctcctccttctgtggagcaaaaagtcacctctccagggacctctttgacttgacagatccctttggctgtatcctgtctcctgctctccctacctctagaatcacctccctaccctaaagccaaaggagtctgaggcagagtcaagactctcagaagcaagttaaaccagttcctgcaggccctgacatgccctgctgaatagcccctgcagaaaattcctgtcctcagctgtagccacagctggctactgatggtaagaaagagacctgaggaggggagagatctcaaggaaaacacaagtcgacaccttccttcaaatacagatagagccaaactggacttttaggagctgagaccgtgcctgtggggcaaagctaacactcaagtcacctctttcttggtcagcatagtggctacttctgcctgaaaggacatctccaaagagcaccaatgcctgtttcttggggcctccatccaactgtgtcagctcagatcctagcagagctcccggtgttctctgagaagctgcctcccagcaatatctgagagcccaggtttcagtttcttcctccaggttgctcaggtcccctgagtcccggggaaaggccacacatggcttattcctcatgcaggcaatatggctgggtgtcttgcctcactgtggttatatagggtaggctacaaccagggggagtacagaggttaatggttcaggattgggtaaaggcctggctggaggcttgagggcttggagcttggtgtaaaagttacctccccctgtttctggtgcttcagagtcaaaattatttggcctgactttaagtgagggagttctgccatctctcctggactgtaagagctcagccgatgactcagggagccctaagaatgctttacagctgtgctctgtaaacaccgtcacgttttatgttgcagaagttcacagtcagccaagagatttagttacctgcctgcagtcaaaagctggttaatgattagaaacaggatttaactgggagcttcaacctcagatccagtgctctttctctaagctgcctcctacctaactcctccaatgctctatttatttatttcagataggatctggctctgtcatccaggctgaagtgcagtggtgcaatcatagctaactacagccccaaacttcttgtgctcaagcgatcctcccatctcagcctcctaagtagctgggactacaggtacgtgccacttgtagtgatttttaaattctttttttaatagagatgaggtcttggtatgttgactaggctggtcttgagctcctggcctcaagcaatcctcctacctcaatctcccaaagcgctgaggttaggtatgagccaccgcaccccacctcaatttattgaatttggtgatccagtgatccagtggcaacattccattccttccacaataagatctatttggctttaaacaaaacacacacacttctgagaagctgtatgctcacatctttgtaaatcaaatctgcagataaatgcagagggaagcttgattcaaggattgctactctgaaaacctcaataaagtgaaataaaaccccaaaaactccttcgagtttgagaccagcctgagcaataaagaaaatcctgtctctaaaaaaaaaaaaaaaaaaattagccatgcagggtagtgcatgcctgtagtcccagctactcaggaggctgaggtgggaggattgcttgagtgaccaggaggttgaggctgcagtgagccaagatggggccactccactccagcctgggcaacacagcaagaccctgtctcaaaacaaaaacaaaaaactctttcacactacagctaccttcctctctccgcagtccctttaaaagacatttttgtgcatatctttgttttctccacactccatgtggaatttatgcaggagagggatctccagaagcgaggagctaagctctggctccccctactgggtatatgatggattcattggccccaaatctcccataagactctggggctctccaatcttgtacctgcctgtgcttggaaagcctttagaaggcagggctccctaaggagagatgtgaccgtggaaggctttctagaagagttggaacctgaactacatcttgaaagattttgacatgggaagttggtaagctggtttgtaattatttcgtcatttaacaatatatcttaacaatcattgtatgtcagtacctatagctttacctctttttttttttttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaaatttttgtattttttagtagagacggggttacactgtgttagccaggatggtctcgatctcctgacctcgtgatctgcccgcctcagcctcccaaagtgctgggattacaggcgtgagccaccgcgcccagcctcattcttttttttttattattatttttatttttatttttttgagacggagtcttgctctgttacccaggctggagtgcagtggcgcgatctcggctcactgcaagctctgcctcccgggttcatgccattctcctgcctcagcctcccgagcagctgggactacaggcgcccaccaccacgcctggctaattttttgtacttttagtagagacagggtttcactgtgttagccaggatggtctcgatctcctgacctcgtgatcggcccgccttggcctcccaaagtgctgggattacaggcgtgagccaccgtgcccagcctcattctttctttttttaattatttttatttttattttttttgagacggagtcttgctctgttacccaggctggagtgcagtggcgcgatctcggctcactgcaagctccgcctcccgggttcatgccattctcctgcctcagcctcccgagtagttgggactacaggcgcccaccaccacgcctggctaattttttgtacttttagtagagacagggtttcactgtgttagctaggatggtctcaatttcctgacctcgtgatccacccgcctcggcctcccaaagtgctgggattacaggcgtgagccactgcgcccagcccttttcttttttttaaatcatccagcccaaaatgtcaaaaggacaagcttatgcttttatttatttttattttttgagacagattcttgctctgtcacccaggctggagtgcaatggtgcaatcttggctcacttgcacccttgacctcacaggctcaagtgatcctcccatctcagcctcccaaatagctgggcccacaggtgtgcaccaccatgcctggctaatcttttttttattgtttttttatttttttttagacagtctcactctgtcgcccaggctggaatgcagtagtgcgatctcagctcactgcaacctccgcctcctgggttcaagcgattctcctgcctcagcctcctaagtagctgggactacaggtgtacaccaccacactcggctaatttttgtatttttagtagaaacggggtttcgttatgttggccaggttggtctagtactcctgaccttaggtgatctgcccaccttggcctcccaaagtgctgggattataggcgtgagccactgcacctggccatgcctggctaattttttaaattttagaaatgggatctccctgtgttgcccaggctggtcttgaactcctgagctcaagtgatcctggcaccttggccttccaaagtgttgggattacagggatgagccaccatgcccagctacttcattctttcaaaagtgggctatatatgtacatttaaaaaactttttatggctaggctcagtgcctcacgcctgtaatcccagcactctgggaggccaaggcaggtggatcacctgaggtcaggagttcaagaccagcgtgaccaacatggttaaacctgatctctaataaaaatacaaaattagccgggcgtggtggcgggtgcctataatcccagctattcgggaggctgaggcaggagaattgcttgaacccgggaggtggaggttgcagtgagctgagatcgaatccattgtactccagcctgggcaacaagagcaaaactccatctcaacaacaacaacattttattattaaaaaaactccaacatttaaaaattaggctgggcacaggtgctcatgcctgtaatcccagcactttgggaggctgagacaagaggattgtttgaatataggagttccacaccagctgggaaacatggtgaaacgttcttttttttttttcttttttgagatggagtctttctgtgttgcccaggctgcagtgcagtggtgcaatctcggctcactgcaacctctgcctcctgggttccagcgattctcctgactcagcctcctgagtagctggattacaggtgtgctccaccacaacgcccagctaatatttgtatttttagtagagatggggtttcaacatgttggccaggccggttccaaactcctgacctcaagtgatctacccgccttggcctcccaaagtgctgggattataggcgtgagccaccgcgcctggccaatattatttctactaaaaattgtttaaaaaattagccaggggttggctgggcacggtggctcacacctgtaatcccggcactttgggaggccaaggtgggcggatcacgagttcaggagatcgagaccatcctggctaacacggtgaaacccccatatctactaaaaaatacaaaaaattagccaggcgtggtggcgggcacctgtagtcccagctactcgggaggctgaggcaggagaatggcgtgaacccaggaggcggagcttgcagtgaactgagatcgcgccacagcactccagcctgggcgacagagagagactctgtctcaaaaaaaaaaaaaaaaattagccagggaaggtggtgtgcgcctgtggcaggaggctggggcaggaggatggcttgggcccagaagtttgaggccacaatgaactatgattgagccactccaccccagccttggtgattgcatgagatcctgtctcaacaaaataataaaataaaatttgtgctaggcatggtgactcaggcctgtaatcccacgactttgggaggcccagccaggaggatggcttgcatccaggagtttaagaacagcctgggcaaaaagcaagaccccatgactacaaaaaaagtttcaaaaattagccagacatagcagtgcgtgcctgtagtcctacttgaaaagctgaagagggaggatcgcttgagcccagaagttccagattgaagtcagctgtgaagtgagccatgatcctgccactgcactccagcctgggtgacagagcaagagaccctgagtaaaaaaaattttttttttttgagatggagtctcgctctgtcgcccaggttggagtgcagtggtgcaatctcagctcaatgcaagctccgcctcctgggttcatgccattctcctgcctcagcctcccgaatagctgggattacaggcgcccgtcaccacgcctggctaatttttttgtatttttagtagagatagggtttcacggtgttagccaggatggtctcgatctcctcacctcatgatctgcccaccttggcctcccaaagtcctgggattacaggcgtgagccaccacacccggcccccaatttttttttttttaaataaatataggccgggcgcactggctcacacctgtaccccagcactttgggaggccgaggtgggcagatcacctaagttcagaagtttgaaccagcctggccaacatggtaaaaccccatctctactaaaaatacaaaaattagccagacgcggtggcacgcgcctataatcccagctactcgggaggctgaggcacgagaattttttttttttttttttgagacggagtcttgctctgtcgcccaggctggagtgcagtggcgtgatctcagctcactgcaacctccgcctcccaggttcatgccattctcctgcctcagcctcctgagcagctgggactacaggagcccaccaccatgcccagctacttttttgtatttttagtagagacggggggtttcaccgtgttagccaggatggtctcgatctcctgacctcgtgatccacccgcctcggcctcccaaagtgccgggattacaggcgtgagccaccacacccggccgaggcacaagaattgcttgaacttgggaggtggaggttgcagtgagccaagattgcaccacggcactccaacctgggtgacggaagtctcgaaaaaaaaataaaaaaaaattttttttaaatatatataaataaaaaagtaaaaaattagggccaggggccaggcgcgatggctcacgcctgtaatcccagcactttgggaggaggccaaggtgggcggatcacctgaagttagaggagttcaagaccagcctgaccaatatggtgaagccccgtctctactaaaaaaaaaatacaaagattagccgggcatggtggcaggcgcctgtagtcccagctacttgggaggctgagacagaagaattgcttgaaccagagaggcggaggttgcagtgagcctaaatcgtgctactgcactccagcctgagcgacaaaaaacaaacaaacaaacaaacacaaaacaataggcccaggtacagtttgggcaacagagtgagactgtgtctcaaaaaataatactaatttttcaacaccataaataccatttgataggctaagagttcctgataaagaccacagtcaccagttaaataaactgatagcctcagaacaataacatcaaagctgacatcatctgtgatgactcacgcaacctccatcatctttgagaatcctatgacatcctggctagcaactctaggtctgcccaggtgcctgcaaggcagattccatagcaaggcaagtttaggtatctcaggtcttagctagatctcttattatcttctgctatcaaaggagacccaagatagctgtacgttttcttggcttgttcaagatgagaaagcatcctaaaactctacaacctgcactttgaaaggatgtcttcgagtacaagttcaaaatgttgagataggctcggtgcagtggctcgggtctgtaattccagcactttgggaggctgaagtgggcggataacgaggtcaagagatcgagaccatcctggccagatgctggtgatatcccgtctctattaaaaatacaaaaattagctgggcatggttgcatgggcatgtagacccagctactcgggaggctcaggcaggagaatcgcttgaacccgggaggcagaggttggggtgagccgagattgcgccactgcactccagcctgatgagagtgagactctgtttagaaaaaaaagaaaaaaaatggccaggcgccttggctgacgcctgtaatcccagcactttggagaccgagacaggcggatcatgaggtcaggagttcgagaccagcctggccaatatggtgaaaccctgtctctattaaaaatacaaaaattaggccgggcacggtggctcacgcctgtaatcccagcactctgggaggacaaggcaggcaggaggatcatctgagctcaagagtttgagagatcagccttggcaacatggcgaaaccctgtctctgtttaaaaaaaaaaaaaacattaaggccgggtgtggtggctcacgcctgtaatcccagcactttgagaggctgaggtgggcagatcatgaggtcaagagattgagaccatcctggccagacgctggtgaaatcccgtctctactaaaaatacaagaattagctgggcatggtggcacgggcatagagactcagctactcgggaggctgagggatgagaatcgcttgaacccgggaggcagaggttggactgagccaagatcgcgccactgcactccagcctgacgagagtgagactctgtttagaaaaaaaagaaaaaaaatggccaggcgccttggctgacgcctgtaatcctagcactttggaggccgaggcaggcggatcatgaggtcaggagttcgagaccagtctggccaatatggtgaaaccccgtctctattaaaaatacaaaaattagccgggcgcggtggctcacgcctgtaatcccagcactttgggaggctgaggtgggtggatcacctgaggttgggagttcgagaccagcctgaccaacatggagaaactccatctctactgaaagtacaaaaattagctgggcatggtggcgcatgtttgtaatcccagctactcaggaggctgaggtaggagaatcgcttgaacctgggaggtggaggttgcagtgagccaagattgcgccattgcactccagcctaggcaacaagagcgaaactctgtctcaaaaaaaaaaaaaaaagaaattagccagatgtggtggcaggcgcctgtagtcccagctacttgggaggctgaggcaggagaattgcttgaaccgaggaggcggaggttgcagtgagctgagatcatgccattgcactccattccgggtggcagagcaggactctgtctcaaaaaaaaaaaaaaaaaagaaaaagaaaaaaatacaaaattagctgggcatggtggcacacgcctgtaatcccagctacttggtaggctgaggcaggagaattgcttgaacctgggcggtggaggttgcagcgagccaagatcatgccattgcattccagccttgtgacagcctgagactccgtctcaagaaaaaacaaacagaaaatcaaacaaacaaaaaaacaacattgaccaggcgcggtggttcaagtctgtaatcccagcactttttgggagaccaaggcaggcggactgcttgaggtcaggagtttgagaccagcctgggcaacatggcaaaacccctcctctactaaaaatacaaagattagccaggtgtggtggtgtgtgcctgtaatcccagctattcagaggaggctgaggcacaagaatcacttgaatccaggaggcacaagctgcagtgagctgagattgcaccactgcactccagcctgggtgacaaagccaggctctgctttaaaaaaaaaaaaaaaaaaaaagggccgggtgtggtggctcacgcctgtaatctcagcacattgggaggccaatgtggtggatcaggagtttgagaccagcctggccaacatggtgaaaccctgtctctacttaaaatacaaacattagccacgtgtggtggtgggcgcctgtaatcctagctacttgggagactgaggcaggagaatcacttgaacctgggaggcggaggttgcagtgagctgagaacgcaccattgcactctggcctgggtgtgaagagcaaaactctgtctcaaaaaaaaaaaaaaaagttgagatagtttgaaataggtaggaaaaagcaaccagtggtatgcagatttgatgatcacttcctccagtatcaattcagtcatggttctgagctttactttttgcttttttaagtcttagcactaatattacagtttatctgtgtattattgtaagagaaaatattttcctttgatctagtgtgattttacaaaaattggtatctaaaaattcctcagaatacttctaaattaccacaaacttggtgggttgttttttgttgttttttttgagacggagccttgctctgtcgcctaggctggagtgcagtggcacgatctcagctcactgcaacctccatctctcaggttcaagcaattctcctgcctcagcctcccgagtagttgggactataggtgcatgccactacgcccggccaattttttgtatttttagtagagacggggtttcaccatattggtcaggctggtctcgaactcctgagctcaggcgatccacccgcctcagcctcccagagtgctgggattagaggcatgagccactgtgcccagcctaacttggtgggttttaaaacaacagagtcattctctcatagttttggagtccagaactctgaaaacaagacgccaatctcatgcaatgctctttctcgaggcccaaggggagaattttttttttgagacggagtctcactctgttgcccaggctggagtgcaatggtgtggtctcggctttctgcaacctctgcctcctgggttcaagcgattctcttgcctcagcttcctgagtagctgagattataggagcacaccaccacgcccggctaatttttgtattttttggtagaggtggggtttcgccatgttggccaggctggtctcaaactcctgacctcagatgatctgcccacctcggcctcccaaagtgctgggattacaggtgtgagcagccacgcctagcctattattattttttgagacagggtcttgctctgtcacccaggttggagtgcagtggcgcaatcatagttcacagcagcctcaaactcctgggctcaaacagtcttcctgtgcaccatcatgcctggctaagttttcaattttgtgtagagaccaggtcttgctatattgcccaggctgatcttgagctcctagtatcatgcaatctttctgccttggcctcccaaagtgctgggattacaggcatgagccactgcgcctggccagtttctttctttttttttttttttttgagacagggtcctgctctgttgcccaggctggagtgcagtggcacaatcctggcgcgctgcagccttaaactcctgggctcacgtgatcttcctgtctctgcctcccaagtacctgggactataggtgggcatcaccatgcaaggctaattaattatgtgtagaaatggggtctcactatgttggccagattggtctcaaattcctggcttcaggcaatccaccccagcctcccaaagtgttgggattacaggtgtaagccactgcacccagctcagtttattttaaggtatgagttgatcatctgttttcttcctgtccatagcgctagcaatgttaattatagctctgaatacaccttacagcttaacaagaagcatagtaaacatgtgactatgagcacttttttttttcgagacggagtctctctctgttgccaggctgaagtgcagtggcgtgatctcgactcactgcaacctctaactcctgggttcaagcgattctcctgcctcagcctccagagtagctgggattacaggcacgagccaccacacccagctaattttttgtatttttagtagagacagggtttcaccatgttggccaggatggtctcgatcttctgacctcgtgatctgcctgcctcggcttcctaaagtgccaggattataggtgtgagccactgcacacggcctgagtactgttaaatagtattattatgccttaaaaatcctgacttcggcagttccacactaatcaagaagagtgttcagatgtgaggcccaacccagggggattctgatagaggatagtccacacctctcttggagagtggaatcataaaagagctcacaactccatctccatcttgagttcagttcacacctttctctccagtggtagtattcctatgtctcacatttctttcattggattcttctttggaggagctaagggcagaaccaagctaagaaacctgagcaatttattgtcttcatcactggtttcagaattagcagcctatgtttccatcctcccaaacatttcagttatctcagcacactagcgtgaagaaagatatgaatgaactagcatgaagcaaataacactgagtgattccttctcctgtccaccccccactcctcattgttgtcttctagataccagcaactgaaaagcagaacaaaaacacttggatcgtaggctaactcctaaaagattgatccctggtgctgatacaggtatggacatcctgacttgctatttctgggtatctgcacgaggaatggcagctggatcagagtggcctggactgcgggcagtctttagttttattaggaacacagggccagatcaataatcaattagagttggcaggggaccagggacttggagcataaacaagtcatgaagggctaagaattcagttcagctacaaagcctcctgtagaaggacccaaaggatgaggagccagcagactatttggaataaggcatgtggcatgcggcctgagacagaacaagaagtgcctgagagagaacaagaagttctttcacagaagggagtagggactgctggctaaaaagggaccccataaagcccacaaagcccttctgtgatacatgctttgctggaaagtctggctggaaagtgggagcaaggccaagattccatggaggccagaggcctagaccaagtcaaccccacattccctaagtcacctttctttgtgagcatgttctatggaacaagtcccatagtaaaataccaaaaacctaagagttcagttgcacatgtgtacctttttccttttataaatattcatgactcctcctatagcttattaaatacatatattcagccaccttgttcaacataaattcctgtcccctttgcccctccctcagtttgtgtttctgacttctggccagaggctgtacttcccagactgtcagaatggccaccctgcagactgcaaccctttgagaaataaagctctcctttccaatttttaaaaataaaaaaacctgatggtaaaggaatgaagctgcttttgttctaatctgcatttcccaaaaatgatttgacaatatattttgtttggagatggagtctcactctgttgcccaggctggagtgtagtggcacaatctcggctcactgcaacctctgcctcccaggtacaagcaattctcctgcctcagcctcccaatagctgggattacaggcacccgccaacacgcccagctaatttttgtatttttggtagagatggggtttcaccatgttggctgggctggtctcaaactcctgacctcaggtgatccacccacctgggcctcccaaagtgctgggattacaggtgtgagccactgcacccggctgacaatgaagattttacaaataccttctaaattcattttgggaaaggctagtttcagccctttccaaatgtaactcgtctcctctggggagccctctcaaattgctttaacttactcatctccccttcctgtcttgcagcctttgatcatataggaacccatgtgtcatgttctgaaccagtcagtctctaaggcaggtgcatagagcagctgtgtccagcttgccctggaaagaacaagtaccatgtggcagaagaatagggacggccttgccaggctctgcggcctagccctggtgggtttcccagagatgactgtgtgaggaagggtggtatgatttggcagtttctctcagctacagctccaaataggctctagaagagcatcactcactgtggtcactgtgtcttccccttacaaagggcagtgaaggtctatggttccaactacaaaaaacaaaaattaatatcctattcccagagtactatgcaagcactttcagcgtcattctcagggcaccatccaagcagacagggcctattaccaacccttacttatgtaacagaagtaacgtcacactacttcagtaccctgggcatatccaccctcagctggacctcagagcaactcatcttgggctagagttggggacccagagcaagcaggtcttagtatttgtgcctgcacttgacctgcctctaacctggaggtaatggcttgtgttccccttctgccacaagcaatcccaacagctcaagccaaccttccaactagtcatgtggggcctttttggcaggctcctggctacacaatactcactcacaccattgtgcactggaataatttttatttttttccttggcaaaaagtcaagtgctacatttttaaaaacagaaaatctcaaacaatcaaacgcattacccattacagaagagggtctagcaatagtacaaaacatcctactgaagattttttttttaaatatacaagtcagtttaaaatgatagaagttctgtgagaactaagaaatctacagcctgtagtttaataatagaaaaaaaattaagacaattaaaagatctatagcatccagcattttgcttaattccctgtttatagcacctatttctctaggttcgaagatgagaattccagaacctgtggtatgtgctgtgtaacaagttagggtggacttgctgtctctcctctccagtagccccccaccattaaaaggagaatatatatataattttttttccaatttcccttcttacacccagagaagagggggacaactgggagaacaagttaaaaaactggggtgcaggaataaatatgacttttcctttccccaaaatgggatgttgacagaaaagcagagtatgtgcttagaggaactggtgggtgggaacagctgttatctttgacatgatgtgtaaaaatcagggaacaagtggacatcacagtcagctgcctgcaagtttaaaaacctcagactaaacagacagttcaagggaggaacagacaaattactaatcacattgatgctgtcacatgcacaatgatgctgactgcaggccagcctgtcaccatctcagggctaagccaacagagtaggaggggtggcttcaaccccaagtcccactgcagtaagaaaatgaatattccacacatgaagcactcactacacacagataaaccccctgctcacccccaccttcttagacttaacccaatttagaaaataatagcaaaacccactggggagattggaagaatggcagagaggattctcctcaaagccatgggggctatggatgtgaatcttagcagacttgagactcccagctccaggccccttaaaaccagatcaggtcttgaggggaaggagagagaagctaggatggggattcaagtcccatgaagccttttgtagcctctggagctgcacctggatggtgagtctgatgttttaggggtgtggctactggctaagcagatgtgagggtgggaaggggaagtgacaccaacttcccacacgggggacacacaggtgggaagacaggtagggctggatcactttgcagtcctggcatgggaggccccaggaagcctacaatctaactaaaaagattttcccagtggtaatttcttttcctttctgtttttacttcctattatcagtgttgttagacttaaaaaacaagatacagactagtcccaaagctggactctgtgaataaagttgtttcttttataaatattttaattacaagtaatcctcactccaggtaatttcagtgacacacagtacctacaggcacacaagatcacacacacacacgcagacaagatctctctctcacacacacacagacacacacagctcccaaactttcacagaaagtctgagagcaaccatgtaattataaaggagccctacctctcaagagtgaagtaagggtgagctatgtcatttcagcctgaagaagccagagacaggagaatgtgtgtcacttaaagaaaaatagggattagcaacaatgtttggttgaaaagccagaaataataaaagatagtaaaattttgattaccaaaggggaaaacaaaaagcaaaacaactttcagatttctgtacagagcttcttcctattaagtgcctaaactataggcaaactttggtgttcccactaaaacacaagagcctcacacaattaggaaaaaaaaaatcaaaagaaacaaggaaactgagaatggaagttagtgtaaatctctgcatttggggagttgtcattaactccagagcccagcatagtttccatggagccctgaagggaggggacctcctgccacaaagagtttcgttccagacgagtcgtagcagtgggtgtaaacagcattggggaagaagtcaatgtctgaaaagtaattcctccaggtttcatcatgattctacgggaagagaaagagactacaattagcacctctagccatggggcaggaaaagggggaggaagggacaggaatgctttctggtctccttaagggaacagggttctacaggtacaacctcatgtcaggagattggctggttggttctcatgggaatcagggcctcatttttccaactaaacgttagagaagaacggagcagctgaagaattgctatacaaggctcagttcttctcaggagacttagaaccaaagttctgttttccctccacctgctaggcacaggaggaagaaccaaacacttgaataattcactggaggtggggcgcagtggttcatggctgtaatcccagaattttaggaggccaaggtgagagaatcacttgagcccaggagtttgagaccagcctgggcaacatggcgagaccccatctctactaaaaaaaaataaattagccgggcacagtgcatatgcctgtggtcccagctacttgggaggctgaggcaggaggactgcttgagcccaggagttcaaggctacatacagtaagctatgatcacaccactacactccagcctgggcaacagagtgaccctgtctcaaaaaaaaaaaaaaaaaaaaaattcactgacagctgtggtgggaggtcccttatccttcttgctctattacaccttggggaaaatcctaagtcaaccagtgtgttttactgggcctcagttttcccacaggcaacgtgcagacataaaagcaaaatcgggggaagtcttttcctgttccaatgagtgcctcttactagtgaaaaagtatgagtagatggtgtgtcagtgggggctgagagatagaggaagataatttttctgttactgtgtagcagtcatctcaggtaggggcttacgcaccagccagcctttgccagtggttagtttcagattctcccctgctagtctgggcttggacccataacaagctgagagcctctcttccagaaatctctgagctcggatgtcatagaacagcagggagccctgccctgttcccacagtgatgatgtgctcgtagaaactcactgaccggattcctgaaagacagaaaagtaaaaggcagtgaggcgggagagaatatttgctgactgtctgctagcctgaatttctccaacactgagttttcaacgtccaccctgctcccctccacccgccccacaaagtatcagacagtgttttcccaatggcaagttagctcatgcaaaagcaaagagaatcctgatgccatcctgcctatccacacactgacagaaaccatccaagaagccttggaaaagtgtcagattcccgatgatgctcaagatgcttttggccgaagaccataagtgctgagaacttccttgcttcctctcaactcactctgggatcatctttcataactctaagcttttctccatcatatgtttccaacctacactgcaactcaaggtaatctgcatatttataaatcattaagtcatcaacgattccttatatttcacctaaaaccactactgtggcaaatgcaagaagtctttttttattttttgagatggagtctcgctctgtcgcccaggctggagtgcaatggcgcgatcttggctcgctgcaacctctgccttccgggttcaagcgattctcctgccttagcctcccaagtagctgggattacaggctcctgccatcacactcagctaattcttgcattttcaggagagacagggtttcaccatgttggccaggctggtcttgaactcctgacctcaagtgatccaccttggcctcccaaagtgctgggattataggcatgagccactgtgcccggccacaatgcaagaagtctttatctagtattaggtgttttgagagtggcaaaaagcccagaacttaaatacccaaagatgtttaagacaagtcatgtaattactttagatcacaaggaaaacacatctgctgtacttggggatcaaatcagtgcttgggatatgaagatgtctcttggcacataagaactggataatatttgtggaaccagtatttccttattaggtatgaaagttacccccattaaacagtaccaaaaatctcttaaaacttttcattgcatacattattagagccaaacctatttagtcttttctctttttttttgagctctgttgccaaagctggagtactgtggcacaatcttggctcactgcaacctccacctcccagattcaagtgattctcctgcctcagcctcccaagtagctggaactacaggcacccgctaccacccccagctaattttgtttgtatttttagtagagacagggtttcaccatgttgatcaggctggtctcgaactcctgacctcaggtgatccacctgcctcaggctcccaaagtgctgggattacaggcatcagccaccgtgcccggccctatttattcctttctctactactctcattatacattattctttgttctaaaatgtaagcattttaactataattaagaacaaataggccaggcgtggtggctcaagcctgtaatcccagtactttgggaggcccaaggtgagtggatcacttgaggtcaggagttcaaaaccagtctggccaacatggtgaaactccatctctactaaaaacacaaaaattagctgggcatggtggtacgcgcctgtagtcccagctactcaggaggctaaggcaggagaatcgcttgaacctgggaggcagagggtgcagtgagctgagatcacaccactccactccagcctaggtgacagagcaagactcatctcaacaacaacaacaacaaaaaagaaatagctgggcacagtggctcacggctgtaatccctgtaatcttagcacacactttgggaggctgaggtgggtgtcccaagagtttgagacaactctgggcaacatgatgagaacctgtctctacaaaaatacaaaaattagctgaatgaggtggcggacgcttatagtcccagctactcgggaggctgaggtgggaggactgcttgagcctggcaggtggaaaagctgcagtgaactgagattgcaccactttcctccagcctggctgatagagtgaggaccctgtcttcaaaaaaaaaaaaaaaaaaaaaaccacaaaaaacccaaaacaaaagctactttgcagtatctgcacaggaataaacactacttgaaaaagagagggtgaactgcaatccacagtgtgccttttaggactctcaggataacacagccatatttttgcatgagaaatgggataaagcgagaaatgggataaagtgagataaagaaaatacaatttgttaagttggattctggtccctagctgttcccccatcaagctgtgtgatgctgggcaagttatttagctggctctaggtcttatatgtaaaactatgttttctcatctgcttcccacagggttcttggtatgatgaaatggcatgtcagaaaaaggtattttgaaaccttcaaagtacactaaaataagtattttttccctcttcaataaagaatgagggtgctcttacagagaatatgttataaaagatttgaggtggaagcttaatttactcagtggtcagaactaaactcagtattttcttcagccttattgaggtttgtcatacaatatacgacacataaagtatacaatttgaggttctgacatatgtatatatccatgacatcataaccacaatctacataatgaacatactcattaccctgaggtttcctcatgccctttgtaaacttcctccttatcccaccatgccacatcttagcataaatagaattttagttcaggcaggaccacagcaaaaaaattaccacaggatagaaagtagggctctcggccaggtgcagtggctcacgcctgtaatctcagcactttggaaggccgaggtgggtggatcacaaggtcaagagatcaaggccatcctggccaacatggtgaaaccccgtctctactaaaaatacaaaaattagctgggcgtggtggtgtgtgcctgtagtcccacctactcgcgaggctgaggcaggagaatcacttgaactcagaaggcagaggttgcagtgagctgagatcacgccactacactccagcctggcaaaagagcgagactctgtctcaaaaaaaaaaaacaacaacaacaaaaaaaaagtagagctttctaaaagaacatggaaactactaactaatatcctgactggtggctcccaacaaaggcttctgtggccacacatttgtctgtggtgtttgaaagtctagtgcccttttgtgtcactccccccacacccctttttttttgagacagaatttcgcgctcattgcccaggctggagtgcaatggtgcgatctcagctcaccgcaacctccgcctcccaggttcaagcaattctcctgcctcagcctcctgagcagctgggattacaggcatgcgccactgcgcccggctaattttgtatttttagtagagacggggtttctccatatttattggtcaggctgatctcaaactcccgacctcaggtgatccacccgcctcggcctcccaaagtgctgggattacaggcgtaagccaccacgcctagccatcgctcccctttttgaacacacttccaaatgttccatacagagcactatacctgtttggaaaccaacaaagaaactgaaagtcagaacccatatgcagtgcagctgtaggcctgaggtgcacacagggactcttaccactgcctcgctccctggaacagacagacttgacgttgtatgatggctgccgtggatccaagaaggagacatgagcttgggagcccactgcataaactgaccattcactaccataagccagacacacattctcacggcaatatggcagtttggtggagaggagctgaaaatagaggagagatataaccatggcatcagcagagagggtaaggcagggatattgtttctggactcccaccttgatgggcttccctcatataaaagccacataaaatcaagccctgattacagaaataacactctgttccacccctaggtatacaggagaaagaggaggtgaatgttaataaacggtaagacctagatactgaaggagataggttggggaaaaggtaaatctggaataaataatcagaagtagctggaaaggccaaggcctttcttggtaggctgtttcaactattcaggttgtttctgggaatcgttccagggcactaaagccatagtcccactctgttctgtctgccaggaagggccacctcagtgcttttcagataaagaggctgatctctggctacccccagctcaccttcccacctgaatgggaattgtacgctatagaaagcacgcccatgggactagcttaatcccagataacccacatcagccttaaccctgggtcttcgtcagttagcaaatcctcagtgggtgcatacaacacataagacagcatacaaggtcagtggagctcaaaggctattgtgacatgaaggaatcactaattcctggaaccctgcttcctcttgcaaagtcctcaaggataagaagaagagaaaaagctgggcgtggtggctaacgtctgtaatcccagcactttgggaggctaaggcaggcagatcacctgaggtcaggagtttgagaccaggctggccaacctggtgagatgccatctctactaaaaataccaaaaattagctaggggtagtggtgcatgcctgtaatcccagctactcaggaggctgaggaaggagaatcacttgaacctgggaggcggaggttgcagtgagctgagatcgtgccactgcattctagcctgggcaacaaagtgagactctgtctcaaaaaaaataaaaaaaagacaaatgattcacaggtaggtttaactctatgtaaaagttgcttgttgaatctcccttatccaaaaggcttgtgactacaaatgttttgaatttcggatttctccagctttttttttttttttttgagacggagtctcgcactgtcgcccaggctggagtacagtggcgcgatctcagctcactgcaagctccacctcctgggttcacaccattctcctgcctcagcttcccgggtagctgggactacaagcgcccaccaccacgcccggctaattttttgtatttttagtagagacggggtttcaccatgttagccaggatggtctcaatctcctgaccttgcgatccgcccaccttggcctcccaaagtgctgggattataggcgtgagccaccgcacccggccccgatttttaaatatctacatatatgtaaggagctatcttggggatggcacccaagtctaaccacaaaattcatttatgtttcatatacatcttatacacatagagtgaaggtaattttatgcaatattttaaataattttctgcattaaacaatgtttggtacactgacctgtcagaaagcaaaggtgtcccatgtgaaattttccatttgtggcattgtgttggtgctcaaaaagttttggactttggaggcttttttttttgagagagagtcttgctctgttgccaggctggagtgcagtggcatgatctcggctcactgcaacctctgcctcctgggttcaagcgattctcctgcctcagcctcccaagtatctgggactacagacgcccaccaccacgcccagctaatttttgtatttttagtagagacggggtttcgccatgttggccagcatggtctcaatctcttgacctcatgatccacctgcctcggcctcccaaagtgctgggattataggcgtgaaccaccgcgccaggccttttttttttttttttttttttttttgagatagggtctcgctctgtcacccaggctggagtgcagtggcaaaattacggctcactgcagccttgacctcctcagctcaagtggtcctcctgcctcagcactgctaccctccagtagctgggactacaggcatatgccacaatgtatggctaatttttaaattttgttgcagagatagggtcttactgtgttgcccaggctagttttgaactcctgggctcaagcaatcctcctgcttcaacctcccaaagtgttgggattacaggcctaaggtattgtgcccaactggattttggagcattctggattagggatgaccaatttgtattgtaaattaagtctattttctcattaccttacatgattatttcagagatggtttatcttaatttgatcgatcttcaattgccaaaggttcctaacactcaggatttccttcccttacagcatgccaagtagtcatcaatctataaagaaatacttaaatgcattgttgaggaggactgctagtcaaaggagcctctcaggaagcttatgcaataggaaagaatcaccctgtcttactctttaaaagactttcctgcaagagaggcacaccagactcaaaatttcatgtactgtgcaaaaacatgcccaggcctttggagaactggtcttttaaacaagaattgagaccaggtgcaatggttcatgcctgaatgcccagcacttcgggagaccaaggtgggaggatcgcttgaggtcaggagttcaaaaccagcctgggaaacatagtgagactctgtctctacaaaaaattaaaaaaacaaaacaaaacaaaaaaaacaaccagatgggtgtggtgacacatgcccatagtctcagctacttgggaggctgaggcaagaggatcgcttatgcccaggagttcaaggctgcactgatccatgagccatgactgcactccaacttgggtgacagagtgagaccctgtatttattgtctttaaaaataaaaataccaacctggccaacatggtgagactgtgttcctactaaaaatacaaaaaaaatacctgggcatgttggcagacgcctgtaatccccgcagctactcaggtggctgaggcacaagaactggttgaacccaggaggcagaggttgcagtgagccaagattgcaccactgcactccagcctgggcatcagagcgagactctgcctcaaaaataaatgaatagataaaataaacatgaaaaaaaagctcagctagaattacagtattttaactgtaaggtgaattattaggtaaaaccacaaaatcatgttcatcacaccttagatagtgtattttcagccttccagagatgaaagtagccatccagagacactgctcccagttcctacaagagcaatgaaaaccaggttatattatcatctatagcaactaatgtacgataataagcaggcgaggattctaaggtcagggtcctttattcctgtctcgtgatgattccagcagaggtgccagtaattattagaccattacttcaccctacagaacctagctgaatggcatattaaattgaggctgccagcaataacacaggcacccatggttgaaaaactcctcactatgctatcactccctcaacgtcctgttggagagttaaagcagggcacatatgtgaaggacagtttcataatctagtgtgagaatttctataagtgaagactctaatttaggagagattaatctacccttaggccataaatacagatgggataggaggttgagggaactacccttcaaactgtggcctgattcagattctggagaagcctttctctggctctgggtgtatattctgacactgctttttttttttttttttttttttgagatggagtcttgctctgtcacccaggctggagtgctgtggcgcaatttcggctcactgccaacctccacctcctatagttttcctgcctcagcctcctgagtagctgggaatacaggcatatgccaccatgcctggctaatttttttgtattttcagtaaacatggggttttaccatgttggcccaggctagtctcaaactcctgaccttgtgatctgcctgcctcggcctccgaaagtgcagggattacaggcgtgagtcactgcgcctgggtgacactctgctttattaaaacctcagcatcagatctgactcaataaggtaagacttagtggaaatgtgaagggaaagtaggcagtaaagaatactggccaggcatggtggctcacgcctgtaatcccagaactttgggaggccaaggagagtggatcaactgaggtcaggagttcaagaccagcctggccaacatggtgaaaccccgtctctactaaaaaatacaaaattagccatgtgtagcggtgcatgcctgtagtcccagctacttgagaatctgaggcagaagaattgcttgaacctggaaggtggaggttgctttgagctgagatcgtgccattgcactcctgcctaggtgacaggagcaaaacacagtctcaaaaagaaaaaaaaaaaaaaaggaatgaataccaaagagaaaaaaagtgattgttttcagaagcaagtatgaaaatcatgcccagaatacagcacctgcaaaggcatgtgcaaatgacagacagtcaaatcagggtggccctaggggaattctgtgaggctgacccacaaatatagactactcagagaaatactgcagacaccaattgaaggggtgggtttcagagcctcagttataatttctcaccagcatcactcagcctttaagaggtgttctgtgggctcagaaccatgctatgtagcaagcactgatggggaaggaaaaaggagtgcatatcccaagacataagcaagaggaatacacgtcagggatccctacacaagttcataccttgttcttgttgttgaaggccagagcccgaaccttgcagttgtcagggtttgtgtcttctttggggatgtcctttaaggccttgtgagtgatgtgtgcatacacagggacccgtgacacattgtgtctcgcatcacttttggtcaaaacatcatctgtcacctcccagagtcccatagaaccatcacgtgagcctgcagggccaggagaacacagatgtcagatgtacccacccctctatgggaaatcccacagacgccaaagagggctttcatagtctagctgtttgtgcatcatcctcatatgtgctgaagcttggccagatggcccaccctaaacacagagcagtaggcattttaatagctacactaagagaattattcacctaaggtctaggcattaaaatataacttttaagtttgacatggttgttgaaatttatttattattattatttttttttgagacagagtctcgctttgtcacccaggctggagtgcagtggtgcgatctcagctcactgcaacctccatctcctgggttcaagcgattcccgtgcctcaccctcccaagtagctgggattacaggtgcctgctccatgcctggctattttttttgtatttttagtagagacggggttttaccatgttgcccaagctggtcttgaactcctgagttccagcgatcagcctgccttggcctcccaaagtgctaggattacaggtgtgagccaccacacctggtctgctttttttttttttgagacagagtctcgctctatcacccaggctggagtgcagtggcacgatcttggctcactgcaacctcggcctcctgggttctagcgattctcctgcctcagcctcccaagtagctgagatcacaggcgcatgctaccatgccctgctaattctttttatttttatttttgagatggagtcttgctgtgatgcctaggctggagtgcaatggcgcaatcttggctcactgcaacctccgcctcccaggttcaagcgattctcctgccccagcctgtagctgggactacaggcgcgtgccaccacgcccagttaatttttgtatttttagtagagattgggtttcaccatattggccaggctggcctcgaactcctgacctcaagtgatccacctgcctcagcctctcaacgttctgggattacaggcatgagccaccgcgccttactcgaaattctttaacgagaattttatacattttgataaagctaattttcttttttatttttcttttttttccctttttttggagatgaagtctctctgtgttacccaggctggagtgcaatggcatgatctcggctcactgcaaccaccacctcccgggttcaagcgattctcctgcctcagcctcccgagcagttgggactacaggcacacgtcaccatgcccggctaatttttgtatttttagtagagacggcgtttcaccatgttggccaggctggtgtcgaactcctgacctcatgatccacccgcctcaacctcccaaagtgctgggattacaggcataagccagtgcacctggccaaagcttagtaattttctatgccaaatgtttaggtctcttggcatgcatccacagctgacttttagtgggcagtagggcttgggaatcctcccctctagagcagtggtacttaaccttttttgagccttggacccccttatgtctctctttttttagagacagggtctcactttggggcccagggtagacagggcaatagtggcacaatcatagctcactgcaggctcaacttcctgggcctaagtgatcctcctgcctcagcctcctgagtagctaatacaacaggtatgcacccccatgactggcttttttttttttttttttgagatggagtctcacactgtcgcccaggctggagtgcagtggtgcgatcttggctcactgcaagctccgcctcctgggttcacgccattctcctgcctcagcctcctgagtagctgggactacagaggcccgtcaccacgcctggctaattttttgtatttttagtagagacggggtttcactgtgttagccaggatggtcttgatctcctgacctcgtgatccacctgcctcggcctcccaaagtgctgggattacaggagtgagacaccacgcccagcttctttttttttttttaatacaaggcctcactctgttgcccaggctggagtggagtggtgcaatctcagctcatcccaacctccacctcctgagcacaagtgatcctctcacctcagcctcctgagtagctgtgactacaggcacaccctaccacacctggctaatttttgcatttttttttttttatagacagggttttgtcatattgcccagcattgtcttaaacacctgggctcaagtgatccagctgcctcatcctgtcaaagtgctgggattacaggtatgagccaccaagcctagccttatttttttaattttttttgtagagatggagtctcgatttgttgccaaggctagtcttgaacccctggcctcaagtgatcctcatacctcagcctctcaaagtgctaggattaaaggcatgagccaccatacccagactaggcctctttttctagaaaattacacaaaacaccacattttacattcaatttcagggagacccatggatttcctgaaatccatgggctttccatgaacccacagggaccacaaaccctccccaactttttttttttttttttttttaaatgagacaggttctggctctgtcacccaagctggagtgcaataacatgattatggctcattgtagcctcaacctcctgggcttcagcaattctcctgccccagcctcccaagtagctgggtctacaggcatgtatcctcatgcccaggtaattttttattttcatttttttgtagaaatggggtctcactatgttacccaggctggtcttggactcctgacctcaaactcctgcttcagtctctcgaaatactgggactacaagtgtaagccactgtgcccggccataattcctttattatttatttatttattttggtggtgggacagagtttcactcttattgcccaggctagaatgcaatggcacgatcttggctcaccgcaacctctgcttactgggttcaagtgattctcctacctcagccttccgagtagctgggattacaggcatgtgccaccatgcccggctaattttgtatttttagtagagacggggtttctctatgttgttcaggctggtcttgaactcctgacctcaggtgatccaccctcctcagcctcccaaagtgcaaggattacaggcatgagccactgtgcccggcccacaatccttctattaagaatgactgttctagaccgttctttattaagaattactgctcacacctgtaatcccagcaacttgggaggctgaggtaggtggaccgcctgagctcaagagtttgagaccagcctgagcaacatggcgaaaccccatctctaccaaaaatacaaaaaattagccaggcgtggtggggcacgcctgtggtcccagctactcaggaggctgagctgggaggatagcttgagcctgggaagtagaagttgcagtgagctgaaattgtgccacagactccaacctgggtgacagagtgagaccctgtcgcaaaaaaaaaaaaaagataataatgacgactattctaggctgggtacagtggtatatgcctttaatcccagcactctgggagaccgggtaacatggcaaaaccctgtctctacaaaaaatacaaaattagccaggcatggtggcgcaaacctgtggtaccagctacccgggaggctgaggtgggagggtcactggagcctggagaggtcaagggtgcagtgagctgggatcacaccaacagtctgggcaacagagtaagaccctgcctccaaaaaaaaaaagaataatgactgttttatataaaatgaatgcttaaaaagataaatcagttttcttagcaaacaataataaagcacttaaaaacccaggccgggcacggtggctcacgcctgtaaccccagaactttgggaggctgaggcaggcagataacgaggtcaggagtttgagaccgacctgaccaacatggtgaaaccctgtctctactaaaaatacaaaaattagtagggcgtgtgcctgtaatcccagatacttaggaggctgaggcaggagaattgcttgaacccaggagacggaggttgcagtgagccgagatcacaccactgcactccagcctggatgacagagactccatctcaaaacaaacacacaaacaaacaacaacaaaaaacaagaacacttttctgtgaattgagccctgaatatactgttggtggcaagctaaaatggtatctttctagaggacaactgagcaacctgcagcaaggaaatgttatattcctggctgggcgcagtggctcacgactgtaatcgcaacactttgggaggcttaggcaggcaggtcgcttgaggccaggacgttgagaccagcctgggcaaaatgttgaaacaccatcagtacaaaaaaatacaaaaaactagccaggcatggtggcacatgcctgtagtcccagctactcagggacaggggtggggtgctgagacaggaggattgtttgagactgggaggtcaaggctgcagtgagccatgatcacatcacgccactgcattccatcctgggtgacagggcgagaccttaactccaaaaaaaaaaaaaaaaaaaaaaaagagaaacaacagctgggcgcagtggctcatgcctgtaatcccggcactttaggaggccgaggcaggtggatcacgaggtcaggagttcaagaccaacctggccaacatgttgtaagccatctctactaaaaagacaaaccagcccggcgtggtggcacgcgcctgtagtcccagctactcagaaggctgaggcaggagaatcgcttgaacctgggaggcggaggttgcagtgagctaagacatggccactgcactccagctgggcgacagaggaggactccatctcaaaaaaaaaaaagaaacaaaaataaaaagtaagtttatattcccattcagaaacaatccactatcacaatacccatacacaaagttgtttattcggaacactcagtatgttcaacaatagggttatattatatccataaaacagagtatcaagaaattatgttttaggccgggcatagtggctcatgcctgtaatcccagcacttcgagaggctcaagtgggaggatcgcttgagcctaggagtttgacagcagcctgggcaacaaagcgagacccagtctctataaaaaatagaaataattaaccgggtgtggtggtgtgtgcctgtagtcccagctacttgaggggatctcttaatcctgggagttcgaggttgcagtgagcaataatcacacgctgcactccagcctacataacagagtgagaccctgtctcaacaacaacaacagtaacaacaacaacgaaaatgtgttttaaaattctttttccagtaaacttatttgccagttctcctttgagaccaagaaggtgcccttcccacactgctaatctcctgaacacttcatagaaaaaaacatctaggccaggcgcagtggctcacgcctgaaattccagcactttgggaggccgatgcaggcagatcacttgaagtcaggagtttgagaccagcctggccaacatggtgaaaccctgtctctaccaaaaatacaaaaattaggcacagtggcacgcacctgtagtcccagctacttgggaggccgaggcaagagaagtgtttgaacctgggaggctgaggttgcagtgagccaagatgcactccagcctgggcgacagagcgagactctgtctcaaaaattaaaaaaaaagaaaaaaacatctaaaatgacagacacatcaattcaaagtagaatgttaattatgtgaaattagaaaaggccacagagacaagggcacatctggagaactagacatggtttgttaatgctggattatggggtgcaagcatggaagctatgagagagaaagttggaaagataggtgtgggccttgtatgctgtgctataaaatttgtttctcatcttacagatactagaaagtctctcaaagatttgagcatcagagtgagaaaattagataactgtgtttcagaagattactttgtgtacagtgtgacctcatttaccccatcaaagttttattatgaaaattttaaagtgtaaaaaaatgaggccaggtgcagtggctcatgcctgtaatcccagcattttaggaggccgaggcaggtggatcaactgaggtcctgcattcaagaccagcctggccaacatggcaaaaccccatctctactaaaaaatacaaaaattagccaggcgtggtggtgggcacctgtaatcccagctactcaggaggctgaggcagggagaagtgcttgaacccaggaggcggaggttgcagtgagccaagattgcaccattgcactttagcctgggcaacacagcaagactccgtctccaaaaaaaaaaaagaaagaatttcacaaagaattctatatatgcatcttctaaatgatctcatattaaccaactaaaaaatatgggccaattttgggaggccgaggcaggcgaatcactgaggtcaggagtttgagaccagcctggccaatatggtgaaaccccatctctaccaaaaatagaaaaattagcctggcgtggtggtgggcacctgtaatcccagctactcaggaggctgaagcaggggaatcgctcgaacctgggaagcggaggttgtggtgagccgaggtcgtgctactgcactccagcctggaagacagagtgagactctgtctcaaaaaaaaaaaaaaatcatactaaggctgggtgcagtggctcatgcctgtataatctaaacactttgggaggctgaggcaggaggatagcttgagcccaggagttcaaggctgcagtgagccatgatggtgccactgcactccagcctgggtgacagagcaagaccctgtgtctaaaggaaaagaaaaaaggtactaaaaaaagactagcaagttatattttaaaatgtcaacagtcgttattactagctgggtgtgaaggtgtgtgcctatagtcccagctacctgggagcctgaggcagaaggatcacttgagcccaagagctcaaggatgcagtgagctaggatcatgccactgcactcaagcctgggtgacaaaatgagacactgtctcaaaaagaaaacgaaacaacccacaaaaaaaagtggttatctctggatagagatcttgtgggtggtccttacttccttttttatctatctatcttatctatctatccatcctttttttttttttgagatggagtctcacacttgctcaggctggagtgcagtggcgcgatctcagctcactgcaacctctgcctgccgggttcaagcaattctcctgcctcagtctcctgagcagctgggactacaagcgcccacgaccacactcagctaattttttgtacttttagtagagacagggtttcaccatgctggccagcctggtctcgaactcctgacctcataatccacccacctcggcctcccaaagtgctgggattacaggtgtgagccaccacacccggcctatattttaaaattttcttacaataaatgtgtatcacttttacactaaataagaaattattattctacagggtcaccctctgtcatgtaggctggagtgcagtggcacgatcacagcttgatgcagcctggttctcctgggctcaagcaatcctcctgcctcaaccttctgagtatctgggacaacaagtatgcagtaccacactcaactaatttaaattcttgggctcaagtgatccacccacctcagcctcccaaagtgctgggattataggcgtgagtcactgagcccggctgggctgtttcctatcacactactatcccttttcaatctctagcccccaatccctgccacatcaaaagctccctataaaagggcaactttaccagacactgccatagtgtcgctgatccatgcgatggaaaagatccagtccttgtgtccatccttggagagcagggagtaacaggtacagggaggaaaataagaaattagtaaaataaggattgtaataaactctctaaagaagcatacaagtcagactgaaaatatttttgtagaaattacaactctgatctctggtggtctcaacccacagagaatgatcaatctttaccttctatcttgaggagctcaaagctggaatgaaattggcactactgtgggtagtggacacatagctcttgccttctacctctgggtcccatcttccatctggaactctcttcctccagacatctagacatctacatggcttgtaccctcatttcctttaagtctccctgctcaagcgtcatcctatcaatgaaactttatcttctgatacagcatcctccaccttactctcagtccctttatgctgcctttattcttctccatggcacttatcacactctgatgtattactggtaaatattagtttatatggtttatgttttgtctatatgtcaccctccactagaatgtaggcttcaagaggacaggggctttatctgttctgttcactgctatgtctcaaacaacgcctagccatagaagactcaataaatgcctgatgaatgaatggatgatttagtaaactgctactctctgactatgggcagtgggaagtatgtggacactatggattcaaacagcaacccaatactgttggcccctgaggtgtgctgcttgcccctttatcaaatatacactgtgccctatggggagtccagtccccactctgggctgatgagaggagggtccatgttaatcactgagacccgtttaaaaacaaggctccctccaactacaactactgggaaaacttacatctcctacacacacaggatccagcgtaggtagtcgatagatggcaagactgttggggttgtctcctccagtggctagcagtgttctagaaggattcagctcgatggcatggataccacagccctgctgggtcacacctccaggctcccggtctttcagaatggggatcttggtgatctggcttgtctggacatctacgacaaatagctacaagaaaaaatggatacagaagctgaacataaatttaacgtggccaatacagggtataaacatccttttgttcaactgttcatcaacatttaattaacaactactacatgttagaccctaggaattattaaaggcatggtcaggactactaatgacatgaaacatgaaataagtcaatataacacaatattagagatagcaataatatgctacatgaacacagattaggaagcagtaagttctgcctgggattcagagaaggtttccaagaggccttctattaggccacggacacaaagaggaagaccaacacagttttctgtcagtttggtcatattttatacactgaatcctcacctaaccacaccatgcacagaaacttttaaacgaaacacaattcccagaacacatcatggctactaatataactattaatattactaagttttctggaatgaccagagacatacgacaaggaagaattattagtatctcatggctgttctctatacacacacatcccattcagtcctattcctccctgcctttgctcttgctgctacctctgcctgaaaggctctcttccacctctttaccctccaagattcaacttagagaaatgctttatggaaaaatcagtcttagcgaaaggacagcccttagaagagtcaaactcttcagtgattcaacagttcattccttcggacactcacttattttccagtactgttctaagtgttatgaacacagctatgaacgagagaaataatatctgccctaatagatacaccttatagcctaagaggctgaaataaaatcctgtcagcaattctcatgttgaagtcaaacatgtcaaacctttacataaataaacctgctgcttacacagaagatatatgaaaggagaaactaggtgagtcttaagtttaaaatataaaaagggccgagcgcagtggctcacgcctgtaatgccagcactttaggaggccaaggcgggcggatcaccagagcttgagagttcgagatcagcctggctaacatggtgaaaaccctactaaacttacaaaattagctgggcatggtggcacacgcctgtaatctcagctactcgggaggctgaggcagaagaatcgcttgaaccgaggaggcggaggttgcagtgagccgggatcgagccactgcactccagcctgggcaacagtgtgagactgtgagacttggtctcaaaaaaaataaataaataaatatatatatatatatatgaatgaggtggacaaggtggcaagtgcctgtagtcccaactacttagctactcaggaggctgaggcataaggatcacaaattgagtccagcctgggcaaaacagcaagaccctatctcaaacaaatacatatatgtattttatgtatatgtttttatatatatatatatatatggtttttttttttttcactaggaaaatggtttcattggagtgtctttagagctgtgatgtcaagacatgaagaacaagtgcacacacagacatggctatcacagaacagactatgggtgaataaaaagttcacatcacttcttccctttacccaaaaacagaaggctctaggccacctcctcataggcccactcctcaaactctctctcctccttggctgtggtatcctgtactcggacatgttcatgctgctcacagcctcagtgaactccatctcatccatgccacttcccatgtactagtgctggaaggctttgtgccagaaaatggctgtgaactgtacgagatgcacctgaacagctcctagatggctgtgttgttgccaatgacggtggcagccatctttagcccccagggtgggatgttacagacagctgttttcaccttgtgggggattcaatgaacaaagtagctgctgtccttgttttggagattaagcatttacttatccacctcctccgtgcacgtacggcccctgaacatggcagctgctaagcaacagccacagaggggggtcccacgcagccatcatattcttggcatcaaacatccgctggatgggcttgggcaccatcggggctcagtactgctggttgtcctgtatggtctggatgagtccagacatgaagaagtgcaagcgggggaataggaccctgttcatggccattgagctggccctggaagctcaggcaggtggtgaccccactcacagtgcagacaccaggtggctcaggacaccataggtgggtgtgggcagctttaggggtcggaagcagatgtcttagagagcttccttatcaatgcaaaaggtctcgtctgtgttttctgtgagctggtggacggagagggtgacattgtagggctctaccaccatgtccaacaccttgggtgggggcattacactggatacatatataaatatttaaattatatataattatatatgtatatataatatgtactttatatatttaaatatatataatatatgtttattaaagacagagagagagaaaggagtagctagaagagtgtcagagactgagtgggagcagggggaagaaggggacaaaccactctcaaactggcaactacctgagagcagcagactccctgcctaactggcatcattgctgatgcatcccacaagcatctgaaactgaatatgcccaaaacaaataaccttgctcctcaaattgctcactttcctaacaccaccactatctaccctgtcactcaagtgtggattttatcctaaattactccttttccctcatttccatcatcctagtcctgcctaacctacctcctaaatattcttacagctgactccttcctctgcttcctcactcatcacttctccttggacaaccacaattagtctttgtgccttcaggcaacaccgctatcaaaattattctattataagcagagtcaacttcctaaaaatggaaatcttcccatgccagtccccaactaaaaaacatccaatgactccccgtcacctaaatctgagatacttagcatggcattaagactctcctcggggccagactttggaaggccgagaaagaagtattacttcagcccaggaatttatgaacagctcaggcagcacagtgagaccctgtctctacttgagcccaggaggtcaaggctgcagtgagccatgatggtgccactgcactcgcacctgggtgacagagcaagaccctgcctcaacaaaacaaaacaaaacaaaacaaaaccaagagtctcctcagtccagcctctactatcatcacctcttgccatggacttcaaactctagaaataattgcttataaatatcatacatgaaaaattcttcaatgaaatataattattttgtttcatgctcatgctgttcacaatgccagaaatgattctcctattcttttctgttttttttttttttttttgagaccaagtcttgctctgtcgcccaggctggagtgcagtggcatgatctcagctcactgcaacctctgcctcctgggttcaagcaattctcctgcttcagccctccgagcagctgggactacaggcgtgcaccaccacgcccagctaatttttatatttttactaaagatggggtttcaccatattggccaggctggtctggaactcctgaccttgtgatccacctgcctcagcctcccaaagtgccggcattacaggtgtgagccaccgcacccagcctctcctactcttttacctggccaacatgtacttatctttcatgattcggttcagatatgtcctcttggactactctctaaatgtccaggctgatcaagtgcctctcttgtaggctcccaagatatccctctacccacaacacttagaccatatcgcactgatttaaaatatttacttatttgtcttcctcataaagctattaactctctcccaattctaagtgcagagaatttatcttatttgattctacaatcttgccccagcaactacttaagcatttacaacagtcacctttcagagggcctgcccaactactgtagtaggcccccacatccctgtgagggtgaggctctgtagctgttttatttgctataagcctagaccccctgatcacagcacagtctagagggagtttcaggacaatcagtccaaaggctagattggactaggccattcagattctttagggaatatgtaactggctggtggcactagaccaaaccgcccgggtggccactttttaccaaagccagtccttggagaaaagaaaacttgagacttgaagcatgggccaggcgcagtggcttatgcctgtaatcccagcacttagggaggctgaggcgggtggatcacttcaagtcaggagttcaagactagcctggcaaacatggtgaaaccccatctctactaaaaatacaaaaaaaaaaaaattagctggatgtggtggcgggcgcctgtaatcccagctactcgggaggctgagacaggagaattgcttaaactcaggaggtggaggttgcagtgagccaagatcgtgccattgcactccagcctgggtgacagtgtgagactccaactcaaaaaaaaaaaaaagacaggaaacatggacatccttggttcctagtggcttttcaattcctgtttccacttctctctgagatccaataatactttctgttcttggggtttgtgaactcgtctttccaataaatgtgagtgggtttcttatccttttaaacaaatgatcccaggctgagcgtggtggttcacgcctgtaatcccagtactttgggaggccaaggcaggcggatcacctggggtcaggacttcaagaccagcctggccaacatgacgaaaccatctctactaaaaatacaaaaatcagccaggtgtggtggcgtgagtctgtaatcctggctactcgggaggctgaggcaggagaattgcttggacccaggaggtggaggttgcaatgagccgagatcacaccactgcactccagcctgggcgacagagtgagaatccatctcaaaaacaaaaaataaaaaatattggctgggtgtggtggctcacacctgtaatcccagtactttgggaggccgaggagggcggatcatctgaggttgggagttcgagaccagcctgaccaacatggagaaagcttgtctctactaaaaatacaaaattagccgggtgtggtggcacatgcctgtaatcctagctactcgggaggctgaggcaggtgaatcgcttgaacccgggaggcagaggttgaggtaagctgagatcacgccattgcactccaacctgggcaataagagcgaaactctgtctcaaaaaataaactaataataaacaaatgatccctaaccagataatcctcaaattatttcctgaaacaaaattaattgcccactcacatatttgtgttgtgtgagacaatgcaaccataacatgtagcttttagaccagggattcccaaactgctgatcaaaatattttttgagatacagtctcattcttgttgcccaggctggagtgcaatggcatgatcttggctcaccacaacctctgcctcctgggtacaagcaattctcctgcctcagcctcgccgagtacctgggattacaggtgcctgccaccacgcccggctaatttttgtatttttagtagagacagggtttcactatgttggccaggctggtctcaaactcctcacctcaggtgatctgcctgctttggcctccgaaagtgctgggattacaggcatgggccactgtacgcggcctgaattttttcttatttttttctgaaacagagtctagctctgtcacccaagctggaatgcagtggcgtgatcttggctcccgggttcaagtgattctcgtgcctcagcctcccaagtcgctgggatggcaggtgcacaccactgtgcccagctaatttttgaatttttagtagagacagggtttcaccatattagccagactggtctcaaactcctgacctcaagtgatccgctcatctcagcctcccaaagtgctgggattacaagcatgagccaccgcaccaaggctgaattttctttaaaaaacaatacaaaacactacaaaacaaaaacaattcccaggccttaccctaaaactcttccattaggcatttctgaatttgcatgtttactgcagcattattcacaatagccaagatacggaatcagccgaagtgtgcatcagtgaataaatgcataaagaaaatgtggcacaggccaggcgcagtggctcatgcctgtaatcccagcactttgggaggccaaggcaggcggatcatgaggttaggagatcgagaccatcctggctaacacagtgaaaccccgtctctactaaaaatacaaaaaattagccgggcgtggtggtgggtacctgtagtcccagctactcaggaggctgaggcaggagaatggcgtgaacctgggaggcggagcttgcagtgagccgagatcatgccactgcactccagcctgggcgacagggcaaatactccgtctcaaaaaaaaaaatgtggcacagatacacaatgcaatactgtttagctataaaaaagaatgaaatcctttggacaacatggatgaacctagaggacattatgttaagtgaaacaagccaagtatagaatactgaatgacctcacttatatgtggaaccttaaaaagttgatcttggctggatgcggtggctcacacctgtaatcccagtactttgggagtctgaggctggtggatcacctgaggtcaggagtttgagaccagcctggccaatatggtgaaaccttgtctctactaaaaatccaaaaattagctaaactaagagtgtgcccccaacctcaccctcattattgcaaaggaatgacaatgaaccacttgaaggatagagccaccctgcttcttcatgggaagaaacaggatgtggatgagctgccacagaatctcttcccaagctctctgacaagggtccaaggattcatgcagctccactaacatttcccagaatgaggctgctccacattaacctactgggatccctgccagaaactagcagcgcggcaaggtaagctcgaggctcgggctccctgcagtttacattctaggatggggggaaagagacatgtaagactagtgagtctatctctgcatgcattcatgtgtatctagacaaatgtaaatgagtgtacacaaagacaaagatggcttaaaaaaaaggagtcagatgtggtagcaggaacctatcgtcccagctatttgggaggctgaagcatgaggatctcatgggcccaggaggtcaaggcttcagtgagctataattgtgccattaccctccagcctgggtgacagagcaagaccttgcctctaaaaacaaaaaacacaaaaacaaaaaaaagaggaaggggtaaccttacaatgtttctaaaattcaagggtgtttcagactggagcccaatgagaaaggaaagtaattctacgcaggtcacacagacaacaagacacactatgttgcagtcagtaaaagacaggtgggcaacctaagtctgtggagaggttgggaaaggaaagacaagtgaaatcaaagcagaagaatctattcactatcccaatctgagaaagtggggaggagcaaaggagagagccaagaccaagaaacacaacagaaaatggacagacaatatgtatcaaacattaaaaatatgtatagcggctaggcgcggtggctcacacctgtaatcccagcactttgggaggccgaggcgggcggatcacgaggtcaggagatcgagaccatcctggctaacatggtgaaaccccgtctctactaaaaatacaaaaaattagccgggcggctgggcatggtggcctgcacctgtagtcccagctacttgggaggctgaggcaggagaattacttgaacccggtaggcggaggttgcagtgagccgagatagcgccaccgcactccagcctggcgacagagcaagacttcgtctcaaaaaaaaaaaagtatatatatacacatagcaggaccctatagtctctgcagtctccccatagacatatatatatagcttgtaataccaattttaggaacttacactgaggaactagtgatgggtgaacagtttgaactactgtacatcttttttaattatagagacagggtgccactttgttgcccatgttgtaataaaacccacctgggctcaggcaatcctcccgccttagtctcccaaagtgcgggattacagacataagccatcaagccttgccactacatacctttaacggcgataaggtagttcactgcatgaatatactgacattaattgaattaattccctattattgaacatttatgccacgtccaaatttttagtaatacaaaacatggcaatgaacattcttttattgaaatccagggcctcctcttagtactggggaataaggaggaacaaaattaaataaataaatccagggctgggtgcggtggctcacgcctgtaatcctagcactttgggaggtgggcagatcaactgaggtcaggagttcaagaccagcctggcaaacatggcaaaccctgtctctactaaaaatataaaaattagccgggcatggtggcagtcgcctttaatcccagttactcgggaggctgaggtaggagaatcgcttgaacccaggaggggcaggctgcagagatcgcgccactgaactccagcctgggcgacagagagagtccgtctcaaaaataaataaataaataatacaaataaataaataaatctggctgggcacagtggctcacacctgtaatcccagcactttgggcggtcaaggcaggcagatcacttgaggtcaggagttcaagatcagcctggccaacaaagtgaatgaaaccctgtctccattaaaaatacaaaaattagccgggcatagtagtgcgtacctgtagtcccagctacttgggaggctgaagcaggagaatcgcctgaactcaggtggcggaggttgtagtgagccaagatggcaccactcagcctgggcaacagggcaaggttctgcctcaaataataataataaattaataaataaatccggccgggcacggtggctcacgcctgtaatcctagcacttgggaggctgaggggggcagatcactctaggtcagaagtttgagaccatcctggccaacatggcgaaacgccatctctactaaaaatacataaattagccgggcacagtgacgggtgtgtaatcccagctactcgggaggatgaggcagaagaatcgcttgaacccaagaggcggaggttgcagtaagccgagatcgtgcccctacactccagcctgggcaatagcgcgagactccgtctcaaaaatcaatcatcaatcagtccacgtgtctgcgctatgccaagatcttagacactctgagctgtgaatctaaactgttcctacacaagatggactacactactagctagctaagataagtaatggtacttcataataggtcttgaattctgatgtttcgccacagaatcatgacttcgtggaaggagggccacattaggatttacaattattttggatttaagtgacatattcttataagctttatatctagcagtaaattgatttctaatccttgattttttttttttttgagatggagctcaaaaaaaaaaggtgcccaccaccacgcccggctaattttttgtatttttagtagagacagggtttcaccgtgttagccaggatggtcttgatctcctcacctcgtgatctgcctgcctcggccggccaaagtgctggcattacaggtgtgagccaccgcgcccggcctctaatccttgattttggaggtctctgttaaaaatggactgaatcctaaaagccagctttggcaagacaccttgattttacctagtacccaccaaagtcaccacataaactttgacaacatacaacagaggtttagctaccttaagcatctatctaaacaaatatttgttaaaaagaaattcttgctgggtgcagtggctcacacctgtaatcccagcactttgggaggcccaggcgggaggatcacctgaggttgggatttcgagaccagcctcaccaacatggagaaaccccatctccactaaaaatacaaaattagctgggtgtggtggcgcatgcctgtaattccagctactcgggaggctgaggcaggagaactgcttgaacccaggaggcggaggttgcagtgagccgagatcgcgccatcacactccagcctgggcaacaagagcgaaactctgtctcaaaaaaacaaacaaaaaaagaaattattcttggactgttaaatcagaaccctatttagtattgcttttatatgtttacaaatcccatcacctatttccaagtgataccaatctgaaaaatgaaaggggaaataaaaggattagtccaatagtctgatttcataagaatctttatttcttcctacctatagaagatggaaattgatttatttcttttgttttttttccaagatggaaaaaaagacagactcactctgtcgcccaggctggagtgcagtggcacaatctcagttcactacaacctctgcctcccgggttcaagcgactgtcctgactcagactcccgagtagccgggaccacaggcatgcggcatcatgcccggctaatttttgtgtttttagtagagacgggatttcatcatgttggccgggctggtctcgaactcctggcctcaagtgatccacctgcctcagcctcccaaagtgccgggattaccggagtgagccactgcccccggcctgaaattgatttctatatactcaaggatgctaacagttaacgtgtaagttattcaggagaaaatctgtacacaggaaactttcaggtttttgttccctggtgacatttccaggtataaggccttctactcagaattaacagggagctttatccctaacttgcaaactactggagagcagagacggtaattacgtatctggtataagagattataaactcttaacaatagtgttaaataatgataatatggccgggcgtggtgggtcatgcatataatcccagctctttgggaggcagaggtgggcagatcacctgaggtcaggagttcaaaaccaggctggccaatatggcaagaccccatctctactaaaaatacaaaaattagccgggcgtggtggcacacacctgtaatcccagctacttggtggtgctgaagcagaagaatcgcttgaacctgggaggcggagattgcagtgagccaagattgcgccagtgcactgcagcctgggcaacagagtaagaccctgtctcaaaaaagaaaataataataataataatatctctcttatctcacacttacttcctaagtataacagcattaagacttgaggaccaggaccatatggttgtgtatttgcccattgagaatcaagagccctcaccaggggctattttgagctccaaaaaactcactgtgtgactaagaggagcaactccttttgttgcatattctactactgtatttttgagcccctacttcggtccttctcaccgtcattttaggataagaaaacgcaaggttcatctagctgaaataacagttttaaaagatgagtgtttattgtacaaacgatactttatcaacaatacagaaatttaaaatgcaagaaagatcactcagaattttctctcttttaaaatctgtttttcatttgtcaggttcctgtttagtcttcaaccacatatatattttaattgtgcacagctattatcagcagagacaggattttgtatctcatttcattaaacgtactgaattcttcgcacattacagtctccataattatgttaatgtctgcataataccatccagatttatcactatttacttaagtattcgattgttagtatttagattaagtagcttccaattattatcttgttaaaaacgacttttcctttggataaattctcaggtgtgaacattttaggcaaaagggtataacatttttaggctcttctttcaacaaatactatgtacttttgcggtttttttttttttttttgagacagggtcgtgctctgtcacccaggctagagtgcagtggtgtaatcccatttaactgcagcctccacttcccagactcaagccatcctcccacttcagcctcctgagtagctaggaccaaaggcacaagccaccatgcccagctaattcttaaatattttgtagagatggggtctcactacattgcccaggctggtctggtcttgaatctctgggctcaagtgatcttcctgtctcagcttcccaaagtgctggattacagtcatgagccactatacccagccaatactggccaacatggtgaaccctgtctctactaaaaaacaaaaaaattagccgggcttggtggtgggcgcctataatcccagctactcaagaggctgaggcaggagaatcacttcaacctgggaggcggaggttgcagtgagctgaaactgagccactgcacttcagcctgggcaacaagaatgaaagtccgtctcaaaaaaaaaaaaaaaaaaaaaaaaaaaaaaggccaggtatgatggcatgtgatatagtcccagctactcaggattctggggcaggaggatcccttgggcccaggaatttgaagctgcagtgagccatgactgcaccactgtactccaccctgagtgcaaaatgctgtcttgaaaaacaacaaagtggctgggcatggtggctcacgtttgtaatcccagcactttgggaggctgaggcgggcagattacatgaggtcaggcgtttgagaccagcctggccagcatggtgaaaccccgtctctactaaaaatacaaaaattggccaggcatggtagcacgcgcctgtagtcccagctagtcggggggctgaggcacaagaatcgcttgaacccggaggcaaaggttacagtgagccaagatcgtgccactgcactccagccttggcaacacagcaagacgcggtctcaaaaaaaaaaaaaaaaaagaaaacaaagcaaccctgacataatgggttagcctgatactctcaggtaggccttggtgtcctagcgtaaataaataatttcagagaatatcaacatcagacaaggccactctgcaactgtgataaagacaaaaacaagaccactctataatcatacctgaacacagaccaaaacaggaacactggccaggcaaggtggctcacacctgtaatctcagcactttgggaggctgaggcaggtggatcacctgaggtcaggagttcgagaccagcctggccaacatggtgaaaccctgtctctactaaaaatacgaaaattagctgtgcgtggtggcatgtgcccgtactcccagccactcgggaggcagaggtgagagaatcacttgaacctgggagacggaggttgcagtgagccaagatcatgccactgtactccagcctgagcaacagagcgagactccatctcaaaaaacaaacaaacaaacaaaaaaacccaagaacactgactaaaccacaaaaagatcaaacatccccttaacctggctaatataaatgactgtttcatctttatcaattacagctttaacctcctgctagataagattaagatacccaaacatagaatttgcccgtcgtgacagtatccatctggagcaaagtgctatatccttaagccgtcccccaaatcacgtgcaacaagtcccagtgttgtaactcctttccagcactcttaccgagaggtccctcgctctcttatggtgaaggttctcctaggtacaacaagcaactatatctgacttgttctgctacaagaacagtccctggtagtctttgactggagagtgctgacaatgggaaataagagttcacgtccaaaattaaatacctccaactgtgtagatcatcactctgccgattgccatccttctcctcaaatcacaccccacccccagccccttcaagagccctcttttcggccaggcgcggtggctcatgcctgtaatcccagcactttgggaggccaaggcaggcggatcacgaggtcagaagatcgagaccatcctggccaacacggtgaaaccctatctctactaaaaatacaaaaattagctgggtgtggtggcaggtacctgtaatcccagctactcaggaggctgaggcgggagaatcgattgaacccaggaggcagaggttgcagtgagctgagatcgcgccactgcactccagcctggtgacatagcgagactctgtctcaaaaaaaccaaaaaagcaaacaaacaaaaataaagtcctcctttcttgaattcttttctgtattctcccggttttcctgagttccctgctcccccgcagcagttcttcttgccctgtaaatgtacatgttttccaaggttctctccttagcttatctgtcagtatcagtggttcttaaccatttttggctcatagtactctctttcaaaatctaaggacaaaaactaagaacgacttcccacaccacccccccaaaatcttgcccagaaagtacacatataatcaaaactttgcaattttagggaaagtttacacaactcaagccaggaatgcctgctctctactgtctttcccatgataatgtaacaatttcaataattccttctacataaatgactgccaaatcattaacttcaatccttactctctgccaagcttcaactaattgatgaaaaggacaaaacccaaatctgttccttaacattcaccctgccatctttccagttatataggttcaagacattagtatcaatttttttttttttttttttttgagacggagtctcactctgttgcccaggctggagtagaatggcacaatctcagctcactacaacctccgcctcccgggttcaagcaattctcctgcctcagccttccgagtagctgggattacaggcacccaccatcatgcccagctaatttgtttgtacttctgtagaaacagggtttcaccatgttggccaggctggtctcgaactcctgacctcaggtgatccgcccgccttggccttccaaagtgctgggattacaggtgtgagccaccttgccctgcgaaagaaaatctttttaacactaggctcaaattcctacacggcaacagttggttaaagtcaagaatgccttctgtagttctttgcagcccctactactccttactgtcttgcgcctagcaaacttttcttcacttagcttttctgtctggctccgcagccaatctgaatttgcgtaagtctaaaccatgaacatatacctaacccatcccagctgccagatccatgttctaattaaggttataccacctctacttaagcagttgagtaaaaatatgactttattgttattaatgataaaaacaacagtggctatccttgctgttactgctgtgctagctggggccaagaaatctggggattgaatgactaccctagtttgattgttagcccacagcacagggacattctacatcaaaactttcctattgagaatacaacataatctctcccacctctgaaatcttcacacattatccaaagacaattccaatttttaaataattttcctctcttcaaattgtgggaaaaggttatggaaatcatttttaccgctactagtacttttaaataagtaagatattgctcactcagaatatttcccagatgcatgcagacaccttagcaccagatattatcactcccattttgcagatgcaaaaacaaaagcacaaataagggaatcatttgcccaatgtcacaaagttcagagaagagcactattcctagttccctgctttggttctggaagctaagcaaaaacaaacaaatactaactataaaatgaaaacagctccccttgccccaaacactaggttatgaggattaggaagacagaaagaggtaggaattaagagtaggttaaattattacttattatgctcgccttcaaaatagtgtcaataaattcaacaagcaagaggctatgatgattaattcagtttacaattcagtaatatttgctaggctaaacactatgatgcacgtgcggggagtggaatgaactcttccaagcaggagactctttttctactccaagtgacaaggatgacagttcttaaccacgagtgggcagctggagagaccaagaaaaggaagttctgtggaggcccgttgccaccacttagttttgaaaggcttctgggtaagacaagcgactcctcaacagaagaggaaacgaaaggttggccccaaccaccatggtattatttccttcctcaaaactgtttaaatttttgcctatgtcctttataaacagaccaaccaccatggtattatttccttccttaaaactgtttaaatttttgcctatgtcctttataaacagacacttctcctagtacttaagactttcttgatctagagcaatcttctctcttttaatgatccaaaatgtgtttcattccagggtcaatttactcacacattatgacattacttgtccattcacacaggggaggtgaaaaccgagggagggctgggcgtaatcatttcccacccctaggccctaggccctgcctcttttcatttgccagtcttgtgacatcatgctattcgtggactctattccaaacgtttctgctctttgacttattttatcctggcctataattgggttggttacaaagcttactgagaaatttttcacttcattcatttataactgtctttctattcactcttaaaaaggctactttccaaagagctaatgcttataccctgaaatatactaccagacacacattccctgccttccttataggaaacagttcatgtatttctcatatttcagtttatacatttttagattctgttcactaaaaaacagccaagtgtgctattttaaatacttcgacatacgttcttaggctgttttcactattatgtatcctgaatgatgctctaagcatcattatttcttaaatctttcctttgaggcctatgacttaaaaaccagcataaaaatatgaggcaaaaacaaacaaacaaacaaacaaccctctagaagcagcacatccagagagggcctgaagaaatacactcctttgaggacttatcagaaaagaaatgtatgagtgaaaaaaggaacacgaaaagaggaagaagtcaccaacgggaaagaatggaaaggagagtaaggcaagtccctcctaaaagaaacagacgggaaaactagcagaggttctagagcaagtggagcaatatatccacgacctaggagagaggtcacatccccccaggcacttaccgtgttgcattttgtgccacacaccacttgcctatgattcaaccactgagatgcaaacactttattaagggtcccaaggtgaaactctctctccttcaggagactgggaagttgctgtgctgcataaccatgcaacactcgagagtagctggtttcattctgtagcctgacttcccggttcttcaagtagtatactaaggatctcttcacaggaggaagtcttttccttttgtgaagcgagtgatcccagccaaactgtggaaacaacattagaaatcagggctttggctactcttcttcagaacagatcctactgtattacagaaatcaccaactcataactcatactgcagaatttacaaacaacacaaatacaaacacaagagaacaagaatctcaatccagaaagtcgtttaactcttccaacattaaaaagatgttgctcacagtcaaacttaccaatgtgaattacaagggctgaaagtcaagggaatgaatgcagaatagaacagactaaaaggtttactagacattttaggagtgaaagattgaaggaaatgagaggtagagtgattcccataccgacatgggctgcatctctacccagcccccttctccctctcagtctgtactcccactggagcacggaagatacagtccaaggagccagacctggctcccaggtcttccagggatgcatcatcaatgaccgttcctctgtcatcatgcccgcgctccaggcagttgcagaattcgaaaaatcaaccgccaacggggtagtaggcccccgggaaatcagaggccatatctatgtccaagaaggccttcccctccaaagggggcggcatagagatgatacctgggaactgttgtttcttttggggtccaaacgccgaaaggcccagctcagggttgggtatacatatagggagactacttccttcttccaggagggacgcaatcatcccagcttcctagggcccatggaaggtagagttcactctaccagagtttgtttccgattcccttaacttcggtttccccttcctccaaagccaagattctggtttcttttcaagccctatccacgaatgcaggcctcccgcggattatgtcccattcctgagttcccctttggctcctcaccgccctggcctatctgccctccagttaacgagggtccagtcctgaccctataggccctgaacccattcctgttttgcctctgactgcagaccctggaccccgattcccgtcgcaggatctgcggaccctaagcccatcttggttcctcagcctcaccacccaggtgccggcctctcaaccctcacctgcgggccctgagcgtcgctcccagctcccggcgaggcgggcgctttccgcttcctgctaactactttccgggccatagtgggcagcgccgccgcggccccgcagccacatggggcgggggaagcgaaggatagcaggacggcgggtcatatactgggccccggggccgcgcaccttagtgcgcccggcccggaaaatggcccggacccggagcggcagcagaaaaaagataggcggaaagaaaggaaagagagaggaaggacttgagccgggaaagggaaggggaagcgagaatgagcggctttccgacggcagagcctgcaaggacggcgagcggctagaaccaaaacaccccctcccccttgctcgcgcgccgtcacccttgcgcagccgcacttcggatagcgtcgccacggaaacaccgccggaacgagatgggcgggatctaggggttggaagatagttctctggtgtttcccggccgccgccaggccattttcaacggttgtttggctactgctggatggaagtggacgagctggggccaagggaatctggcttctggccgccgacctccgaccccagcccgcctatccgcaggcacccggaagtgaggaccaccagtgctgctgggggaaggaatcctccctagtgcaggccttaacccggttacctcccatctggcaccaaacgtttccctgaatctgtcacaaaccgtgccctggctccaagggctggacaggggggtgggggggtggggggcaggaaccgctcccaccctcgaggtgaagtccagtcaggaagtcagggcagtgtggccagactttcccaccactgagaacctgcccagcacaaccaacccaggccgccctacgagtctctggctaccctcttcccaccgctgggtagccctgaggctccattctccgctctgtctcctcctgatcctttctcctgtccgaaatgcttcagcccctcagtcagtttcagctcctcagtcaccttccccttacggtgcaacttcaccattccctttagatttccatgacctgccatctaaaccacatggtcttttgtgctttatgaagtagtcatcacgctgtaaacttatctgtagctgcctgcctcactcttggattcaggttgcgtctccattagggcaggtcgggaattctgaactacaggaaagagagtggtcatttttggcttgccagtccagttagagctggcattggcctccaaacaagggggcttcatcaggatcacccttgccaacatttttggaagatcctgaaggaatatgactgccagccttcgctttcctcaagcaaacaaaccctctgaggaagcaggatgctcttgcttggggctgattggcctcaggctgtggtgcccagttacctgctggtcacttcaggcttcaggcctcaggcctcatacctccaaggagctctgttggaccatctcaagttctgtcaacaaggagatttggatttgttttccaagccgaatcaaagaccagattgaagcagggtctcctgccatcccaagtcggcactaccactaacccctaatgtcttgcgaaaggcagctccatcttatttggtcaggcctgtccctttagagatatgcacatagtgagtgggtcaggagtgggtcagctttcttttttgagtctgttctaattctgtcttgccccgcaatgctctggatgacccaagagcccctgggcaagagtctggaatcctttgagaatctctaggctcagattgggctgtcagtgccaagaggggcacactgggcactgctgcagtctctttctcaaagttcctttacttcatcttcacaacctaggaaccatccccaaatgtaccttatagcagagctcgcgatttcttttctttttttttttttgagatggagtctcactctgtagcctaggctggagtgcagtggcacgatctcggctcactgcaacctctgcctcctgggttcaagtgattctcctacctcagcctcctgagtagctcagattacaggtgctcgccacgttgcccagctaatttttttttttcttttttgagacggagtctcgctctgtcgcccaggatggagtgcagtggtgcgatctcggctcactgcaggctccgcctcctgggttcacgccattctcctggctcagcttcccgaatagctgagactacaggcgcccgccaccacgcctggctaattttttgtatttttagtagagacggggtttcaccatgttagccaggatggttgcccactaatttttgtatttttagtagagacggggtttcaccatgttagccaggatggttgcccactaatttttgtattttcagtagagatggggtttcgccatgttggccaggctggtctcaaaatcctgacctcaggtgatccgcccacttcggcctcccaaagtgctaggattacaggcatgagccaccacggctggccaagagctcaccatttctattcaaataacagaatgaaagtccattttggaaatttaattgacaattgcctttaaaagactgcaggccaggtgcggtggctcacgcctgtaatcccagcacactgggaggccgagttgggccaatcacctgaggtcaggagttcgagaccagcctcctgagtagctgggttgcagtgagctgagatcatgccactggactccagccagggtgacagagcaagaccctgtgtaaaaaataaaataataaaataataatgataacaataataaagtagtagagtggctgggggaaaaagtactcagggcatgtaactactccaagaatggcattcttagtgagcctcactgctgaaactgcgtgctataatctgaaagcagttttatctaatagctgttaaaacaacctactgtgactctcagaaatagttttacttattgccttcacttaccaatcaaaacttgccagctctccaaaaccttactagtgccagtgaactttcttgaagagcaatacataacacttcctttttacaaaacttccaaccttctctttgttctgcagacatggcaaagaccacccagtctgcgtgtgccctgaattacaattcctgcttcacaaaacattttaattttagagattcatctatatattttatttcaccttgacaaaactgtgtgaatgaattttataatattgcataaaagatatcaggccaggcgtggtggcttacacctgtaatcccatcactttgggatgccaaggcgggtggatcaccttaggtcaggagtttgagaccagcctggccaacatggtgaaaccccctctctactaaaaatacacaaattagctgggcatggtggtgcccgccagtagtcccagctactcaggaggctgaggcaggagaatcgcttgaacccaggagaccaaggcttcagtaagccgagatcgagccactgcactccagcctgggcaacagaatgagtttccgtttcaaaaaaagaaaagaaaagaaaaaaaaatcaaacacactgctgggcacggggctcacccctgtaatcctagcactttgggaggctgaggcaggtagattgcttgaactcaggagtttgagaccagcatgggcaacatgggaaaatcctgtctctatagaaacatacaaaaattagctgggtggggtggcatgtacctgtagtcccagctacttgggagttggcaggctgaggtgggaggatagcttgagcccagaaggtggaggttgcaggtggagagccaatatcatgccactgcactccagcctgggagatccagacctgtctccaaaaaagtcaaacacaaagcagtaattcctttttttatttttattttttgagggacaagttctcgctttgttgcccaggctggagtgcagtggcatggcatgcatgtgccaccacacccagcttattttttatcttttgtagagacagggtctcgcctggttgcccaggctggtcttaaactcctgggcttaagcgatcctcccaccttggcctcccaaagtgctggtattacaggtatgagacactgaggccaaccaaagcagtaattcctaaatgtaattagtaaatgcctaatttcatgtttttgaagtatgaaaacaggcacaactgatccatggtaagagaaatcagtcattacccttaagcgggattactaactggcaggggacctcagggagccttctgaggttctggaaatttcttttttttctttttgagacagagtctcattctcccacccaggctggggtgcagtggcacgatctcagctcactgcaacctctgccttccgggttcaagcaattctcctgcctcagcctcccaagtagctgggactacaggcctgcgccaccacacctggctaatttttgtatttttggtagagatagggtttcaccgtgttggccaggctggtctcaaactcctgacctcaggtcatccacccacctcggcttcccaaagtgctggggttacaggcatcagccaccatgcctagcctggaaatttctttcatttttcttttcttttcttttttttttttttttttttttgtgagacagtctcgcttcattgcccaggctgggtgcaatggtgcaatctcagctcactgcaacctctgcctcctgagttcaagcgattctcctgcctgagcctcctgagtagctgggattacaggtgcccaccacctcgcctggctaatgtttttgtatttttagtagagatggggtttctccatgttggtcaggatggtctcgaactcccgacctcaggtgatccgcctgcctcggcctcccaaagtgctaggattacaggcgtgagccaccactcctggccctaatttttgtattttcagtagaggcagggtttccccatgtttgccaggcttgtctagaactcctgacctcaagtgatctgcatgcctcggcctcctaaagttctgatattacaggcatgagccacagtgtctggccctcaaactatactattttgtagcctcaaataaaaaccccaacagttccaatcttctctaaccccattcctccaattcagttcttataaccatttcatcacaatgcaatgtgctgctagagggtcattaatggatctgcacctgttaccttctcttgccttggtcttgccaggaagaataaacaataagaaatactataaagtgctttgggcaaactgaattgtgttatacttgcttagtaacagaattttctcttgtttatttgcataggtttcctggaacaaacaaagcggatgttaatacaattccctgtttgactctacccttcatgtgttggagctaattaaccacgcttgctagcaaaggggcaagtaagagctcaggaggaaagtatttctgttaggaaaaaggattttggattttaattcatacaaccataataaaacatagcaaggaaagagacccagaggacataggacacaaatgaacacagatggtaagcgcacaaaaacggctctccgatgacgtagggatgtgagaggcctctgaggcatggaatcgtaattacttcacccactgtggaaatatttttcagattctgggcataggttattaaaagtggaagatataggccgggcgaggtggcttacacctgtaatcccagcactttgggagactaaggcgggtggatcacttgaggcctctactaaaaatacaaaaattagctaggcatggtggcggacacctgtaatcccagctactcaggaggctgaggcaggagaatcacttgaattcgggaggcggaggttgcagtgagttgagattcagccaatgcactccagtctgtgcaacagagtgagactccgtctcaaaaaaaaaaaaaaaaaaagtggtagatatagagagacagctcatgtcttaaacttatagttttaaagaaaactaaggccaaaaatgacaagtcatgcaaccagacaagagataagccagagctgaaacccatgaactctggtctacaaaattttttcttttcttttcttttctacttttctttctttctctctttctttccttctttctctttctttctttggcattgagacctgcttgatttattccaattacttaacacataatgatgcaactgtgatcccaaagtgtgcaaagttaaagccttcaactgcagctgaggagagggcaggaatggttcactggggacggtgatgagtcaggaatgacaggcaggtggccatgaccagggcagcctcctccccagggccagggacaggggagtggcctgaggagcaggacccaagggtagcccagggccggggaagagggcagagacctccccttggcctaggtcaggagctcagaagtgctacatggctgagggggcagcggcccacgaagggccagaggcagggccaggagagcaccatttcctgggggggctgggggcagggaggtgccctacaggagaaaccaggaggggctgcctgcccctgggatgggggctgggctggagcaggctgcagcaagaaagacctgaggcaggtgcagggcctgagaacctggctggctgggctcggggggctcccagggcagcctggcccagggagcagccctgactctgcaggggatgcccagcgagggcccggagacccttcagggcctcccctcctctctccctggaaaggagctggggaacccgtaatgcaaatctgtggaccactcagttatggggggaggctgtgccccctccatcaccttggcctctactgctgtcctcagtacagccgcttttcataaaagtgcagaccatggacgccaccctcgatctgggccgacatgatccgcttctcaaacttgagctctcctgagtacatcatggaccgagggacagacaggctgtgggccccgatatcctagcagccgtgctggatgcccactatgaggtagggcacgaacttctgaatggaccctttgtcctggatggagcccaagacaccctgcacgatcttcaccttatcccccttgctgaagtatcgtttctggctgctgctgctcttctccatggcatccagtgagcccatgccccagtacttcttgagccgcacctcgtctgagaagtactcaccaggggcctccatggtgatggccagcagggagcccatcatcactgtggagactccaagggccagggccttgactatgtgccccatggtctggatgctgccattggctatgatgggcacaccaaagcgccgggcatacttggcctccttgtacacagcagtgccctggggctgaccacaagccatcacttcccgggtgacgcagatggagccgcagcccatgcccacacacagcccgtccacaccagcgtcaatcaggttcttggcctgggctgctgtcaccacgttcctgccaatcacctggaggtgggggtacttctgtttgatgtaatgcaccatggcgatctgatacaccaagttcccttgggacgagtccaagactatgatgtcgacgcccacctgggtgagcaggtccaggcgatatttgtcatcctcacgggtgcccacagctgccccgcacagcagctgcttgttgggaatccttggaggccagagggtagtcttggttcttcttcaggtcgctgccggtgataatggccaccagctcattgcgatcattgatgataggcagcttccctttcttgctacgctgcaggatctcatttgcctctttcaacgtcacacatgctggagctaccaccagctcgagccttggcgtcatcacctcactgaggagggtggtgtggtccttctcagcaagaaagttgatgtctcgggaggtgacgatgcccaccagcttgctgcccatggtgcccgtctcagtgatggggatgccagagaagccatgccgcatcttggcctccagcacatcacctacagtgtgggaggggctcagcaccgtggggtccgtgatgaagccctgttcaaacttcttgaccttccgtagctccttggcctggagctctggggtgcagttgtggtgaatgaaaccagtatctcccatcagagccatcgcgatggccacgtcagcctctgtcacagtgtccatgggggaggagatcagcggtgtcttcagcgtgatcttccgggtcagggctgaggtaaggtccacctcagctatgaagtctatgagtcctgggagaatcaggaaggcgtcctaggtgaggccttaggcgctggcgaagagctgctgcgcgatgagcccgtcctcgggcatgtagccggtaccaccgctgatcaggtagtccaccacgctgctgggagaccctgcgacccgagagaaacacccgctggaccgcccgccgccgccgccgccgctgccgcgctgctgccacgctgctgccacgctgctagcgcgggtccggcgggcctgggacgggggatcttttttttttttttttttgagagcagggtctgtggcccaagctggagtgtagtggtatgatctcagctcactgcaacctttgcctcttgggctcaagccatcctcccacctcagcttcctaagtagctgggactacaggtgcaggccaccatgcccgcctaatttttgtattttttgtagagatggggtttcaccatgttacacaggctggtcttgaactcctgagctaaagtgctttacatgcttcggcctccctaagtgctgggattacaggcgtgagtcaccatgctaggcccataattttcagcactaccacattaaatatctgggtccagttgaagtctcaagtggtatttattttagcatttcccttgtactctcatgttttttctttattcagaacctgaaatgttttatccagaacatctactactttgacagcagaaattctatttctatatgttatgcataatttggcatacgttggtagaatttgtgttaagtacagtacagacaatttctgtttcatttatttttttagagacagggtctcactatgttgtccaggctggactcacaactcaagggatccttctgcctcagcctccagagtacttgggactacaggtgcgagccatcattctcagtacagacaatttccaatcattcattaattgatcatagagtttgtaaagtttcaagagtccttgttttctgttgctcctgcctgttaaacagtcttacttttatctgtaaccttaataaaataagaaaataaaggaagagacaaaacttttctacttaataagatcaagtaatttatttatttatttatttatttattttttgagatggagtctcactcttgtcacccagctggagtgcaatggtgtgatctcagctcactgcaacctccacctctcagcttcaagcgattctcctgcctcagcctcccaagtagctgggattacaggcgtccaccaccaagcccagctagtttttgtatttttggtagagacggagtttcaccatgttggccaggctggtctcgaactcctgacctcaagcgatccacccatctcagcctcccaaagtgctgggattacaggtgtgagccactgcgcctggccaagaaatttatttttaaaaaattggctggacaaggtggctgtaaatccagcactttgggagactgaggcaggtggatcacttgaggtcatgagtttgagaccagcctggccaacatggtgaaactccgtctctactaaaaatacaaaaactagctgggtgtggtggaggtgcctataatcccagctactagggaggctgaggcaggataatcgcttgaacccaggaggtagaggttgcagtgagccgagatcatgccactgcactccagcctgggcaacagagcgagactccatctcaaataaaataaagtaaaacaaaaataaaaaataagagagaaatagctaattggaagaaaaacaatgtacctcatcctactcatgctatcttcctaccgccttcatacatttctgaaatgactaatgtgggtatatataaatataaaaattgtacacaaatattacctaccaattttgttgaggagtcttccatcagtcatattttttgagtcaaatacaacacaatcttggcataaaaacaaacacataggtatcaactaatgataggaaaataaaatggcttgcaaaatggaacaaatattttaaaaaaattattagataattaggcaacgtttttcctctgatcacaaatgtccagaaatgtctttaaagaccattaccggctggtggtggctcatgcctgtaatcccagcactttgggaggccgaggcaggcagatcacttgaggctgggagtttacagccagcccaggcaacatggtgaaaccctgttactacaaaaaaatacaaaaattagccaggtgtggaggctgaagtgaagttacaaaggttacacgctgccctctccctccccctccccctctccccacggtctccctctccctctctttccacggtctccctctgatgccgagccgaggctggactgtgctgctgctatctccgctcactgcagcctccctgcctgattctcctgcctcggcttgccgagtgcctgcgattgcaggcacgcgccgccacgcctgactggttttcgtatttttttggtggagacggggtttcgctgtgttggccgggctggtctccagctcctgaccgcgagtgatccgccagcctcggcctcccgaggtgccgggattgcagacggagtctggttcactcagtgctcaatgttgcccaggctggagtgcagtggcgtgatctcagctcgctacagcctccacctcccagccgcctgccttggcctcccaaagtgccgagattgcagcctctgccctgccgccaccccgtctgggaagtgaggagcgtctctgcctggccgcccatcatctgggacgtgaggagcccctctgcctggctgcccagtctggaaagtgaggagcgtctctgcccggccgccatcccatctaggaagtgaggagcacctcttcccggccaccatcccatctaggaagtgaggagcgcctcttcccggccgccatcccatctaggaagtgaggagcgtctctgccaggccgcccatcgtctgagatgtggggagcgcctctgccccgccgccccgtctgggaggtgaggagcatctctgcccggccgccccgtctgagaagtgaggagcccctccgcccggaagccgcgccctctgagaagtgaggagcgtcaccgcccggcagccaccccgtccaggaaggaggtgggggtcacccaccgccaggccagccgccccgtccaggagggaggtgggggggtcagccccccgcccggccagccgccccgtccgggaggtgaggggcgcctctgcccggccgcccctactgggaagtgaggagcccctctgcccggccagccgcccggtccgggagggaggtgggggggtcagcccccgtccggccggccgccccgtccgggagggaggtgggggggtcagcccccccgcccggccggccgccccgtccgggagggaggtgggggggtcagccctctacccagccagccgccccgtccgggagggaggtcgggggggtcagccccctgcccggccagccgccccttccgggaggtgaggggcgcctctgcccggctgcccctactgggaagtgaggagcccctctgcccggctagccgcccggtccgggagggaggtgggggggtcagcccctcgcccggccagccgccccgtccgggaggtggggggcgcctctgcccggccgcccctactgggaggtgaggagcccctctgcccggccacctccccgtctgggaggtgtgcccggcagctcattgagaacgggccatgatgacaatggcggttttgtggagtagaaagtggggagaggtggggaaaagagtgagaaatcggatggttgccgtgtttgtgtagtaggaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccattccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgtgagaaacacccaagaatgatcaataaaaaataaataaattaaaaaaaaaaaaaaaaggttacacgctaaaaaaaaaaaaaaaattagccaggtgtggtggtgtgcacttgtagtcccagctattgggggtggggctgaggttagaggttttttagagcccaggatgtgcagtttgcagtgagacctgtctcaaaacaacaatcaaaaaccatttccaagaaataaatgcaataaatattgtgatgttccctctctgtgtgtgtattcttaccacctacttgtgtgcttatttattgaaataaaattgcagacataaatttttccctgttggttttttgtttgtttgtttgtttgctttctgagacagagtcttgctctgttgtccaggctggagtgcaatggcacgatctcggctcactgcaacctccgcctcccgggctcaagcaattctcctgcctcatcctcccaagtagttgggattacaggtgcccatcaccctgcctggctattcttttgtgtttttagtagagatgggatttcaccatgttggccaggctggttttgaactcctgacctcaaagatccgcctgcctcagcctcccaaagtgctgggattacaggtgtgagccactgcgcctggcccctattgtttaaatatagtaattttatgagaacttacctattttatttttgtatctattaaaaacatcatttttggctgggcatggtggttcacacctgtaatcatagcactttgggaggtagagatgggtggatcacttgaggccaggagttcgagactagtctgagcaacatgatgaaaccctgtttatacaaaaaaatacgaaaattagctgggcatggtggcgtgcatctgtagtcccagctacttgggaggctgaggtggagaatcacctaagcctggggaggtggaggttgcagtgagctacaattgcaccactgcactccagcctgcgcaacagagtgagacccactctccaaaaaaaaaaaaaaatttttttcaaagtaaaaaaagtaatctaatagaggaaaatgctccagtcagagtggcttggaatctgttttagttcataaaactaggggctgaggtgagaaaaagaggctgaaacaagctgctgccctctgctgcctgggacagcagcttttgtaactctcatacccaggaaccaggccaacatagacatggccacaaaaccaggatctgtgccaaacatacagggccatgactgaattcacaaaaaccctagataaggatggtgagagcagtgagaaagaaggttatagcaaaacaaaacagaacgaaattgcaaaacttcccactctaagatgaacctgcaaataaatttcctcaacttattaaaattaattgtagacaggacaaattccccaacaccaacaccaaaaaaaaaaaaaaaaaaaaaaccaaccaaaaaaacaaacaaagtaaaatcctccataattaggagggtaattcactatagataaatgcaaagaaaagaacaatctttaaaagacctttttcacagatactctcaatctaagaaaaaaacaacagaaataaaaggcttcaacacaagtatgccttggatcctcaaagggataaaggaagaataacaaattgaataaacgtaaaaagagatctcgcgcattggctcatgcctataatcccagcactgtgggaggccaagacaggaggatcatttgaggccaggggtttgagaacagcctgggagatatagtgagaccctgtctctaaataaataaagaaagaaagaacacatattctttgattcatctccctctgggaagtacagctcaatttctctcttattcagtattgcctggactcagtgactcacttctaatgcatagaatttggaaagggaaaaatagcaactgcacaatggagataccaccttaaccaagtgatcaagttaacctaaataataatgtcagactgatatcttataaccccttatatgatgtgatgagaagggcactttacctctgtagcattcttccccaaaatctataaccctagcttaacagaaaacatcagataaaaacctaaattgaggaacattagacaaaataacctgcccagtactctttaaaaatgccaaggtcatgagacaatgaaagactgagtacagtcacggatttgagacttgacaactagattcaacatggtgtcttggattggattctgaacagaaaaaaagaaaaaagaaaaattaaggaaatctgaataaagttaatagtattatatcaagtttagtttcttacttttgataaatgtctcagttatgcaagacattacgtaactgttaacattagggaaagctgggtggaggataaacaagaatttgctatgctatctctgaagctcttctgtaaatctaaaattatttcaaaatgaaaactttaaaaattaaaaataaatgaatcaattagaaatcctgaaaataatttcctaaatgaaaaaagtaagttattggtaataaaccctcaataaactagatatacattatcttagatggacatagacaaacagagtgttagtgaattagaagatggttctaaggaagtggcttagagaacagcatacaaattgaccaggcacagtgtttcacgcttgtaatcctagcactttgagaggccgaggtgggcgaatcacctgaggtcaggagttcgagatcagcctggacaacatggtgaaaccccatctctactaaaaaatacaaaaattagccagacacagtggcgcatgcctgtaatcccagctactcaggaggctaaggctggagaatagcttgaactggggaggcggatgctgcaatgagccgagattgcaccaccgcactccaggccaggcaaccgagcgagactccatctcaaaaaaaccgaaaaacaaaaattagcttggtgtggtggcaggtgcctgtaatcctagctgctcaggaggctgaggcaggagaatcacttgaatctgggaggtggaggttgcagtgacccgagatcacaccattacgctccagcctgggtgacagaggagactccacctcaaagaaaaaaaaaagagagaacaacataaaaagatagaaattgagtataataaaaaggcatggaggttagaagtggcattattgaaaatggcagagtaggggatccatttctccccagaaacactgaaaaacttggcaaaacctgttggaattcaaccttatcagaatgctaggagacagttaaaagtttacagcaacgggccgggtgctatggcttatgcctgtaatcccagcactttgggagactgaggcgggtggatcacctgagaccaggagttcaagatcagcctgaccaatatggtgaaacgctgtctctacttaaaatacaaaaattagctgggcgtggtggcgtgcgcctgtagtcccagctacttgggaggctggggcaggagaattgcttgaacctggaaggaggggattgcagtgagccaagattgtgccactgcactccagcctgagcgacagagtgacactccatctcaaaaaaaaaaaaaaaaagaaaaagaaaagtttacagcaaccaaatgcttaaccaagagaaaggccactgaagcagctaagatttttgtggtattttagcttaccttagccccatcccctccttagagaagcagtgatcttagagccagcagcttgtgttccctgttcagatacctcgttctagagagagcagagtggaccttgttcctatggaataggatttgatttttttttttttttttttttttttttttttgagactgagtttcgctctttcacccaggctggagtgcaatggtgtgatctcagctcatagcagcctctgcctcccgggttcatgccattctcctgcctcagcctcccaagtagctggaattacaggtgcccgccaccacgcccagataatttttgtatttttagtagagagggggtttcaccatgttggccaggctggtctcaaactcttgacctcaggtgatccacccaccttggccttccaaagtactaggattacaggtgtgagccgccgcgccggcccaggatttgtcttttgaacctaactagggtttctctttgttgtaactaacttggaactctgctaggatagagcagctacacagacttttcctaaaagcaattaagaacaaatgaatgaactgctatgggctgggcaaaacaaacaatcaaaaaaacagctagatcaaacaacagacatgttgaaagcctgagaggaaaatccagagaatgatattttgggggagaataagagctttgaaagttttctatgtttacaggggaatctagaaagccacacacatgccaagagaaggacacatgcttagagaaaaactgggaagaccatgagttttcacctctgcctgatttttagactcagtgcaagcaagaagtggaggtttagacagagttgcaaacagcatggctaagcatagaaggagtgattcaacatagagccaatctgcaaagacctggaaatttttcttttcttttgtactgcttttttccttcccttatttccttttctccaggcatttaaggaaacatctggcaaaccacagtaaaaaaaaaatatggttatgtaagagaaggttctggcttttttttttttttttttttggaggctgagtctcgctctgttgaccatgctagagtgcagtggtgtgatctcggctcaacctctgcctcccaagctcaagcaattcttgtgcctcagcctcctgaatagctgggactacaggcccccaccaccacgcccagctaattttttgtattttagtagagacagggtttcaccatgttgcccagggtggtcttgaactcctgagttcagtcaatccacctgcctcggcctaccaaagtgctaggattgcaggcgtgagccacagtgcccggttggtccttgcttttaagaaaccaacactgggccgggcgcggtggctcacgcctgtaatcccagcactttgggaggctgaggcaggcggattacgaggtcaggagatcgagaccatcctggctagcacggtgaaaccccatctctactaaaaatacaaaaaaaaaaattagccgggcatggtggcaggcgcctgtagtcccagatactcgggaggctgaggcaggagaatggcgtgaacccgtgaggcagagcttgcagtgagccaagatcacaccactgcactccagcctgggtgacagagcaagactctgtctcaaaaaaaaaaaaaaaaaaagaaacgaacactgaaatacagtacttaggagttttcaactttccaacattctaatatttccaatttattgtcagagaagtgaaaaagattcattcctttagcaatcatttcttaggccctactgtgtgatacgtgtggtgggtgggcagagatgtgacctggtcctcctccctgtccttaaggagctcatagactagtagggaacccatccaactaaagcacttgatagtctaaggaccataaggagtatgaacagagctgtgggagctcagcagaggaagaagatcaagaatggctccttaaaagaagtcacataggcctaatgctgtggctcacatctgtaatcccagcactttgggaggccgaggcggatggatcacctgaggtcaggagttttgaggccagcttggccaacatggcaaaactgcctctctactaaaaatacaaaaattagctggacatagtggtgggcacctataatcccagctacacgagaggctgaggcagaagaatggcttgaacctgggagctggaggttgcagtgagccgagctcgtgccactgcactcctgcctgggtgacagagtgagagactccatctcaaaaaaaaaaaaaaaaaaaaagaagtcacataagcaaataagagtgtagaggattttaagagagaaatgggtagaactagctttgattagaagggtgaagaagggccaggcataatggcaggtgcctgtagtcgcagctatttgggaggctgaggtcggaggatcacttgagccaaggaggtcaaggttgtagtgagctaggatctcgccactgcactccatcctaggcaacaggcaagtctctgtctcaagaaaaaaaaaaagaagagtgaaggagagtggttgctaattgttccccaatatccccaccttttagttagtaatggattccccctgaattttttttttttttaattttttgagatggagtctcactctattgcccaggctggagtgcaatggcgcgatcttggctcactgcaacctctacttcctgggttcaagtgattctcctgcctcagcctcctgagtagctgggattacaggcacccactaccacgcccggctaatttttgtgtttttagttgagacggggtttcaccatgttggccaggctgtattcacactcctgacctcaagtgatccacccgtcttggtctcccaaagtgctgcaattacaagcgtgagccactgctcctggccctccccctgagtttagctgagtgcttgccagctgcagctctctcttgcatctaggtatgaccatgagacaatactctggccaaagggaaagtgatgttggcaactttcagatcatgccttaataagaagctgcttgtcctttgctttcccctctttaagatgtatgggaggtgagtcagctctgaccctgtgacaagtgtaacaccatggaggatggcaaagcaacgagatggaagaaatgagtcccagagggcctggggtgacagagtccctgactggccctgtataatctgccagcttagacttttacctgggagaaaaacagaactttttttttttttttgagacggagtttctgtcttgttgcccaggctagagtgcaatggtgcgatcttggctcactgcaacctcctcctcctgggttcaagtgattctcctgcctcagccttctgtgtagctgggattacaggcacccgccaccacacctggctaatttttgtatttttagtagagacagggtttcaccatgttggccaggctggtctcaaactcctgagttcaggtgatccacccgcctcggcctcccaaagtgctgggattacaggcatgagccaccgtgcccagccgagaaaaacagaacttctaccttgaagaagccactgatatttttgtctctgtctggtcaatatcctaactaatgaaaacaggaagaaaaaaaaggcaataagaatataaaacctgttggccaggtgcgggggctcatacctgtaattccagcactttgggaagctgaggcgggcggatcacaaggtcaagagatcgagaccatcctggccaaaatggtgaaaccccatctctactaaaaatacaaaaattagctgggcgtggtggtgcgcgcctgtagtcccagctactcaggaggttgaggcaggagaattgcttgaaccctggaggcagaggttgcagtgagctgagatcatgccactgcactccagcctggcaacagagggactctccatctcaaaaaaactaaataaataaaataaaaaataaaacctgcttagaaaaccaaactctctctctctcttttttttttttttttttttttgaggcagggtctccctctgttgcccaggctggagtgcagtggcacaattatagcttactgcagcctcgacctcctgggcctaaacaatcctcctacttcagcctccggaatagctgggactacaggcacatgccaccacacccagctaattttttaattttgtagagacagggtctcactgtatattgcccaggatggtctacaactcctggcttcaagggatcctcccgcctggacttcccaaaacactaggattacaggcgcaagaggcacgaaccagcagaccaggacttttctctctcggttttccttccctttcttctaacccttcttttcctgtagtctacataaagggacacacacacacacacagatttgctcctcaatattacactggttccaggtttttagcaccagatatatagacagatttatatcttcctgtttttcctgtcaatccagcctcctgtgaaacaggccctaagaatgaaaaccatttcgtccctcaaaagctctctcctggccgggcgcggtggctcacgcctgtaatcccagcactttgggaggctgaggcaggcagatcacaaggtcaggagatcgagaccatcttggctaacacggtgaaaccccgtctctactaaaaacacaaaaaattagccagacgtggtggcgggcgcctgtagtcccacctactcgggaggctgaggcaggagaatggcgtgaacccgggaggcagagcttgccgtgagccaagatcgtgccactgcactccagcctgggcgacagagcgagactctgtctcaaaaaaaaaacaaaaaaaaaccccaaaaaaaagctctctcctagggccaggcgcggtggctcatgcctgtaatcccagcactttgggaggccgaggccagtggatcacaaggtcaggagttcaagaccagcctggcaaatacggtgaaaccctgtctctactaaaaatacaaaaaaattagccacacgtgatggcgcatgcctctaatcccacctacttgggaagctgaggcaggagaattgcttgaactctggaggtggaggttgcagtgagccgagatcacgccactgcactccagcctgggcgacagagtgagactccatctcaaaaaaaaaaccaaacaaaaaaactctctccagggcacagtgaggcagttgacagctggccagacagtggacagacacatctattcactcatagtaggcagaagggtattactttctttgtacaatcgtatttgaagggaatagaggggctgtgttgtccttgggaagctttgtatctttccataaaaggatattttgaggaagtcttaaatgtggagatcacaaatgctttatgctcccttttccatcaaaatttcttccttgtttacattcccttacagggtggaatggataactattgttttggccttcctggtatctgcgcacccttcttttgatagagaatcctgattatactcttaatttcaggctatgtggtttgactggggacgacctggccattactctaggattggatatgtaatctagttctttccaaagctggaactattaggaacaaagctccataatgctggggctactatactagaagaatgtaaggctggagctgctggtatcagcttgccattcggtaggggagcctgtctaagaatgaagtcaacactgagaaacatagacccaagagatagaagccaatcctgataacactgtctgggaagctccttcagtttgagtagagcttctgtcattggaaaccaaatacgttttgactaatccacaggggatataaaaactatttgtcagctctctaaatgacattttggcagatgatatgcctacccagaatttgattaatgtaattaagtttcatcttattccagaaagtattgatggtcccttctagcaagaaggtccctcctttgtgttttattttgctgtaagaaaaaaaggcaggccgggcgtggtggctcacacctgtaatcccagcactttgggaggccgaggcgggcagatcacaaggtcaggagatcaagaccatcctggctaacatggtgaaatcctgtctctaccaaaaataaaaaaaaaatttatccaggtgtggtggcgggcgcctgtagtcccagctactcaggaggctgaggcaggagaatggcgtgaacccaggaggcggagcttgcattgagctgatatcgcaccactgcactccaggctgggcaacagagtgagactccatctcaaaaaaaaaaaaaaaaaaaaaaaagaaaagaaaaaaaggcatcaattggggtttaagtttgttggcattgacagggttccactctatagcccaggctagagggcggtggcacatcacagctcactgcagcttctacctcctgggctcaagggatcgtcctgcttagcctccccagtagctgtgactacaggtgcacaccaccatgcccagctaaaatttttttgtattttttgtagaaatgggagtcttactatgttgccaagctggtcttgaactcctctgctcaagaaattctcctgcctgggcctcccaaagtgctgagattacaggtgtgagccaccgtgtccatccacatttagggtctctggcacatactaacagggagactctgaacaaatctggggaatatatctgaaccttggtttccttatctgtcaaatggatatatgatctaggaagacctctcttccttttcatggcgtgtttttttgtttgtttgtttgtttcctttttttttttttttttttttttgagacagagtctcactctgtcgctcaggctagagtgcagtggcacaatcttggttcactgcaacctccacctcccaggttcaagtgattcttgtgcctcaaccgcctgagtagctggaattttaggtgcacaccaccatgcccagctaatttttttgtttttttgtttttttgtttagtagagataaggtttcaccatgttggccaggctggtcttgaactcctgacctcaagtgatcctcccacctcggcctcccaaagtgctgggattacaggtgtgagccaccgttcctggcctggttctgttttgaaacttggagtggagtggagaagatactgccatattgtcctctaaagatactaatttatggccgggcatagtggctcatgcctgtaatcccagcattttgggaggccaaggcaggcagatcacttgaggtaaggcgtttgagaccagcctggataacatggtgaagccccgtcccgtcactactaaaaatacaaaaaaattacctgggtgtggtgatggctgtctgtaatcccagctactccagaggctgaggcaggagaatcgcttgaacccaggaggcggagattgcaaggagccgaggttgcgccactgtacttcaggctgggtgacagattgagacaacgtctcaaaaaaaaaaattctaatttacatttttacattttccttgtaaatgagagtgcccatttccccacatcctagccaataccaagtattgtcaattttttttccttttccttttctttttcctttccttttccttccttccttttttagcagtctagctgtacagggattaaaatatgccagggatttaatttctctaattacttggaagaccatctgtgccctgctttgatgcaggagtccctgctctgcccagagaaccatgtggtgctctgccaaagccccttttctccaggctttcctactcctcatcccctaccaattggctatgggatcacttttgtcagagagtaggactgggagatggagctctagacagaaatcctccccacacagctgtgcccctgatactctggggacggacaatcacagaggaccatttgacatcagccaccagtggtcaccagccaatttccaagagctgcatctgggcggaaacctactgtggctgaaggagtaaagtgccccccatgctcaccatggagacttttgcagttttatctcccttcagcagacctgacttgagttcaaggctgagtcatcagggtgagcatgggagtatttttcttatgcttaaatacaggttaatgacattatagcagaattctagtaaagagggcatgtttatccagttaaaatttattcttggctgggtgcagtggatcacgcctgtaatcccagcattttgggaggctgaggtgggcggatcacttgaggtcaggagtttgagaccagcctggccaacatggtaaaacctcaactgtactaaaagaaatacaaaaattagccgggtgtggtggcacatgcctgtaatcacagctacatgggaggctgaggctggagaatctcttgaacccaggcgtcagaggttgcagtgagccaagatcatgccactgcactccagcctgggcaacacagtgagactcaaaaacaacaacaacaacagcaacaaaaattattctctataatgaaaagccacaagcaaaaattggtttttcagtttcctatttactgtctagaatgagacagacttattacaggctgtttgggaagaggagaaagttgatttaagttattgtatccaattatttttatttttattttttttttttgagacggagtctcgctctgtcgcccaggctggagtgcggtggcgcgatatcggctcactgtaacctccacatcccgggttcacgccattctcctgcttcagcctcccaagtagctgggactacaggcgcccagcaccacgctcagctaatttttgtatttttagtggagacagggtttcactgtgttagccgggatggtctcaatctcctgaccttgtgatccacccgcctcagcctcccaaagtgttgggattacaggcgtgaccgtcctgcatccttttattgttagccattgagcagcaatttcccttcaatttcatctacccctcctcaactctctgaagaatctgagagacaaataaaagagagctaaagatgagggccagaggagaaaaagaaaaaggttgcctcaaaaagtggctcgcttttcttatcaatgtctttttcttgtctatcattatcgattccacccagcaatttctctgcctgatctgcagcccacctccttatctgcagacatccagagtgccccttctttgccggagtaagtcatgtacctcagttgagagctcccgttgggacataaagtccatgaattcagtgaggccttgctcttctctgtgatcagcacagaactcagctcttggccttgccagtagcagcagcagtcagaggtaaaggggccttgggggagaagtgattctgactcctttattatgtaggtgaggagactgagactaccccttctctcatcaagaagggaaggcatctttgggcctcagtggcaaaaaggtcaggagagtgggtagtggggtgctgttgtttggagcacccagttttggagtcagaccgacttgggttgaaagccagtgatcctgagtaataacttccactctctaaacgtgtttccttcgttgcaaattggggttaataatgttgtgttccttacagaactattaagagaattcaatgcacagagacatataaaatactacgcttggaacaaaagaagtattttaaaagtcgttaatattatgcatttcattttttttcctttttttccccttctaatcaatgtcagaaaaattaaggaaataggaagtcacttccaagggagctctggctgctctgcaaacctgttagttagctatgagatccaagctactcaggagacccagagcaagttgttacttctttctactgattgggaaactgaagaatagaagaaatgtaattgtctgccttgcctaatggcatggtgtaaaataataagaaatatgcaaattggtctttgaccatggttcctgtctgacacagagcttctaagaactgtataattttctgagagattggagcttctgatacagagctcctaagtctcttgtaatttcagttgatagaagtacattttgtgctgaagcaactctgtgagctcctggatgggggctaaccaccagaaagaccaagtcataatttgaagcttggaacttttacccttacctcccattttctggagaggagagagggctggaaatggcattaataatcagtcatggccaggcacagtggctcacgcctgtaatcccaacactttgggaggccaaggtgggcagatcacttgaggtcaggagttctagactagcctggacaacatatcgctactaaaccctgtctctactaaaaatagcaaaaaacagaaaaataaaattagctgggtgtggtggtgtgagtctgtagtcccagttactcaggagggtgaggcaggagaatcacttgaacccgagaggtggaggttgcagtgagccaagattgcaccactgcactccagcttgggcaacagagcgagactccgtctcaaaaaaaaaaaaaaaaattagccatgcgtggtggcaggtgtctgtaatcccagttactcaggaggctgaggcaggagaatcacttgaacccgggaggcggaggttgcagtgagccgagatcgcgccattgcactccagcttgtgctacaagagcaagactccatctcaaaagaaaaaaaatcccggccgggtgtggtggctcactcctgtaatccctgcactgtgggaggccgaggcaggcggatcatgaggttaggagattgagaccatcctggccaacatagtgaatcccatccctactaaaaatacaaaaattagctgagcatggtgttgcatgcctgcagtcccagctacttgggaggctgaggcaggagaattgcttgaacccgggaggcggaggttgcagtgagccgagatcatgccactgcactgcagcctgggcgacagagcaagactacgtctcaaaacaacaacaacaacaacaacaacaaaaccaaaggtacagtttttgggttggggaacacatccatgtgctgggaggatggtacataccaactccacagggacagaaacacccgtgctcaggacctttcaagaccttgtcctatgtatctcttcatgtgtctgtccatctgtaccctttgtaatatcctttgtaataaaccgatagatgtaataaaatgtttccctgagttctgtgagcctccctagcaagttaagtaggagggagtcatgggaactcccaatttatagccagaagttctggaggcccaaacttgcaactggcatctgaggagcagggcagtctggtgggactgagcccttaaggtgtgggatctaattctaacttcatgtagatagtgtcagaattgaactgaattatatgacacccagttggtgtccactggagaactgcctggtgtacaggagaaaaaaaccccacacatcttgttacagaagtgttctatgttaagagtatagtaggagaaaacagttcgtttagtttatttttcctactacacacatggtgtaacagaaaaagcatgggttttgaaagtaggattttgaactgagttcaaatgctggctatgctgccaagttgctttgtgatcttggataagttacagaacctctctgagcctttctccgagatgttaatacctactacatagggttattatgaagagtaaatgaaatgatgtatgtgtatgccaaacacatgtgaagttgtgaaatctatttttttttttttttttgcctattctagaatctaatttttcctttttctggtagcataatttgattttttctttagggaagtgcctttcctcttctgcacactctaatgctaaaactgtcagtcaagattccctacttctccagccaagtggtcatattacccaagttaggctagccagacccttgttgcctgtaattcgaatccttttgggggtgaaatggagatggaaaatggctggagctgattcatcccaggtgtcattctgaaaagactatctaatagtttttgccatctagatctctgtagctacctggttcttgtcttttactttttaaaattaatttattttagatacagggtttcactatgttacccagcctagagtgtagtggcttttcacaggtatgattatggaacactgcagccttgaattccttgtctcaagcagtccttccacctcagcctcccaagtagctgaaactactgacttgtgccgctgcacacagcttaaaccaataatttcatttactttattttttattctttaaaaattttttaaccaataattctaaaaaattaaatttaacattgtaatgattttagaaaagcggtaattgctttagaaacaagtcaacatttctttttaattttagtcagttcaagtcatgttagtctatggattttagtcaatgatttttttccctttcaagttttttatgctgaagtgttttaaaataactgtagacattcttaactctcgtaaattacatagtcaaaaagatttaattcctaatttctactcaaatttctccaactgtaccaaaaattacttatacatgcattctgtccaaactaggatccaaccacagatgacacttcaaatcttagaatccaggtgctatgttccttaagcctcttttaatgtaaaagaggtttttttagacttttttttttttttttttgagacggagtctcactctgtcactaggctggagtgcagtggcgcgatcttggcttactgcaagtgattctcctgcttcagcctcccaagtagctgggactacaggtgcacgccaccacacccagctaatttttgtatttttagtagagacggggtttcaccatgttggccaggatggtctcgatctcttgaccttgtgatctgcccgccttggccccccaaagtgctgggattacaagtgtgagccaccgtgcctggcttttttttctttttgagatggagtctcattcttttgcccaggctggagtgcagtaccacaatattagctcactgcaaactcagcctcctgagttcaagtgattctcctgcctcagcctcctgagtagctgggattacaagcacgcaccaccacacctggctaacatggagaaaccccatctctactaaaaatacaaaattagctggacgtggtggcacatgcctgtaatcccagctacttgggaggctgaggcaggagaatcacttgaacccaggaggcagaggttgcagtgagccaagattgtgccattgcacttcagcctgggcaacaagagcaaaactccgtcttaaaaaaaaaaaaaaaaggaccacaaacaaaaaaattcccccccatttttaaaagacttaaatacacactaacataatctctaatacctgatgtctgcattcctaggatgaccttagcctagccccacctgctggcttaaagtgtctgcccaaggaagctaaaaaagcagcacctacagataggttcctgaccaccatttcttagagcatttacttaaaagggcttagaattgtggatccttcctctgtgcctttgaaagatatatgtatctcccataatttaggagtgtctttctcaaggacctgaaagctattccattgaaatgtaatcattggaaaggatagggcctctgtcccctagtctctctgggaggatagaattctaactcgttaattgccaattaacagacaaaggtggcctaattggcatttacaccaaccaaccctttgtaatttttcctgactcagcgccctctgttctatcccacaactcagtctttgtctttattttttaatttattattattattatttttgagacagagtcttcctgtgtcacccaggctggagtgcagtggcgtgatcttggctcactgcaacctccgcctcccgggttcaagtgattttcctgcctcagcctcctgagtagctgggtgtaccacgccaagctaatttttgtattttcagtagagatggggttttgccacgttggccagctagtcttgaactcctgacctcaaacgatccacccacctcaccctcccaaagtgctgggattacaggcatgagccaccgcgcctgaccaattttttttttttttttttgagacggagtctggcactgtcacccaggctggagtgcagtggcgcaatcgcagctcactgcaacctccacctcgcgggttcaagcaattcttctgcctcagcctcctgagtagctgggattacaggtgcctaccaccatgcccaggtaaatttttgtatttttagtagagatggggtttcactatgttggccaggcgggtcttgatctgctgaccttgtgatccacctgcctcggtctcccaaagtgctgggattacaggcgtgagccaccatgcccggcaaaccgattatttttatttatttatttttttgagacggagtttcactcttgttgcccacgctggagtgcaatggcacgatctcggctcactgcaacctctgcctcccaggttcaggcgattctcctgccttagtctcctgagtagctgggattacaggcacccgccaccatgcctggctaaatttttgtatttttagtagagatggggtttcaccatgttggccatggtggtctcgaactcctgacctcaggtgatccacctgccttggcctcccaaaatgctgggattacaggtgtgtgccaccccacctggcctaaatgttttttttaagcccacaactaacatcatatgtctttctctctttataaggcctagttacctctaaaaatggaagctgagtttagttcatactgcaccctcttccctattgcaaaggaatattactgatgaataggtgtccttaccactgtaactagtttatttgtttatctttgacaagcatgttgaccagcgttatggaatttcactctatttacatgtggcttagtgttcggcatcagactcagtgggaccacaatacatttctgatcctctttttcatatagctcttctctggcaaaattgcccccaaaatcccagctgccttagtttcctcaaacttgatctctgcttcctcaccccatgaacactgctatgttctgcttggatttcctcaccctgagcagaagcctagaaactgtctacaggcagaaagccaaagtgtttttaggctcatcttacttgcttttttcttctctcagggaacagagtcctgtactccttgtccagtgtctgagaataggtatttcatataaatttgtctacttttctcattctttatcaccagagggcaagtccagtaccaactattagaggaacttaggatttcatttttgaaaaacttttaataattaatttaattgggttggagtaaagaaagggggaaaaaatgaaggtggacaccataagacttaaaaggtaaatggcaaggagagatctttttaaatacatttaacagaaggataatgtatggaatatgccagctccttcaaatatataagaaaaaaggaaacaacccagtggtaaaatgggcagaggataataacaagcaattcacaaatggtcaataaacacaagaaatatacagcataaggaaatacaaattaaaatccaatgaaaaaccattcattggcttggtaggatggctcacgcttgtaaccctgtgctttgggaggtcaaggtgggaggatcacttgaattcaggagtttgaggccagcctgggcaacatagcaagatccctgtctctacaaaaaactaaaaaattagctgggcatggtggtgcatgcctgtagtcacagctactctggaggctgaggcagaaggatcacttaagtcccagaatttgaggctgcagaaagttatgattgggccagtacacaccagcctcagcgacagagcaagactctgtctctctctctctttttttttttttagcaaaatcaaaaaaattttaaatgtcggcaagaatacagcaaaacagctaccttcatacactttggttccagtgtaaagaaatctgtttgacacgcaatttggagaaatggggaagctgtggtgaatgggaattcatggccctggacctacaaaaagcctgcattcctgccagtatggctactttgttcatgtgcgcactgtgcctgctctgggggggttaatgacacaggctatcatcaactagctgagtcattttgtttacttggctgttcagtgcctcttatgtggtgcattctctctggtatgccttaacatgttgttacgaactgaattgtgccccgcccctccaagttcttatgttgaagtcctaaccaccccacttacctcagaatgtgactgtatttggagaaagggcctttaagtaggtgattaaagatcctaatgcaatctgactggaggccttataaggaagaaatctggacacacagagataccagagacgtgagtgcacagagaaaaggcatagagttgaggatacagtgagaaggcgaaagctaaggagagaggcctgagaagaaaccaaacctcctgacaccttgaccttggacttctggcctccagaactgtgagaaaatagatttacattgtttaatccatccagtctatagtattttgttatggcaaccctagcaaacaaatacacatgtgatacaaagatcttcatactcatgccccttcctatatgttcacttggaattctttgtccttagatctccttattcccaatgtttccagtctttctcattcaaggcctctaaccaaccaaccagtcactcaccactatccatgattctgaatatatcctaacctcaggctacttttattcaccaaaattagatggtgcatttgccaaagcttcccagttaggaggattgcttcttaacaccttgtctttcagggtcctcactatgtcctattttctgcttgcgttttctcacccaccgagccaacctcctctgttagctggccacaagagcatatatggcaatagatataagctaagaggtgctaaggtaagagcagtagatgactgggggctcgtgccacctgcagcttatacactttagctgtatttgtgtctgctcctgaatgtaccacttctgcattgcgacagattgctgctggcccatccaccttatgatgtggtgagtctgagaaacaaaacttttttttttttttgagacagaatctcactctgttgcccaggctggagtgcaatggtgcaatcttggctcactgcaaccttcacctcccaggttcaagcgattctcgtgcctcagcctcccaagtacctggaattacaggcatgtgccaccacgcccggctaattttttgtatttttaatagagatggggtttcaccatgttggccaggctggtcttgaactcctagtcttaagcaatccacccgcctgggtctcccaaagtgctgggattacaggtttgagccaccacaccggcctgagaaacagaatttatgaaggattgtattgtccatgtggttgatgtcctacagtcaggcacttcatctttgccatggtcagatgctgattattttattttttgagacagagcctcactctgtcacccaggctggagtgcaggggagcaatctcagctcactgcaacctccacctcccaggttcaagcaattctcatgcctcagcctcctgagtagctggaattacatgtacacgccaccacgcctggctaatttttgtatttgtagtagagatggggtttcaccatgttggtcaggctggtcttgaactcctgatctcaaatgatccacctgccctgcctcaacctcccaaagtgttaggattacagacgtgagccacctcgcccagcctcattttttaaaaaatttgtaattatctgctgcagatatcatagccttactgtggaaccctaggggtctaggttgtgattctcttatcggagcttgtcagaaactccacatgatgccttttgccactgtcttagtgtgtttgttctgctttaataaaatacctgagattgggtaatttataaagaacagaaatttatttcccacagttctggaagctgggaggtccaagatcatggagccagcgtgtctggtgtctggtgagggttgctgtctgattccaagatgatgcctcttgctatgtcctcacatggtgaaaggaggaagggcaaaaaggactgaacactgtgaagcttcttttataagggtcttaatcccatttatgagggaggagacctcatgacttaattatctcctaaaggccccactccctggagattaagtttcaatgtaaattttgtagggacacaaacattcagactatagcagccaccaccataggttctgctgggttctatggttcaaacagtaggaccatttgcatcccagcctggagctgctgctgagcacgtcacttatcctggacccactcgaagctggcagccttttgtgtcacccagtatatggattagagtgatattcccaagtaaggactaatactctgcctccagaacaaagacaccttagttgagagtgtggggaatgagagatgcaatattgtaatttgtcttttactttgaagggaatgtcccagcatttcccaaactactagactacccaaaacttaactgttagccgggcgcggtggctcacacctgtaatcccagcactttgggaggccgaggcgggtggatcacctgaggtcaggagttcaagaccagcctggccaacatgatgaaaccctgtctctactaaaaacacaaaaattagccaggcatggtgcactcctgtaatcccagctacttgggaagctgaggcaggagaatcgcttgaacccgggaggcagaggttgcagtgagccgagatggccccactccactccagcctgggcgacagagtgagactctgtctcgaaaaaaccaaaacagacaaaaaaaaaaaaaacttaactgttgtggtggacctttgagccttcataaagttgatctcccacatttgaaagcacatatatctttaaaagacttccaatgaatttgccattttttacacatccagtctgattacttttctgtcctccataccggcaacaatgtgatgttctgtggtgtatccagatgattaaagtcccttcagaatatatatatattctctaggccaggcacagtggctcatgcctgtaatcccagcatttggggaggccgaggtgggaaggaatcgcttgagtccaggagttcaagaccagcctaggcaagagagcgagaccccatcactattttttttttttttaaatagaggccgaggcagggcaggtgagatcaggagttcaagaccagccagaccaacatggtgaaaccctatctatctatctatctatctatctatctatctatctatctatctaccaattttgagacagggtcttgctctgttaaccaggctagagtacagtggcatgatcatagctcacagcaaccttgacttcctgggctcaggtgattctcctacctcagcctccctagtagctagctatggactcccaagtagcctccaagtagctgggcccataccaccatgcctggctaatttttaatttttttttttttttgtagtgacagggttttgccatgttgtccaggctggccttgaattcctgggctcaagtgatcctcctgcctcggcctcccaaattgctgagattacaagcatgagccacacacagcctcagaatatattataatagtgggcatgaaattaacatagctctgggccaagactatatatgtatgctactgtccattccaagtgacagttaactgtttctgatcctcctttagagatggaaaagaatgcctttaccagattaatggtcacatatcacacataccatgtatttgaggtaacgttaatctgctttagcaaagatactaaatctggcacctgcaattgcagctactacttttttgagtgtgtcatagtctactggacatcctccagaatctatctaggattctgttgaaccaaaagaaattatgatagggactattacctctgcatctttttttttttttttttttttttttttgagatggagtctcgctctgttgcccaggctggagtgctgtggcgccaactcggctcactgcaagctccgcctcccaggttcacaccattctcctgcctcagcctccagagtagctgggactataggcgcccgccaccacgcatagctaatttttttttttcgtatttttattagagacggggtttcaccgtgttagccaggatggtctcaatctcctgaccttgtgatccgcctgccttggccttacctctgcatctcttaaatcattaagagtaccattgatctctttcactacccataagatgcaatcttgtttttgattgctatcttgctggggtagggagaagtttcagaggcttctatttggtctttctcatgacgttagcacttacctcacaggtcatagggccaatgtgttagttcttttaacagccaagtatgttgattttattcatgtatttggcaaccagggacataaccactgggtgtgtctgtgtgcacagtagattccctgtgaactgaacctgggccaggactcatttatttatttatttatttatttatttatttatttatttatttatgagacggagtctcattctgtcgccaggctggagtgcagtggcatgatctcggctcattgcaacctccgcctcccgggttcaagcaattctcctgcctcagcctcccaagtagctgggactatagacacgcaccaccacgtctagctaatttttgtatttttagtaggcactgggcttcactgtgttggccaggatggtctcaatctcctgacctcaggtgatccatctgtctcggcctcccagagtgctgggattacaggtgtgagccactgctcctggccaggagtccatttattacagggtctccatatgccccaactctaaaggggggatcctgaggatgctttgagtcccatactggtatcaatttcatttcagaccttgtgtccaacagtccttgtattgcttgggtaatattgctctttccactgcgtttgggggcccaaacaaatactagtggacctttttgaggaaggactggaggaatcattgccaaatacatttattagagtgtcacggggtcctccttctggagacctggcagctgcttcagtcactgggttgcaggtctgaagactggttgtgatccagaagctgagcaatgaatcatgactcagcttcttgatcatctagcctgggttccttttaattgtctaggttgagtaatatccttgttggccatctcacctttaagaacatcatgaactattagccatctccatcgctctctgcaggtcaggaccctctggctgctgttccaacttcatagatcattgtaattgcaactatttgcttctgatggttacatgctgctctctggcctctattattttaagatactattattcccattgctatcaaggtgccctgttctgaaaccacaagggcagctaccactgagcttctcagtaataccaatatcacttttctttttttgagacaggggctcactctgtcacccaggctggagtgcagtagcatgatctcggcttgctgcaacctctgtccacccctaggcacaattgatcctcccatcttagcttcctgagtagttgagaccacaagcatgtaccaccatgcctggctattttttctgtatttttagtagagatggggtctcactgtattgcttaggctggtcttgaactcctgagcttaagtgatccacccaccttggcctcccaaagggctgagattacaggtgtgagccaccgtgcccagcccctccaatgtcactttcatcagagaattccttggagctcttctgtggaaaagtcatttggtaagtttcctggttttacacggtatatccattctaactttcctcttcttttagtcttttgatccctacttgcaccatctcctatagcagttctgatatttctttttttttttttttttctgagatggaattttgctgtttttgcccaggctggagtgcaatggtgcaatctcggctcactgcaacctccacctcccaggttcaagcgattctcctgccttagcctcctgagtagctgggattacaagtgcctgccaccacgcctggctaatttttgtatttttagtagagatggggtttcaccttgttggccaggcttgaactcctgacctcaggtggtccacccgcctcagcctccgaaagtgctaggattataggcatgagccactgtacccggcctctttttttttttttttttttttttgagacagagtctcactctgtcacccaggctgcagtgcagtggtgtgatctcggcttactgcaacctcaccctcctgggttcaagcaattctcctgcctcagcctcccaagtagctgggattacaggtgcaagccactactccccattaattttttgtttgtttgttgttgtttgttcgcttgagacagagtctcactcttgttgcccaggctggagtgcaatggcgtgatctcgtctcacagcaagctctgcctcctgggttgaggtgattctcctgcctcagcctccccagtagctgggattacaggtatgcgccaccttgcccagataattttttttgtatttttagtagagacgaggtttccccatgttggccaggctggtcccaaattcctgacctcaggtgatccacctacctcagcctcccaaagcgctgggataagaggcataagccaccacgctcggtctaatttttgtatttttatttgtttgtttttttttttttttttttgagacagagtttcgctctgtcgcctaggcagacagagtgcagtggcgcgatcttggctcattgcaagctctgcttcccgggtccacgccattctcctgcctcagcctcccgagtagctgggactacaggcacctgccacggcgcccggctaattttctgtatttttagtagaggtgaggtttcaccgtgtcagccaggatagtctcaatctcctgacctcttgatccacccacctcggcctcccaaagtgctgggattacaggcgtgagccaccgcgcccagcctaatttttgtatttttagtagagatggggtttcaccatgttggccaggctggtctcaaactcctcaagtgatccacccaccttagcttcccaaagagctggtattagaggtatgagctgcccggtctgatatttctatttatttattacagcccatcactttctctaagctcataagacccatcctaagaatatgttagcactatttctcagggtccttgtcagggtgttaaatcctgtgttccaagttgataacctctccctattttggttgagaattggaatcctcagaatccagtcccatgaatattctcctgccatttgtcagtacatattggttatgttctacagctcctttagctatagtctctttcctccttcggcatgtcctggtcattcatgttgttatttaattttagttattggtccaatgattaggttgggactttaaagtagatccagatggcaaggcacctatctttttttttttttttttttttttgagacaggatcttgctctgtcacccaggctggagtgcagtggcgcaatttcggctcactacagcctcgacctcccatgttcaagtgattatccggcttctgcctcctgagtagctgggattacaggtgcacaccaccatgcccaggtaaacaggcacctgtcttgtaaggcaggtatttttacattgtcttcaagcaaggaggaatgctaagctttaacaaagaggaatgggcaatgtgttgggtccttcttgcgctgctctaaagaaatacctggcagggaggagggagagcatcacgaagaatagctaatggatgctgggcttaatacctaggtgataggatgatctgtgcagcaaaccaccacagcacacgtttatctatgtaacaaacctgcatatccagcgcatgtacccctgaacttaaaaaaaaaaaagaaatacctgacactgaataatttacaagaaaagatgtttaggccgggcatggtggctcatgcctgtaatcccagcactttgggcggccgaggtgggtggatcacgaggtcaggagatcgagaccatcctggctaacatggtgaaaccccgcctctactaaaaatacaaaaaattagccgggcctggtggcgggagcctgtagtcccagctacttgggaggctgaggcaggagaatggtgtgaacccaggaggtggagcttgcagtgaatcgagattgcaccactgcactccagcctgggtgacagagcgagactccatctcaaaaaaaaaaaaaaaaaaagatgtttaatggctcatggttatgcaggctgtacaggaagcatagcagcatctgttctggggaggcctcaggaagcttccaatcatggcataaggcaaagggggagcagggacatcacatggctagaatggaaacaagagaaagagaaagtggcggcgaggtgcacacacttttaaatgaccagctctcatgagaactcactatcacgaagactgcacccaccaagccatgagggatccaccctcatgatacaaacacctcccagcaggcccctcctccagcattggggattacaattcaacatgagatttgggtggggacaaatatctaaactacatccggccacttgcgaaggcccagaggtacaggaaagactggaagttaatgattgttcaagtatgtcgacccagatattgccatcccatgtctcccatcttcttctttctttcttttgagacagggtcccactctgtcacccatgctggagtgcagtggagtgattgaggctcactgcagccttgacctcctgggctgaatcagtcctcccaccttagtctcccaggtagctggaaccacacgtgcatgccaccatgccctggtaattttttgtaaagacagggtttcaccatgttgctcaggctagtcttgaactcttgggctcaagtgattctccagctttggcctcccaaagtgctaggattacaggcatgagccaccatgcctggcctcccatttttgctctttctcagtcaggactctaaccttggtagctaacctttcagggctgagaattcaacctctctagagctctgcaaattttataattatgttttaggtctgatcctcaggtttttctgccctttggctgtaggagatgatagtatctttatatactgccaagaaggcccttcgactttcacacttaatcttcattgtctttcttcaaaggatctattatccccaacaacaaacatcctattacttctcaaatgcctaatacatgtgttcctccaccctcccatgtattctttccttgggtaaaacatctccattaaccactgctgaaatttttaacaactgtattactatcacatgctaggggctaacagtgtttcacctatcactagtgatgatatcctcattgtcaaccgactgctgagtgactcccaaatttcattttagggtttactttcttggatcactcctggtaccaattattgtaaattgggttccccaggaagcagagaagcagagatttgaatccagaaagtttactgaagagtgcttttaggatcaccatccttgggagagtgaaagaagcaaggttaggttgcagggcattcacaaaaaagtctcagtcaattccatgcagagcactggacctaagatagccctgtaaaactttccctcactggggccagggtaacggggtctttataaccctgtactaatcagtctttgaatgtgggttaccatgggcatgactttaaatgaggcagctcttctcagccaaggttgtgtggggtgcttttttttttttttttttttgagatggagtcttgctcttttgcccaggccggagtgcagtggcgcgatctcggctcactgcaagctctgcctcccgggttcagccattctcctgcctcagcctcctgagtagctgggactacaggcgcccgccactgcgcccggctaattttttgtagttttagtagagacggggtttcactgtgttagccacgatggtctcgatctcctgacctcgtgatccacctgccttggcctcccaaagtgctgggattacaggtgtgagtcactgtgccgggccttttttttttttttttttttttttgagacagagtttcactcttgttgcccaggctggagtgcaatggcgcaatcttgcctcactgcaacctctgccttgcgggttcaagcgattctcctacctcaggctcccgagtagctgggattacaggcgcccaccaccacgcctggctaatttttctgtatattttgtggagacggggtttcaccatgttggccatgctgctctccagctcctgacctcaggtgattcgcccgcctcagcctcccaaagtgctgggattacaggcatgagccaccgcgcctggcctaattttgtatttttttgtagagatggggtttctccattttggtcaggctggtctcaaactcccgacctcaggtgatctgcctgcctcggcctcccaaagtgctgggattacaggtgcgagctaccgcgcacggcagggttgtgtggggtgcttaactgccagctgacagcccttaacattcccagcagctgggagagtaagggtttcagcagttcagaagaggagagatctgaggagcacaccacacacaccacaacatccctaaaatacactttctttttttttctcttcctttttttttttgagacagagtgtcactctgttgcccaggttaaagtgcagtagtgtgatcccagctcactgcagcctcgacctcctgggctcaaccgattctcccacctcagcttcccgagtagctgggactacaggtatgtgtaaccatgcccggctaattttttgtatttttgtagagtcgggaatcttactatattgctcaggctggtctcgaactcctgtgtcaagtaatctgcctgccttggcttcccaaggtgctgggattacaggtgtgagccactgcacctggatctaaaatacactttctagtgtctgaatcatttacaatgggaaagaattcatgtgttttgtgtaaaaaaatgtttttaagaaaactcaagtaaggcaacataatgagacttcatcttcacaattttttttgtttgtttcgctcttgttgcccaggctggagtgcaatggcgtgatctcggctcactgcaacctctgcctcctgggttcaggcgattctcctgcctcggcctccccagtagctgggattacaggcatgtgccaccacgcccagctaattttgtatttttagtagagatagggtttctccacgttggtcaggctggtctcgaactcctgacatcaggtgatccaccctactcggccttccaaagtgctgggattacaggcgtgagccactgcgcctggccagaattattattatcattattttttaattagctggatgtggcagcacatgtctgtagttccagctatttgggatgctaaggcaggagaattgcttaagggcaggaggttaaggctgcagtgagctgtgatcatgccactgcactccagcctgggtgacagaacacgaccctatctcaaaaaataaatacaaataaaaagagaaatctagaatggtaactccaaaccttggattcacacagcagcaaatcacactttgctgacctggcacaggattcacttgtccatgtgcccacacttaactgtgtatactgacatttcattatttttgggcaaaggagccttttcaatctaacactatcttggaaatggaagaaaacatctgggattcactccgataggagaaccaaagcaaaactataaacaccatctgtcaatttttccttccaaaggagcctttccaaatttctgggagtttcctttgccaactccttgtcacagcagctccagaagcaactgaagccactgaagtttcccatgatgttctgggctaggaaactggtgtcctagggcttcctgctgcacagatgcacatcctcaaaggatgattctaccctccttccataggtgccagtctcttcctcctcaagcaagaaagccaagtatggatgtgtcctttatactctgtacaaaagtgcctggctcagggaccagggaggactgaaatccagctgcactcagcttgccaagctgtatatcctggcactgcaacctcttagggagggtgccttttcctatcatgcacaaaggtacagtttagcctagtggcaggccttgtccctgagctcactgatatgatttaactctattgtaattgtgtgtcttacaagtttgtcttcctcctgagagttttgatggctgaagcctggtcttgtttaacctttgctcccactgcagcacagagcttggtgtatagtagacctaagtacattaattagctgaatgaattactatgcacagaggtcttctggcccactgccacaacagtctactaaccccattttaaaaagcttaataaaattatcttttactattttacaagataactttttgctatgcttcctgctgtgtttttttttttttttctctaaattttctcctgcttttcgtatctggttctccatctctcttattctttttttttttttttgagtctcgctctgttgcccaggctggagtgtagtggcatgatctcagcccactgcaacctctgtctcttgggttcaagcaattctcctgcctcagtctcccaagtagctgggactacaggcatgcaccaccacgcccagctaatttttttgtatttttagtagagatggggtttcaccatgttggccaggctggtctcaaactcctgacctcaggtgatccacctatcttggcctcccaaagtgctaggattacaggtgtgagccaccacacctggcccctttcattaagtctttgaactaccaaattatttttatttttttatttttttttgagacagagtctcgctgtcgcccaggttgggatgaagtggcatgatcttggctcactgcaagctctgcctcccgggttggcaccattctcctgcctcagcctcccaagtagctgggactacaggcacccaccaccgctcctggctaattttttgtatttttagtagagacggggtttcactgtgttagccaggatggtctcgatctcctgacctcgtgatcctcccacctcagcctcccaaagtgctgggattacaggcgtgagccactgcacctagcctagcaaatcactttttagaggctggtcattgcatctttgttctcggactcattctctgttcttcttctgaaaactacatttcccagcttctttgacaaccacatactagctatattcagccaatgggaggcactggaagaagactggaggtgagaggaagaagaagccagggcagttcttcctcttccggctatggggcatttcccagcagtggctgcatcgcttctgtgtggtttccacttccccttcttcttctcctttttttttttttttttttttttgagacagagtgtcgctctgtcgcccaggctggagtgcagcagcatgatctcagcttactgcaactttcatctcccgggttcaagcttttctcctgtctcagcctcctgagtagctgggattagaggtgcgcgccaccaggcctggctaattttttttttttttgtatttttggtagagacgggttttggccaagctggtctcgaactcctgacctcaagtgatctgcccaccttggcctcccaaagtcggcctcccaaagtcagcctcccaaagtgctggaattacaggcgtgagccactgcgcctggccgcccctccttctttagtcccaagttctgctgcccgccccactccagccaaatcctatttcctccacagccacaaataataatttagtgtgtgtcctttcagtttttcatccatgcttatatatacacacacatatatatacacatatacacacacacatatatatacacacatatatacacatatatatacatacacacatatatagattatctctacacattttttttttgcaaaaataaataccatatgcattattctgcaacttgctttttactccacaatatactgctgtaactgcgatagttactgccaaattgctccacgaaaagattctaccaatttatactgttgtcagcagtgtatgagaatgcttattttgctagacacggtggctcatgcctaatcccagcactttgggaggtcaaggtgggaggattgcttgagaccaggagcttgagaccagcctgtgcaccatagagagactgtttctttaaaaaaaaaaaaaaaaaagtttatccatctatgcaccattggatacactttatttatttatttttttgagacaaagtcttgctctgtcgcccaggctggagtgcagtggtgctatcttggctcactgcaacctctgcctcctgggttcaagcgattctcctgcctcagcctcccaaatgctgggattacaggtgcacaccactacgccggctaatttttgtatttttagtagacacaggattttgccatgttggccaggctgatctcgaactcccaacctcaggtggtccacccgccttggcctcccaaagtgctgggattacaggtgtgagccaccatgcccggctggatatacttttttattaaataattttttttaatcaattaagatggggggctgagcatggtagctcgtgcatggaattccagcactttgggaggccacggcagcaggatcacttggggccaagagtttgagaccagcctggtcaatatagcgagatcctgactctacaaaaaagaaaaaaaaatggctgggtgccatggctcatgcccatagtcttagcactttggtaagccgaggctggcagattgcttgagctcaggagtttgagaccagcctgggcaacatggtgaaaccctgtctctaccaaaaatacacaaaattggtcaggcatggtggtatgtgcttgtggtcccagctactctggagatggaggtgggaggatctcttgagcctgggaggcagaggttgcagtgagctgagatcacgccactgcactccagcctgggtgacagaagactgaaaccctgtctcaaaaaaaaaaaaaaaaaccacaagctgggtgcgctggctcatacctataatctcagcacttcaggaggggtgggaggtggatcacttgaggccaggagttcaagaccagcctagccaacatggagaaatcccatctctaccaaaaatataaaaaaaaagcggtgcatggtggcacatgcctgtaatcccagctacttggaagcctgaggcaggggaatcatttgaacccgggaggcagaggttgcagtgagccgagattgtgtcactgcactccagcctggatgacagagcgagactacatttcaaaagaaaacaacacaaacaaacaaaacttaaataaaataaaataaaataaaaattagccaggtatggtggcatgtacctgccagtcccagctatccgggaggctgaggcgggacgatcccttaagtccagaagttcgaagctgcagtgatctatgattgcaccactgcactccagcctgggtgacagaacaaggcctgttgcccaggatggactcaaactcctggcctcactcccgcctcagcctcccaaagtgctgagattataggcatgagccactgcatcagacccagcattggatatacttgatcttttcagcttttgccaatttgttaggtaaaaattagagccttgtttcatttttaaacattatcagcccggtgcggtggctcacgcctgtaatcccagcactttaggaggccgaggtggggaggatcatgaggtcgggagtttgagaccagcctgaacaacatggtgaaaccccatctctactaaaaatacaaaaactagccgaatgtggtggtgcatgcctgtaatcccagctattcaggaggctgaggcaggagaatcgcttgaacccaggaggcagaggttgtagtgagccgagattgtgcctttgcactccagcctgggcgacaaagtgagactctgtctcaaaaaaaaaaaaaaattatcagtgatattgaccattttctcatacgttcactagctatttgtatttcttctttggctaattgcctcttgcaaactatacacacttttttttaattgaatcattccatttttcacactgatttgtaaaattatttgtatactgggaaaactaactttttctgttatataggttacaaatattttcttccagtttatcttttcactttgtgtttggggtcttttgccatcatcaaatctgtcaactatttccttcatggcttctgcatttggtgttatgattagacaagttctttccatcccataactcagaaaatattcttctatattctcttttaatattttattgtacctttttgtgtttgtgtattcatctggtggaatggaaaattatctatatcatggtcatcaggataattgcatctttatatgatggtcatcacatcgttcttagaattgagagaagcctcagaggttacccagatatctgagtccttcgttgtaactatgagtttctggggaagggcaaaaggtttcaatctgatcttcaaggttctaaggattcatcctaacttttcccttgattttcccaggagaaaagatgtctttgccaaggatgccagtgactttttcttacagacttagaacggttaaacccaagccaagcctcttccttcctggtttctccaaacttaccaccttctgctcctctacatataccctttgctctacttactgatcctgaacattcctggaaatttcttgcatccatgcctttgcccagactactttaggcacccttcattctatctggcctttaaggcctaacttaaatgcttcaatttgccatgaaatctccgaatttctcaagtgtacctgaattccctctcctctctactcctcaggcatggattgtgctacttaaaggactcagtttattttctttctttattttttttttttgagacagagtgttgctctgtcacccaggctggagtgcagtggcgtgatctctgctcactgcaacctccgcctcccgggttcaagcgattctcctgcctcagcctcccaagtagctgggactacaggtgtgtgctaccacacctggctaactttttgtatttttagtagaaacgggtttcaccgtgttagccaggatggtctcgatctcctgacctcatgatacgcctgcctcagcctcccaaagtgctgggattacaggtgtgatccaccacgcccggccggactcagtttattttctgtcaggtgccatcattatctggacacttatctgcttccctcactgggctgccttgagagcatctttgcagacttgtggtgcctggcacatggtaggacttaattagtactggatggctaaatgaatgaaatattgtagaggtggttgtctgtcttttctgtctctgttcttagacattgtaaatgcctggtgtataaagggagggagaaagaagacagaaagagggagggtgcaggttggtgccccttttttctctattgctgttggcaggccagcaggtatgctggccactgtctacgtgcactgagagggaaagatacagggtaggggaaacagaggactggcatcctattcagcctcttctggccccaggtgagtcaacactgggattcacacctagaaactgacaagtatgaatcactcctaggaaggttaagaggtatttgtttttctaggtaaatgcctccacttcttttccatttcttttttttttttttttttttttgaatggagttttgctctcgttgcccaggctggagtgcaatggtgtgatctcagctaaccgcaatctctgcctcctgggctcaagcaattctcctgcctcagcctcccaagtagctgggattacaggcatttgccaccacacctagctaattttttttgtatttttagtagagacggggtttctccatgctggtcaggctggtcttgaactcctgacctcatgtgatctgcccgcctcggcctcccaaagtgctgggattacaggcatgagccactgtgcctggccttttttttttttctgagacagagtgttgctctgtcacctaggctggagtgacgtggcgcaacctcacctcactgcaacctccacctcccaggttcaagtgattcttctgcctcagcctcttgaatagctaggattacagctgccaccatcacgcccagctaatttttgaatttttagtagagatggggtttcaccatgttggccaggctgctctcgaactcctcacctcaggttatccacctgccttggcctcccaaagtcctgggattataggcatgagccactgcgcccagacttttttttttttttttttttttgagacagggtctggctttgtcacccaggctggagtgcagtggcttgatctcgctcactgtaacctcctcctcttgggttcaagcgattctcatgcctcagcctcccacatagctgggattacaggcgcccacctagctaatttttattttgtatttttagtagagatggggtttcaccatgttgggtaggctggtcttaaactcctgacctcagatgatctgcctgcctcagcctcccagagttctgggattacaggcgtgagccaccacacccgaccttgttttttttttttttttttttttgagacagagtcttgctctgttgcccaggctagagtgcaatggcatgatcattgctcacagcagccttaacctcccaggctgaggccattttctcacctcagcctcctgactagctgggaccacagatgtgtacaaccatgtctggctaattttttacaattttattttatttttagacagggtctcatttgcagaacccaatagctgggactacagtcgtgtaccaccatgcccaactgttttttgttgttgttagagatgaagattctccacgttgcccaggctggtctcaaactcctgagctcaagagatctgaccatcttggcctcccaaagtgctgggattacaggcgttagccatcgtgcctagtcattttattttattttattttattgcgacaagatcttgctctgtcacccatgtttggagtacaccagcacaatcctggctcactgtagcctcgacctctcaggctcaagtgatcctcctatctcagcctcctgaatagttaggaccacaggcacatgccaccacgcccagataatttgagtttttgtagagacaaggtctcactatgttgcccaggctcacctaatttttaccaaactttttgtagagacgggggtctcatgttgcttaaattggtcttgaactcctgggctcaagagtcatcttattcaattaataattctctgtctcctaattccagcagacatagaaagacacagaaggccagcgccatggctcacgcctacaatcccagcaatttgggagactgaggcttgagcccagaagtttaccaccagcctgggcaacatggtgagaccccgtctctccatatatatatataaaataataaaaattatccgggcgtgttggcatgtggctatagtccaagctactcagaaggctgaggtgggaggatcacttgagcccgacaggtggaggttgcagggttgcagtgcgccaacatcgcgccactgcactccagcctaggcgacagagcgagaccctgtctcaaaaaaacaaaaaacaccccaaacagaaacaacaacaacaacaaaaacccccacagaaggcagtgaaggcttgggataggattacctggtttaaacccatagaatgtcagaattgaaggaagacttagaggtcacctttgtttttttttcttttgatacagagtcgcgttccgttgcccacctggagtgcagtggcgcgatcacggctaccgcagcctcgacctcccgggctcaagcgaccctcctgcctcggcctctcaaagtgctggagttacaggcgtgagccactgcgcccggcctagaagtcacctttcaacttagtcctctatacatgggaaaagtgaggtccagaaagggtatgagttgtaccaggtcgctgaccctgaacagaagctagatgtcttaattcccaaataggactcgctgctaactctttgggcataccttcgcgattcaaggctcttgggtttcccgctttggccgcctcgccaaacccaagtcttacactcttagtgaccccctcctttcctccttcccccttaggtcagcagggtttactcattccaattgcaatgctccatgttgccggagtagctcctcgctagaagagagattagttatgtcaccgtcggctcctcccattggtccgggcgtgtggagcgcggcgccatgacgtcagacgcccaaatgagtggggcggtgaggggaaggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggtgaggggggcctccctctgggggagggggaagaggggcggagttgggggaggggggctggtactgggagactgggaaacgggatggggggccgagcgaggtgaagggcgccggagctaggaggtgggagggaaaagtggccggagatccgcgattcggggaggattctgggagaagggtcggagtgaggggaccggagttgaaggggcggaggggaagtgggatgcggaaaaatgagttcggattaaggagactaataccctactggaagacaggcatagtagacatctatcgggctggactgagaactcggtgggaactagaggatgtcagggagggggacccagattttagtaaagaaggtgagtggtggggagttgagggtgagctggggacgtgcggtgtagatttagttctccctgaggcaatgagattggggagaaaaggtggagactagaccagaggtgagtgatctttggggatatctttggccttgtctggtcttctccaggtatgtttatccgccttttttgtttcttgggtggaggcttacctatacagtccacctgggcctcaggaaccgccccagtctttcttgtggaacgtcaggttcatttatttgagctatatcagtgatctttgacctttgttgccaaatgtaattgtttccagactagcgtcttaaaagtatggttgggcataaaaatacgttttatgttaaactgaaaaaaaaattgttacttttagtcaccatgcagtgttgcgaaaccagatttggtaatttagttaagtattacgtatattctgttctaactttactcgttagtgctttgtctcttcagttattagcatttgagaatttgaatagatatgatggatgttttcctttttaattttgtcagatttgatggtgggaaaaacaagatacttagtctttagtgatatatagttctttctagttaatgtcccaacctaaactaaaagtttccgtattggccgggcgctgtggctcacgtctgaaatcccagcactttgggaggccgaggcgggcggatcacgaggtcaagagttcaagaccagcctgaccaacatgttgaaaccctttctctactaaaaagccagccgggcgtggtggcaggcgcctgtaatcccagctactcgggtggccgaggcaggagaatggcttgaacctgggaggcggaggtagcagtgagcctagatcgctgcattgcactccagcctgggcaacagagcgagactccgactcaaaaaaaaaaaaaaagtttacgtattatggcaaagaatgtgaaatgtgtcaagtcttaaaagaattacattgtccgcattaacttactataagtgaaattttattaaatttttgtttctagttctattaattcatggtgtttattaaatagctactgtgtgttgcaataataagagtcattataattacagaaatgctaaacttaatgtttctttagtgagtgaccatcgctgtcattgcacagcagataactttactaacctgctagaacctcattggaaaaaaaacttttttttttttttgtttctttttatttttttccagagggagtctcggtctgttgcccaggctggagtgcagtggcgcgatcttggcttgctgcaacctccgcctcctgggttcaagtgactgtcctgcctcagcctcccgagtagctgagattatagacacccaccactacggctggctaatttttgtattttagtagagacggggtttcaccatgttggtcaggctggtctcgaacttctgacctcaaataatcctccggccttggtctccgaaagtgctgggattacaggcgtgagccaccgcacccggcctgttttctttttttttttttttttgagacagagtttcgctctgtgcccaggctggagtgcagtggcgcaatctcagctcactgcaagctccgcctcccgggcttgccattctcctgcctcagcctcctcagtagctgcgattacaggcgcctgccacacacctggctaattttttaaaatatttttttagtagagacggggtttcaccgtgttagccaggatggtgtccatctgctgacctcgtgatccacccgtcttggcctcccagagtgctgggattacaggcgtgagccaccgcgcccggccttttttatttttatttgtattttattttattttttgagacggagtctccctctgtcgcccaggctggagtgcagtggcgcgatctcggctctctgcaagctctgcctcccgcgttcacgccattctcctgcctcagcctcctgagtagctgggactacgggctcccgccaccacgcccggctaattttttgtatttttagtagagacggggtttcactgggttagccaggatggtctcgatctcctgacctcgtgatccgcccgccttggcctcccaaagtgctgggattacaggcgtgagccaccgtgccaggcctttttttttttttttttaatgaaggcaaaggaaaaaaattaaactctgtaaatatgaaaacttcttcagtttctttcgtttagtatttaagactgatttcctaatcatggcatttcttctgtgtattcttctgaaatattttttcattttgattttgaagacagagtattctgaaaagataataatagatctgtagacaagtctcatcaatgattgttagtgcattttttaattaaaatttttttttttgtagagaaggggtctcttatgttgcccagtctgattttgaactcctgagctcaagtgatcctcccaccacagcctcccaaactgctgggaggcatgagcagctagtgcacgtatttttgactggtgaatgtcacattatttggtgtatcttttaactatggtatttaaggatccctgacgtttatttatttatttatttatttatttatttatttatttattgagactgagtctcgcactgttgcccaggctggagtgctgtggcgtgatctcagctcactgcaacctccatttcccaggttcaagtgattctcctgcctcagcctcccaagtagctgggattacaggcacccaccaccacacccggctaatttttatagttttagtagcgacggggtttcacaacgttggccaggctggtcttgaactcctgacctcaaatgacctacccgcctcggcctcccaaagtgcagggattacagacgtgagccatggcgcccagatggatccctgacgtttaattcagtgactaaaattcttattattttcagcattatagttgaaatatcattagccttgagtgtaaatgccaatattacaagcttttcgtgttcttttttctttttctttctttccttctttctttctttctttctttctttctttctttctttctttctttctttctttctttctttctttctctctctctttcttttcttttctttctctctctttctctctctcctttctttcttttcactcagtcgcccaggctggggtacagtggctcgatctctgctcactgcaagctccgcctcctgggttcacgccattctcctgcctcagcctcctgaatagctgggactacaggtgcccaccaccacgcctggctaattttttgtagttttagtagagatggggtttcaccgtgttatccaggatggtctcgatctcctggctaattttttgtagttttagtagagatgaggtttcaccgtgttagccaggatggtctcgatttcctgacctcttgatccgcccatctcagccttccaaagtgctgggattataggcgtgagccactgtgcctggcctctgttctttagttatgttattgaatgtattgaaatttttcaaatgtagatcattttaagagtaatcttttttcctacagattcattaaaaatatttattcatcatttatcaggtggttttctttagacagtctttctcaagaaatgcaaaaaggtaatacagagtgccttaaaacattaaataggcctggcgccatggctcatgcctgtaatcccagcactttggggggccgaggcgggcggatcatgaggtcaggagattgagaccatcctggctaacacggtgaaatcccgtctgtactaaaaaatacaaaaaaattagccgggcgtggtggtgtgtgcctgtagtcccagctactcgggaggctgaggcaggagaatggcgtgaacccggccactccagaggcggagcttgcagtgagctgagatagtgccactacactccagcctgggcaacagagcgagactccgtctcaaaaaaaaaaaaaaaacattaaataaaccttttttctaacaattaaaaaaaaagaaaaaaactcaagctgaaaagaagcttagaaatcacctgggtgtagtttcccacacagaatgggaatccctgcttctataccaaaacaaatgaaaatccatcctcttttccagatttctaaggaagtaataggatttttcagaatttctttttttttgtttgttttttgttttttttttttgaaacggagctttgctcttgttgcccaggctggagtgcaatggcgccatctcagctcaccgcaactgccgcctcccgggttcaagtgattctcctaccccaggctcccgagtagctggaattacaggcatgtgccaccatgcccggctaattttgtgtttttagtagagacggggtttctccatgttggtcaggctggtctcaaactcttcaactcaggtgatccatccgcttcggcctcccaaagtgctgggattacaggtgtgagatagcgctcccggcccagaatttcttataggaaaagtatgttcaattagaaaaaagaagcaagcagagtagtgctcttccaacctgtaacatacagtgtcctgtaacattagaaaataacttgaaggtaacagtaatattttcctatgaatcgagagttacgatttcaggttttagaaattttaggtggaagtagcaagattcacaaaggaaagggtgctgacactgggtatgtactaatgagccaggattgttaaacactttctttccttttttttttagatagtctcgctctgggccgggcgcggtggctcaggtctgtaatcccagcactttgggaggccgaggcgggcggatcacaaggtcaggagatcgagaccatcctggctaacacggtgaaaccctgtctctactaaaaatagaaaaaattagccgggcctggtggcgggcacctgtagtcccagctactcgggaggctgaggcaggagaatggcgtgaacccgggaggtggagcttgcagtgagccaagatcacgccactgcactccagcctgggcaatagagcgagactccgtctgaaaaaaaaaaaaaaagagagtctcgctctgttgccaggctggagtgcagtggcacaatctcggctcactgtaacctccacctcccaggttcaagagattctcctgcctcagcctcctgagtagctgggactacagatggtgtgccaccatgtccggctaatttttgtatttttagtagagacaaggtttcaccatgttggccaggatggtcttgatctcttgacctcgtgatcctcccacctcggcctcccaaagtgctgggattacaggcgtgcgccaccgcgcccagccaatcctttttttttttttttttttttttttgagatgaagtctcgctcttattccccaggctggagtgcaatggtgtgatctcggctcactgcaacctctacctcccgagttcaagcgattctcctgtgtcagcctccctagtagctgggattacaggcgcctgccaccacgcctgctaatttttgtatttttagtagagatggtgtttcaccttattcaccaggctggtctcgaacttcggacctcaggtgatctgcctgcctcggcctcccaaagtgctgggattacaggcatgagccactgcactcggccctgttaaaacactttacataatctcagttcttggccagacacagtggctcatgcctgtagtcccagcagtttgggaatcccaggcgggcggattgcttgagcccagaagttcaagaccagcctggacaacacagtgagacctgtctctacagaagtcacagaaaaattagctgggattggtggttcatgcctgtagtcccaggtacacgagaggctgaggtaggaggatcacctgagctcaggaagtcgaggctgcagtgagctgagatcatgcccctgcactccagcctgggcaacagagcaagatcctacctcaaaagaaataatctcgggcgggtgctgtgggtcatgcctgtaatcctggcacttggggaggcccaggcaggtggatcacctgaggtcaggatttcaagaccagtctggccaacacggtgaaaccccgtctctactaaaaagacaaaaattagctgggcgtggtggcaggtgcctgtaatcccagctactcaggaggctgaggcaggagaattgcttgaacctgggaggcggtggtggcagtaagcctagatcatgccactgcactccagcctggctgacagaacgcatctctgtctcaaaaaaagaaaaacaaacaaacaaacacattcagttctcacacttgaattaggtaggtaggttgtgttatgcgtgctttttatgtattgaggaaacaggatcacagaggttgtgtaacttaactaaggttacaactaggtagactgaatttgaactgaaatctgtccaacctcaatgcctatgctgcattcttttatgccattttgcccctcttaggtggtcacaggaccattccaattcctataaggtataagcactagttttaaagtaataccattgtgaactgcttgttctcattgaaataatagtgtaactggaatgataaatagttcattaaaattttagtcacattatgtcatcagaattctaggaggaaatgaatacctgattattttgtacttcacaaaataaactggataaactggataaatgactgaaagtttcttttttatattgctgagtcagattggatccggttcattaagggccaaaatttgtatttggcagtaatcctcatgtgttctcagaatgcttgattggtcattatcagttgcttaatgcttaccaaacacttccagtgttttgagtcactgaattggctcatggtaattgttaatcttgtggttactgagtcaagagccagcagtgtgtgttttggctgcttcacttcctcctcaacacttgatattgtcagattttaaattaattttttttttctaatctggtgggtttgaaattgtatctatagtgttttttatcagcatttcctgaagctgggcatcttttcatgtattttcgttggtcatttgtgcttctgcgaagtgtatattcaatttcgttgcctatttttttggtcttttctctttttctgatttatttttaagagttctttatatattctggatactaattatttgttaatttataggttgcaaatatcctttcccaatttgtgacttgtcttttcatctcttcatagtcttctggtgagaaaagctcctaattgtaatgaactgaatttttcagtctttcatggtttgtgttttgtgtttttttttattttttattttttattttttgagatggagtttcgctcttgttgcccatgcgggagtgcaatggcgtgatcttggctcactgcagcctccgcctcctgggttcaagcaattctcctgtctcagcctcccgagtagctgggattacaggtgcctgccaccacgcccagctaatttctgtatttttagtagagacagggtttcatcatattggtcaggctggtcttgaactcctgacctcaggtgatccacccgcctgggcctcccaaagtgctgggattacaggcgtgagccactgcgcccggctggtttgtgcttgttgtatcaaatttgggaaatccttctttgctgccaggcatgttgttttaataaatacagtagtatacctatctataatgtggtatatctcatctgacatttatttccaatatttgcttgattacaaaggcagacttcttagaagttgctttcttattatctttggagttatagggccacagggttttaaaaggaggttggattgtgccttacatgtgggtttcatacattgtccaaactgagacaccaacagatttgtgaatgagatgtgcatcttattaaatgttaatgtgatttgacaatgagacctttctttgtgtggacagtattatatacaattgatagtgtgtcattcagtctaagctgttagcactttcactaaaatatattcaaattttttttgatgtctagtttttacagtgttgggctttatcaagaatagttgtggattgtggaagagctgatatggaaacagaggaatgtattttgcttttttttttaaactctgtccggttccttggacttgtgtgtctcctatcttatcaagaataattgtagattgtggaagagttgatatggaaacatcttagaagaatgttttttgctttttttaaaaaaaaaaacaaaactgtccagttccttggacttgtgtgtctcctatctaccattaaacccttatgacttaaggtatatgtataaatacatatatacatcttggtggcattgatttttctatgttgtgtattaaagctgctaaaaaacattttttctttttttcaatgagaagactagtgattactttgactttaggaattattcttctaaggagtcaagtatttgatctgggcgaggatcacactgaaatataaaacatctgagtaatttgggttcactaaaaaaaaaaaaaaagaaatgtaaaacaaccaccagattaaaaatacactacaaatactgtttacaaccaccagattaaaaatacaacacaaatactgtttatttatacaaatagtatacctttgacatttatgaaaggcatactcttagatcattgggaatccgtacttatgtaactaccatagtttatagtgtccttcatgaaatacagaaaagtgtaacaggaaatttttagttaccatcagatttgatgggtaaatagaagagagcaacaaagtaaagcaatttgaatgctaaacttagtcttcagcttttttttttttttttttttttttaaagagatgggatcttgccctggtacccaggttggtcttaaatgcctggcctcaagtaattcacctgcttcggcctccccaagtgctgggattacagacgtgagccaccatgcctggtgctttcagctacctttaacttcctgcctttttctgttgtttgttactaccactggcctattccagcctcctttagtaacctattggaaactcaagattagtctgtcttgggccgggtgcgttggctcacgcctgtaatcccagcactttgggaggctgaggcgtgtggatcacctgaggtcaggagttcgagaccagcctggccaacatggtgaaaccctgtctctcctaaaaatagaaaaattagccaggcatggtggtggattcctgtaatcccagctactcaggaggctgaggcaggagaattgcttgaagccgggaggcagaggtttcggtgagccgagatcgtaccattgcactccagcctggccgacaagagtgaaactccatctccaaaaaataaaaaataaaaaagattaggctggctttgcctgtcttttgcttcatctcatcatcatggtcttggtcccaggtggggtttgcatccttactggtaagaatggaatcttcctaatcctaaaatctttctatagtttgggagtgttaacatttccttcagtagtttcatggggaaggatatgggcagtaacttccccatttctttcttctagtagatcattatatcttttttttttttttttaaagacagagtcttgctgtgtcgcctagcttggagtgcagtggtgcgatcttgactcattgcaacctcctcctccagggttcaagtgattctttcacctcagcctcccgagtagctgggattacaggcacgtgccaccatgcctggctaatttttatatttttagtagaaatggggtttcaccatgttggctaggctggtcgcaaactcctgaactcaaatgatccacctgcctcatcctcccaaagtgctgggattacaggcatgagccaccgcacccggccgatcattatgtcttataggatacctcatgagagaagtgatctggctgcatgggtggaattcaaggtcaaatggtcagccaaattaaaaatcactgctggagcagactttaggggtagtttgtgaactttcaaatttggaaattattattattattattattttttgagacggagttttgctcttgttgcccaggctggagtgcaatggtacaatcttggcttactgcagcctctgcctcttgggttcaagcagttctcctgcctcagtctcccgagtagctgggattacgggcgtgctccaccatgctcgattaattttgtatttttagtagagacggtgtttctccgtgttggtctggctggacttgaactcctgacctcaggtgatctacccgcctcagcctcccaaagtgctgggattacaggtgtgagccactgctcctggccagacatatttaattctttcatcaaaggtttattatatttccgagatattctagccaaaggaaacaaacttaacaacttttgttttctgaaaatactttagcaaaaatagaagggagaggatcaggaaaaataactaatggataccaggcttaatacctgggtgatgaaataatctgtacaacaacccccatgacacaagtttacctatgtaacaaaccttcacatgtacccctgaacttaaaagttaaaaaaatttaatgttaataaaatcttaaacaaaaatcacggaaggtctttaattgtttatgtcgtgtcctatccgttttcttgaagaagaaatattagctagttcttgtaatttatttattttttggggtggagtcccactctgtcacccagactggagtgcagtggtgtggtcttggctcactgcaacctctgcctcctgggtccaagcgattctcctgcctcagcctcctgagtagctgggattacaggcccttgccaccatgcctggctaaattttttatttttagtggagatggggtttcaccatgttggccaggctggtcttgaactcctgatctcaggggatccaccttcctcagcttcccaaagtgctgggattacagacttgagccaccatgcctggcagttcttgtaatttaatagggaatcttttttcctttctttctttctttttttttttttttttggagacagggtctcgctctgttgcccaggctggagtgcagtgatgcagtcacagctcactgctgcagccttgacttcctgggttcaggtgattctcctacctcagcctcccgagtagctgggactgcaggctcatgccaccatgcctggctctttttttttttttttttgtattttttgtagagatggggtttcatcatgttgcacaggctggtctcaaactcctaagttcaggtgatccacctgcctcggcctcccaaagtgttggaattacaggtgtgagtcacagtgcccagcctgctctggatatattactggcattatatttagtggaagagcatatatatattagagtaatggagatttatttcatttagtagtataagaaattatgtttaggtgcagttctaatttgagacattctgtatctgtcctgtctgatatgtctccaacattgacagtggagatataaaacattttcatcagtgtagaaagttctgctggacagcactgttgtaggtcagtgattctcaaagttttagtgtgtgtatggataacttggatgtattattaaaatgtagattctgagtcagtagctctggtgtgggcttgagagtttgtatttatttatttatagagatggggtcttgctatgttccctggtctgaaacttctggcctcaagcagtcttcccaccttggcctcctaaagcaccaggattgtgggtgtgatccactgtgcctggcctgtgtaaactttaaaatagtgtctttagccatgagggatgatattgtaatggcagaactctggacagtgagttgaaagatcgaaagttgtagttcactttttccaccatcttgaagcttttagaggcctgctgggaataggacttctaaaaggcaaatatgtctggaaggctgtggtccaaggccattttttgttggctgtaagtgtggtctccagaatcaaagagagcacacaactgtttttaaatcgaaggtgtttatgcctgagatgaagctgaattctgtttgggcaagagatttgtgcttatgtatacaaagcaaagaacaacacagtgactcctggtggcaaaccaaacaaaaccagagtaatctgtggaaagataatttgcgcccatggaaacagacatgccaaattccaaaggaatcttcctgctgaggccgtttggacacagaattcacgtgatgttgtacccctcaaggatttaaactactaaaaagtaaaagtggatttgtgaacaaaaaaagtcctagttcagctttcctgtttaaaaaccaacctctctcagccttggatttttttttttaattttttaaatttaaaaaaaatttttttaattaaatttttttttttagtgatggggttttgctgtgttgcccaggttagtctctaattcctgacctcaagtgatcgtccctccatggcctcctaaagtactgggattacaggcatgagccacggtccccggcctgtataaactttttaaatagtgtcttttgctatgagagcttgtattgtaatggcagaactgtggacagtgagttgaaagatctaaagttcaggccaggcgcggtggctcatgcctgtaatcccagcactttgggaggctgaggtgggtggatcatgaggtcaggaatgtgagaccagcctgaccaacatggtgaaaccccgtctctactgaaaatacaaaaattagccgggtatggtggcgcacgcctgtgatcccagctactcaggaggctgagacaggagaatcacttgaacccgggaggtggaggttgcagtgagccgaggtcacgccactgcactctagcctgggtggatagaatgagactccatctcaaaaaaaaaaaaaaaaaaaaaagatctacacttctagttcatctttccagttttaaaaccaatctctctcagccttgaactctttttttatttttcaattttctttagggatgggggtcttgctatgttgcccagtttggtctcaaactcctggcctcgagcatacctcccaccttggcttcccaaagtgctgggattataggcatgagccaccaagcctggctaatgtatttttttaaaatcacaagttcataatgatatttattatttgtttaacttttagcccctgcaaagaaatataatttagattttagaattataggactttaaatattttgcctttcctcttttatataaaaatattagttctttacaactataattacttatttttctatattggactcatataaaaagggttttaaaatagtaatactgctattatagctgataagtacaatctaaaatctttgctattctttatgttcttaaaatactgtgtaagggagggccaggcgcagtggcccacgtctgtaattcccagaactttgggaggcgaggcaggcagatcacttgaggtcaggagtttgagaacagcttggccaatgtggcaaaaccccatctctctactaaaaatacaaaaaattagccaggcgtggtggtatgcacctagaatcccagttactcaggggggctgaggcaggaggatcgcttgaacccaggaggtggaggttgcagtgagctgagatcacgccactgcgctcccgcctgggtgacagagtgagactctgtctcaaaaaaataaaaataataaaaatattgtgtaggggaagctctcaaaccacgttcttcctctactctcacaccaccacaacaatcatcaacacagaacacatctgtgaccaaaagtgtgggggtttttcacctctgcaccaagcagtggacaccagctcggtgttctccaattcaggttgggggctcagtcttcaagactgcctgcacacccctggacaccagttgcatgtctggggccctggatcttatgacccactgtcttcatgttggtgttcccacgatcccctctttgggtttggttaatttgctggagcatctcacagaactcagggaaacactgaaatttattggtttattctgaagaatcttacaaaggatatagatgaagggatgcatagagcaaggtatgggggaagaggtgtggagcttctatacccttcttggggcaccaccatccaggaacctccaggtgttcagctatccagaagttctctgaacccagtcctcttgggcttttgtggaagcttcatgatgtcaggatgccttctctcagggtatagggcagtcccctctctggggagggtgttaagacccacaatcagaaaggtggggaaagattatagtcctttcttggggcaggtgaaagtagggcagaggaagaggttttgtttcctgagacctgcccctgagacctaacacacccaatattgtatcagaagactgtaactagggctgtgggaattatgaaccaggaacagtggatgaaaaccaatatatgtcataacactacaaatatattttactgatgtatacaattagaataccgagttctaaagtcacttcaaataattatattctctggtcattttactaattttctgtaaagttaggtttatttgtttcattttgtattcattttgagggctaaaaaattatattgctaagaatgtgtaatagctattttgaaaagttagaatacagagatgtataaaaagaaaaattctctctctttttttttttttgagatggagtctcgctctgttgccctggctggagtgcagtggcacaatctcggctcgctgtaaactccgcctcccaggttcacgccattctcctgcctcagcctcctcagcagctgggaccacaggcacctgccaccatgcccggctaattttttgtatttttagtagagatggggtttcactgttttagccaggatggtctcgatctcccgacctcgtgatcctcctgcctcggcctcccaaagtgctgggattataggcgtgagccaccgcacctgaccaataaaaattttctttaagccaccattggaaatatccactattagaatatttatataaaatatttgtggagctcacatttattgaaaacattatgccatgtgttcagattgttctaagcactttgtatgcattatctcatttgatccttacaataactttatgagatagttactattatctctattttatttttcttttttcagccagtcaaatttagcagtggggggttgtataccaactttagtaacactgctttgaataagttctgatgagccactaccattggaccagcctgttattcccatttgattgattaaaactcaaatgttaacttgtacaagggatacgtaacctagtaagttgcagaactgagacttgacccctgacaattcttgctcaaactcactttattcatccctgtgtattgtttttatctttttttctgtgcttacacatacacggatttttttcttttgtcatttgagaacagagattttttaaatgtatttcatacattcaggtaagtttttttttttttctctaacagtgtcttataagaagtttttgatttcattgaagtcccctttagtttttcctttatggtttgtgcttttggtgttatatctaagaatttttgcttaatctaaggtcagaaagatgttctcttcttgaagttttatactttcaggtttgacttttttgtctatgattcattttgaattaattatatatgacgtcatatggatggaagattttttttgtttgcacatagatatctattttagcactttttgttgaaaagattaccctttctaaaatattttgtccatgtctatatttggacctgttctattctattgatctgtttgtctatctttatgccagtatcacactatcttgataattgtagctttataataaattttgaaaccagaaaagaaagtttcccaaagttgttacgactgtagagcctttggatttttcttttttttttttttctgagacggagtttcactcttgttgcccaggctggagtgcaatggcgcgatctcggctcaccgcaacctccgcctcccaggttcaagcgattctcctgcctcagcctcccgagtagctgggattacagacatgtgccactatgcccggctaattttgtatttttagtagagacggggtttctccatgttggtcaggctggtctcgaactcctgacctcaggtgatccacctgcctcggcttcccaaagtgctgggattacaggcatgagccaccacgtccggccagtcctttggatttctatacaaattttttggtttttttttttttttttttttttttttttttttttttgagatagagtctcactatgttgcctaggctggcctccaacttttgggctcaagtgatcctcctacctcagtctcctgagtagctgcaactacacaaacacgctaccatgtctggctccatatgatttttaaaattagcttgccaagtttctataaaaagctgctggctttttatttatttatttatttatttgagaccaggtcttgctctgactcctaggctggagtgcagtggtgtggtcatggctcactgcagcctcgacctttcgggctgaagtttatcctcctacctcagcctcttgagtagctgggaccacaggtgtgtgccactaagcttggctaattaaaaacaatttttttttttttttggagacggaatttcactcttattgcccaggctggagtgcaatggcgtgatctcggctcactgcaacctctgcctcctgggttcaagcgattctcctgcctcagcctcccgagtagctgggattacaggtatgcatcaccacgcccggctaattttttgtatttttagtagagatggggtttcgctgtgttgaccaggctggtctcgaactcctgacctcaggtgatctgccctactcggcctcccaaagtgctgggattacggccacggcgcccagcctaaataattttttttaatatagacacggtctcactatgttgccctggctgatcctgaacttttggcctcaagtgatcctcctgtctcagcctcccaaagcaccgggattacaagcgtgagccaccatgcctagcttcactgattcttcagcttgattgagtctgctgttgaaattctctattgaattatttggttcagtcattatattcttccgctctaagatttgctttttattatttgtttctttgttttcattttgttcatgtattgtctttctaatattgttatttgtgtgtgtgtgtgtgtgtgtgtgtgtgtgtgtgtgtgtttttaattgagatggagtctcactctgtaacccaggctggagtgcagtgacacaatcttggctcactgcaacctccacctcctgggttcaagtgattctcccgcctcagcctcccgaatagctgagactacaggcgtgtgccaccacacccggctaatttttgtatttttagtagagacggggtttcactatgttggccaggctggcgttgaactcttgaccttgtgatccgcttgccttggcctcccaaagtgctggaattacagatgtgagccactgtgcccggccagttatttgtgttttattatagttcacggaccttctttaataggattatttatttatttattattttgtaaaaatttttattaaaattttttttttcttttatagagacgggtttcactatgttgtgctagtctcaaacagccggggctcaagcaatctgcccgccttggcctcccaaagtgctgggattacaagtgagagccactgcacctggccaagaggattattctgaattctttgtcagtcagttctatagatctccatttctttagggttgttttttggcattttattagttttcttttgtggtatcatgtttccttggttctttttttttcttttgagacagatttttgctctgtcatctaggctggagtgcagtggcacgatctcagctcactgtagcctctgcctcctgggttcaagtgattgtcctgcctcagcctccccagtagctggggttacaagcatgtgctaccatgcctggctaatttttgtagttttagtagagatggggtttcaccatgttggccaggcttgtcttgaactcctgacctcaggtgatccacctgcctcagcctcctgaagtgctaggattacaggcgtgagccactacacttggcctccttgattcttaatgatctttttgtccttgtgttggtttctgtgcatttgaggaagtagtcacttcttttagtctttaccaattcatttctgtgaggaaagaccttcaccagtcagcctaacctggggttctggatgggtcagctggtagtatctgtgggcaagcagggcgtgctgctggaatctcttgttgaacttggtagctgcccatactctgaggttaggtggggcttgttctctggggtctgaggccagtgcaggtctgttggctgggctctgaggttaggaggggcagctggctgggctccatgtttaggccaggctgctctgtgacttgggagggctgcaggctgtactctggaatttccccggtcaggtgaggctacagggtatgcaccatagatgggtaggactataggctgcattctgcaatcaggtggggttgtatgttaagtttagctgttgaatgggggcattggctgatttttttgcctggatggggctgctggccctgctccaaggttagacgggttctgtggccgggctgcctggttgggcaggcaggttgcctggttggtcctgtggagttggagtttcagctatactattaggtgaggccataggctatgctcagctgaggtcagactggatcactggcacaggacccaagccaggcagaatgttgactgtgcttgttggatagacatgccgcagatgggcagagctggtggttgggctctctggttgggtgaggccactggcagggatgtggtctcattgtcatgatttgcatactgtttgctgtgagccccacccccttctttgttcctagctgactccagtggtctagccctcccatttcttccctatgaggcaagacagacatggatctcctggaaagcaccctggaaagctgggaaagttggggaagctgaatgtctgccttgggctttctttttcccactgcagaaactataggcccaggggatcactctctggccccatgtgggcctggtgaggggcgatgcagtcaaaaagtcaagccactcttacccgtctaatggggcttttggtatttgtgctccaagggagtgcttaagccctaggctctggaattttcacaaaggtgttcttgtctgtggataattactaattgacatttctgtgatagtgactagaacctggacctcctattccaccatcatgttcttggactcttttttattatttatttatttttttgagacggagcctcgctctgtcgcgcaggctggagtgcagtgatgcgatttcggctcactgcaacctctgcctcccgggttcaagcagttctcctgcctcagcctcccgagtagctgggactacaggggcacaccaccacgcccagctaatattttgtatttttagtagagatggggtttcaccgtattagccaggatggtctcgaacccctgaccttgtgatccccccgccttggcctcccaaagtgctgggattacaggcatgagccaccgcgcccagcctattatttatttttaattttaatttttttgagacactatttctattttggaataattttagatttacagaacatttgtagagatagtacagagagtacagagagttcctggctatccctaactcagttttccctaatgttaaccatcttacattaccatgatacatttgtcaaaactgaaaaacctaccttggtacgttagtatcaactaaactctggactgtatttagatttcccctgtttttctttcttcttcttttttttttctctctctttttttgagacagggtctcattgtgtctccccaggctggagtacagtggcatgatcatgtcctactgcaaccttgactacccctggctcaggtgatcctcctgcctcagcctccctagtagctgggactacaggcacgtgccaccatgcctggctgatttttttttttttttttttgtagagactgggtttcaccatgttgcccaggctggtctggaactcctgggcttaagagatccgatccttctgcctcggccttgcaaagtactgagattacaggtgtgaaccactgcacccaacccaggttttctacaatttttttttttctatttcaggatccaatctaggataactaaattgtgtttagttgttatactttcttagtttcttctggtctgtgatagtttcttagtccttccccccgctcccagtaatttgacagctttggggaaaactggtcaggtcctcaatttggttttgtctgctgttttcctcgtaattagactgggcttgtggatttttggaaaaatacctgaggtaaagtacctgtctcagttatatgaaatcagtatggacttgagtatttagtttatattttggattaaagtcccacattgatttattttgttgctcaagttgttttatctttggccattgagagctctttcagattggccttggccttagaatctgtcatttctccagagaatagggcttgtttctctgtcagtctgatcttcattcctttgtaaagacttcatttgtggtatcttgataacttttaggagccacccttttaggagggggtttgttagtgctattacggttttattttttaagagattatgattaggatggatagatgtttagtttgccaacctgatctaaacttttaatttttgctaaacagaatttgtagcatttagagctatatgctttagaatttttcattgtatgatgtttaacatacagaaaaaatatgaatgtaaaacatctaagttatgaggcataataataaacatttgcaagcttattagttgtcttgaaaactagagcattaccaatacattactatttatttatttgtctgtttctgtcctatcctatccttttactactccacagagttagctgttctcccgaattttgggtttatcatttccttccttttataaaccacatgatatatattcctaaataatatattgtttatttttgcttaattgtgagctttataaaaatgttaaactgtatataggcttaagtgattttatttttttttgagatggagtttcgctcttgttgcccaggctggagtgtgatggcgtgatcttggctcaccgcaatctccgcctcccgggttcaagtgattctcctgcctcagcctcccgagtgagtagctgggattacaggcatgcgccaccatgcctgcctaattttttgtagttttagtggagacgtggtttctccatgttggtcaggctggtctggaactcctgacctcaggtgatccaccagccttggcctcccaaagtgctgggattacaggtgtgagccatggcacccagccttgttttagttctttattttagaaagttccaaactcataaaagtagatttggctgggcatgactcatgcctgtaatcctagcactttgggagggtgaggtggccagatcacctgaagtcaggaagttcgagaccagtctggccaacatggtgaaaccccaactctactaaaaatacaaaaattaacgagtgtggtggtgtgtgcctataatcccagctacttgggatactgaggcaggagaatcacttgaaccccagaggcagaggttgcagtgagctgagatcgtgccactgcagtccagcctgggtggcagactgagactgtcacaacagcaacaacaacaacagcaacaacaaaaatgtagattaatcctgctttgtaaaaactcttatttttttctactcacacaccaccacagcaattatcaacacagaaaaagaattctgtggccaaatgtgtgggcagttttccccacacaccaagcagctgccaccagttgggtgttctccagttcaatgccgacactgtctacctggagatagtgtcagatcccactggttgaatgcgcagtctccaagattgccccctagcactcatcagtcacaagtctgggcctcaagtgcttctgaccaccagcttcactcatgtcagggttccctcggtcctctctttaggtttaatttgccagagtgtttcacagaactcagagaaactcttttatgtttactggtttattctaaaggcgattgcaaagtatacagatgaagagatttgtctggcaaggtaggggggaaggtgcactgactttccatatcctccctggggtgtcaccatccacgaacctccgtccaggtgttcagctagccagaagctctccaaatccagtcctcttgagtttttatggaagcttcatgatgttagcattccttctcccagagtacagagtgggagtctccgtctttttcttttgagacacgctttcactctgttgcccagctggagtgcagtggcaccatcttgggtcactgcaacctccacctccgagtagctgggattacaggcatgcaccaccacgcccggctaatttttgtatttttagtagagatggggttttaccatgttggtaaggctggtctcaaactcctgacctcaagtgatcctcccgcctcagcctcccaaaatgctgggattgtaggagtgagccaccctgccctgcctgtgagaggggcttaagactcacaatgagaaaggggtattgggagagatagagttctaccttaggacagttgaagggagggtgggaaaagatttgagagattctgttttctgaggcctgacatacctagcattataacagaagactccagcaagggctatgggagttatgggccagaagctgtagacagaaacgtgtgtgtgtgtgtgtgtgtgtgtgtgtgtgtgtgtgtgtgtgtgtgtgtgtgtccccgtccccgtatatgtatgtatcataacaccatacagccccaataactgtcaatcttgttttatatacataccctctgcccagttattttagagcaaatcccagtcatatcatttaacctgtcaagttatttttgtatatctctgaaagatcacataaattactataatagcattatcctacctatagaaaatgaacttattccttaatattatcaaatattcatgttttctcaatttttttattgtgttttcctcatgtgtttggattgggactcaaataaggtctgtaagttagtgattgcttgagatgtattccttaagatctttttcagtctgtaggttctcttttcatcttgctttttttgtgttgaaggaaactgaatcactttttctaaaagtttgctacagtcaggattttgcagtttaattcactactattttaattaggatttgggtatgtatggataaaacataaataatcagctaggtgtggtggtacattcctatagtcccagatacttgggaggctgaggcaggaagatcttttgggctcaggagtttgaggctgcagtgagcaatgttcatgccacttcactccaacctgggctgttcagagcaagaccctgtctctaaaaacaaggatcaacaaaaattaaatatgctttcatttctggttcttttttctcttttctctgtcagtttttggtatcagtgttatgctgatctcatacgagaacttggaattcagcaacattcattcagcaggagttactgagcactactgtggccgggcactatgcttggtgtaatggtgaatgagacagaagtggtatttgtcctcgtagtgcataaaggcaagtggggaagacagacaataaacaaatcctgaataaattgataagctacaaatatatatttgtttccattttatgtgttggaatagattaaataaaataggaataatctgtttcttaaatatttaatagaactttaaagacatctgttctgacatttattttagcatacacatatttcataagcatgtgaaattacttaagaaccccttttctctccccataaatctttgacaccgtgtgaagttgttccatccttatattgtttttcctttaggcctacagtgttcccctggggatttgagttttcaagttttgtgaacaaggctgtattatttctgtgggaaaaatcattcaggtttcacatgatggaaacagaatgatacaatccactgagtttgaagactccaggaagaacaaaaaattatatttgcaattacttatttcaggtcaaattaatagcttctagtatgataacttttttttgttttaaaattaaccagttaagagactgggcgtggtggttcatgcctgcaatcccagagctttaggaggccacagtgggtggatcagttgaggtcaggagtttgagaccagcctaggcaacgtggtgaaatcctgtctctactaaaaatacaaaaattagctgggtgtgatggcccacgcctgtaatcccagctactcgggaggctaaggcacaagaatcttgctgctgcactccagagtgcagacgacagagcaagactctgtctcaagacaacaacaacaaaaaactgaccagttagtattgtattagttacttgtagaggaaaatagtatcaaatagtaaggattttcttataaaaaacaaaaaaagggtgtggattgtatatacttgctgagtcaagtatacttgtctttctgagtcaagtaagtatacacagtccacacccatttttttttttgaagaaaacacccgtttgtttttatgtgccctcagaattaagatgaagtcttgtgctatctttttaatatgtataagactagaaaaaccagtgaaattcatagttagaaaataatctatctctagtcctttaattctggaaagaattccagagatcatttactccagtagtagtcttgttttatggaagaagccctaaaagttctttttttttaaatttcagaggtttttacccattctacaagtcttttaattgcctcaggtgctcttgtctttcttgccttctggtatgaattgtgatatgatttttggagttgggaaggaaattatatttttggttcaataacttgttgacattatttttttgccaaccagtctttattcagttgcaagaattaaattgataggttcgtggtcagatttcctcttgaggacactgcactgaactctctgaagaaaatactttaaataaattgtaatgaattggttaagatgctgacttgaaatttctgattggctaatgctttaatttttattttttttgagacaagttctcactctgttacccagagtgagagtgcaggctggagtgcagtggcgccatcactgttcactgcagcttcgacctccccaggctcaggtggtcccctgcctcaacctcctgagtagctgggactacaggtgtgtgccaccacacctggccagtttttgtattttttgtagagacaggttgtcactatgttgctcaggctagtcttgaactcctgggctcaagtgatcttccagtctcccaaagtgctgggattacaggcctgagcagtcacacccagccctggctaatgctttgaagtcatgactcccattctgatttttaactagtcattactttcctgttcttccattatggtagtctcacaagacttataatttcagactttttattggtaactacaagagattattgttttagctttttcattttaaagatattgttttgtctagttgtattctgaaattacatgttaggtataattattagttgtacaattagctattaaattttcagaaagtttgaagggagagagtaagtgaaaagccactcctgctaaagattagacactgtactagatgcttggaggattaagaggagaccagagctaagggaaatctttgtctggattttattgacccattttggaattagctgcagatcttaagaaatcagattgggttggcaggacgtggtggctcatgtctgtaatctcagcactttgggaggctgaggcgggaggatcacgaggtcaagagattgagaccagcctggccaacatggtgaaaccccgtctctactaaaaatacaaaaattagccaggtgtggtggcgggcacctgtagtcccagctactcaggaggctgagacaggagaatggcatgaaccccggaggtggaggtttcagtgagccaagatcgtgccactgcactccagcctggtgacagagcgagactccgtctcaaaaaacaaacaaacaaaaaacagtttgggtcaataatttgcgtttacagtactagtttatgtacttatttgtcactttgtaatttttagggagttgcttttcaactgtaatctgtttttattaaactatttgaaatgagctttgtattcagtcactagttgtgtttctcccttccaagtactaaccaggctcaaccctgcttctgagatcagacaagatcaggagcgttcagggtggtttggttgtagacactaattgctttgcttataagccttaaggataccttacaattaataactttggtaaaacctcatttgaaaaataagactaagcctgagccaaacggcaaaatcccatctctacaaaaaattagccgagcatggtgttgggtgcctgtggtcccagctactcaggaggctgaggtgggaggatcacttgagctcgggaggttgaggctgcagtgagtcaagattgtgccactgcattccagcatgggtgacagagtgagaccctgtctcaaaaaaaagaaaagaaaaaagtaagactaaaatcagttagtgacaaaacttatgtattacagcatcttgacttaaaaaaaaaacaaaccaaaacccttcattttccgagtttttcataagccaggtattttcttaaatttgaagtcttagaaacttaggttattttggctcgctagctgtatgtgtagagtgaaaatagtatttctacatttggtcagttgcataatgttactatacctttgatccatctggaatttatcttggtatgcagtgtgaagcaagcatcggattctgcttttttctaggtgactacccagttgtcccatgacttgattttaaaaagcagctttattatataccaaatgtttatattttgggtatttttagggatttctactttgttccactaatctgtatttgtaccagtacgacacagctttcagtattgtatcttctaatattttaatatctgataggctagtctccattttcttcggagattttttcttttttttctgcgtttgcttaattgttatttcttttttttttttttttttttgagatggaattttgctcttgtcgcccaggctggagtgcaatggtgtgagctcagctcactgcaacctctgcctcccaggtttaagtgattctcctgcctcagcctctggagtgggttaggattacgggctcccgccacagctaatttttgtatttttagtagagatggggtttcaccatgttggccaggctggtctcaaactcctgaccttaggtgatctacccacctcagcctcccaaagtgctgggattacaggtgtgggtcaccacgcctggccgcttaattgttatttctacatgaactttagaatcagcttgtctaattaaaaaaaaaaaaaaagaaagaaaaacatggtacttcagttttcatttgcatcatggcaaatttgtatagcaacttagaattgatcttaataatgttgaatatcccgctcaagagtattgtatgtttttctaattgtctaagttttcttttgtgtctttcagtacaggtttagttttctccctttatgtcttcagtttattcctagttcttaactgctgtggtatattggtatgttgtgtgtttctcttatatttctttttatttatttcttttttttttttaaagagatgggatcttgcaatgttgcccaggctggactcgaactcctgggcttaagcagttctcttgtttcagcacattatatttattatctggccatgtatatatgaaggctgtttcagagtattaatttgtttcagaatattaattttgtatccagaaatagtttatcgtattctcttgtcagtttttgggttttcctgggaaagtttcttatctgagtttttatgctttttatttctcccatctaatatgaaataacaatgctaagcaattgtgataataatggatatctttgtcttgttgctgtccttcgtgggaatacttctgtagtctccccactagtcagcataatctggtatttggtattagttttttgttttttaaaactcatgtaaaggagatagccatatgatttttcttctttgagcattaatgctgaattatatcagcagaattgttaatgttggtgttggactgtatttatgcaaaaaatctcacttggacatggtttattcctaaaatgtactggtaattttggttgttacttttttttttaatcaaggattttcatatctgtatttatatattcaatttttccgaagttttttggcaccaatattatactcattttgtaaatacaaattagacacttttctatattttggatccattaaaatcccactggaggccgggcacagtggcttatgcctgtaatcccagcactttgggaggccgaggcaggcagatcacctgaggtcaggagttcgagaccatcctagccaccatggtgaaaccctgtctctactaaaaataaaaaaattagccgggcgcggtggctcacgcctgtaatcccagcactttgggaggccgaggcgggcagatcatgaggtcaggagattgagaccatcctggttaacacagtgaaatcccgtctctactaaaaatacaaaaaaattagccggacgtggtggcgggcgcctgtagtcccagctacttgggaggctgaggcaggtcaatggcgtgaacctgggaggcggagtttgcagtgagccgagatggcaccactgcactccagcctgggcgacagagtgagactctgtctcaaaaaaaaaaaaaaaaattagctgggtgtggtggtgggtacctgtaatcccagctactcgggaggctgaggcgggagaattgcttgagcctggatggtggaggctcaagcctggatggagtgagccgagatcaagctggttattaactcagcttcgtattttagttctattttttgaggtggagtctcactctgttgctcaggctggagtgcagtggcgtgatctcggctcaccgcaacctccgcttcctgggttcaagccattctcctgcctcagcctcccgtgtagctgggattacaggcatatgccatgagacctggctaatattttttgtatttttagtagagatggagtttcaccatgttggccaggctggtctcaaactcctgacctcaagtgatctgcctgccttggccgcctcccaaagtgctgggattacaggcgtgagccaccacgcctggcctgactcagctacttctgattttggaaatttatcatggttttctttgtgtcctaatatttacacaagttttgtaacatgttctttgggtattttaaaaagtgtgtcctgctttcaagatgcttttgatctaacaatataaattaaatctagattagagctaaattagatttgttatctatttctgcctagtttttgtttcctatcatttttgccttttgagtggtaatgctatgttatttggggcaattcagtattgatattcagtggtttgcactctttattgttaataaagtaaaacacaatggtttgcactctttattgttaataaagtaaaacacctgttacgtactccatgaagtctataacctagagtcatttgtatgcttactggtctagaaaccactgatttattctttgttcttttttctctctctgaagtcgttatctttcattagttacctatttttttttttgtttgtgttttttccagcgctctgttgaattacatattattgtatttccttttaatcctcttataggtgcttgttgcataccagtttttttcccccaattacaaagtatgtgtgtgttgatcatagataaatgtatgcatctatgctcagtacaggaaacctggaaaacagcacaaaaggaaaaaccaaaaggctaaatttgtgatcccaccattataaaaatatcttatccttatttgtttccatatccacataaacatacttctctcttttccacaatgtcagggcctattaaatcttgtttctatacgctagtgactccaattttcttttttaatttgcgataaaacgggtgcttaggaaaatctgaaccagtattttattccagctgaattaaaagaaattgatgcataaagaaaagcttactggagctattgaaatgttcctcagtatgaatcagggtactgtgacctcttgttggccttccattttcagccaagtacgccgatgtgcagcggacagtaataagggggctaagttttgcaaacacagagcttgtggacagtgatagatcctgaaagtagtgtctcttgctaattctcagacttaacctgactgaaagcaaggcctcacaaattgaattcagtcttcacagttacgttcttaactaacacaaaaaaatattctaatactattctgttcaaataaaaatttacgttttctggccaggtgcggtggctcacacctgtaatctcagcactttgggaggccaagatgggtggatcacctgaggtcaggagtttgagaccagcctggccaacatggcaaaaacccatctctactaaatacaaaaaaattagctgggcatggtggtgtgtgcctgtagtaccagctacctgggaggctgaggcaggaggattgcttgaacctgggaggcagagggttgcagtgagccgagattgtgtcaccacactccagcctgagtgacagagggagactccatctttaaaaaaaaaaaaaattttttttttttacatgttttctataggtatactagtttactggtagagtggttggaaatgttttgcctttttgaaagttatatttaattcaccaacctttttttttctttaaacacatcgttgctggtttgaataatttgtcaacctttgtggagctctttctgcatgtcaggcagtatataaaagtatcttttgttaatttttataataagaatcatttgagattactttatatgtggtataggggaatggtttccaggcttgggttttatggatcagtaagaaaaaaaatgggatgatgaacatatgattgctagcttttaattttgtcaatatagacattggtatcatttatcttgaatactcaatatttaatttggaaacatgaatatttttccttcatttattctctcattatagatttatggtctatctagagttggctggttattcagtctactacctttattttactgatgagggagctgaggctccaaaatgcctttgagaccccagagagaagacagaaaacttctttctcatgaatatattatagcctaatattgacatgttactagcagttacaaacataaatgttgctatgacttgtatgggagttaatttttcttcaggcttgaaatgtgatgattcccaaagccatctttttgtgtaaattagataatttcctggattaatttgtatcttgggaaattactgattgcagctattattttagaagtgtgactgatagcttactgagattctgagttgctattttgttttgggaagcatttttagagagtattataataatttgacagatatgcaaaaggaaaggaagtgaaaatgagagaacattaatacagttgcccttgggctttctcctccccttctcagagggcctggtccttcgcaaggtgttttttattattactttttaaaaatttcctggtctcctatccctgcctccttcaacttttccttttcccatttcttcccattccttaacccatctcttcttctttcattctggctcctccttctctccctgcatttctcttgttacctgtttccccatctctttttattcttagatttattctttgttcttttttctgatgtctttaaccagtaattcagattttaagttaccgggttttcttcctgtagcatttgaactgaagtgatactgagctggaaaaatagaatatcactgataagttgttggttttgggatttctaagttttattagtgtaaaagttcttgaattatgaatgtgtgttccaatccataccaccagctaaaaaagaaaaagaatatgttttattgttatttttgattgatactttccctttaatagaagcatatacttattttagtggaaatttatgattgattataaatttttttccctgtgattaattatagctttacattagtggcaaacatttctttcagtcttgttttgtgcacattttttacataaggcaatttaatttaatttattaaaacattttaaaatttataattattggccaggaatggtggcttatacctgtaatcctagcactttgggaggccaaggcaggaggatagcttgagttcagaagttcaaaaccagcctggttaacatagtgagacctcatttctattaaaacacacacacacacacacacacacacacacacacttatagttattttctatttattatatgctttttaaaaataaaataatttttttagttccatgtctactcctatgttatgtgcctttagtagacactcttagtgccatcacaacgttatcttctggattttccattatttaatcatttttccataattgagtatttagataataggagagtattgtaaaataaatgggtttagggaaaatacaaccctcctagcttaaatcaggaggaattggataccctgaacagaccaataacaagcagcaagattgaaatggtaatttaaaaattaccaacaaaaaagtccaggaccagatggcttcacagcagaattctaccagacattcaaagaagagttggtaccaatccttctgacactattccacaagataaagaaggaaccatgcctaattcattgtataaagccagcatcaccctaccaaaaccaggaaaggacataaccaaaaaagaaaactacagactaatatccttgatgaacatagatgctaaaatccttaacaaaatactagctaaccaaatctagcaacatatcaaaaagataatccaccatgatcaagtgggtttcataccagggatgcagggatggtttaacatatttaagtcaataaatgtgatacaccacataaacagaattaaaaacaaaagtcacatgatcatctcaatagatgcagaaaaagcatttgacaaaatccagcatccctttatgattagaactctcagcaaaatcagcatacgagggacatacctcaatgtaatgaaagccatctctgggccaggtgcagtggctcacatcacacctgtaatcccagcactttgggaggccgaggcaggtggattacctgaggtcaggagtttgagaccagcctggccaacatggtgaaaccccgtctcatctaaaaatacaaaaattagctcggcatggtggcaggcgcttgcaatcccagctactcaggagactgagacaggagaatcgcttgaacccaggaggtggaagttgcagtgagccgagatcgcaccattgcactccagcatgggcgacagagcgagactctgtctcaaaaacaaaaacaaaaaaacccaaccatctatgacacacctacagccaacctaatactgaatggggaaaagtggaaagcattacctgtgagaactagaacaagacaaggatgcctgttctcaccactcctcttcaacatagtactggaagtcctagccagaacattcagacaagggaaagaaagaaagggcatccaaactggtaaagaggaagtcaaactgtcactgtttgctgacaatatgatcgtttaccttgaaaaccctaaagcctcctccagaaagctcctagaactgataaaagaattcagcaaagtttctggatacaagattaatgtacacaaatcagaagctcttctatacaccaacagtgaccaagcagagaatcaaataaaaaactcaaccccttttacaacagctgcaaaaaaaaaaaatacttaggaatatacctaactaaggagtcaaaagacctctacaaggaaaactacaaaacactgctgaaagaaatcatagatggcacaaacaaatggaagcacatcccatgctcatggatgggtagaatcaatattgtgaaaatgaccatactgccaaaagcaatctacaaattcaatgtaatccccatcaaaataccaccatcattcttcacagaattagaaacaacatttctaaaattcatatggaacaaaaaaagaacctgcatagccaaagcaagactaagcaaagagaacaaatctggaggcatcacactacctgatttcaaactatactataaggccatagtcaccaaaacagcacggtactggtataaaaataggcacacagaccaatggaacagaatagagaacccagaaataaacccaaatacttacagccaattgatcttcgacaaagcaaacaaaaacataaagtggggaaaggataccctttttaacaatagcactgggataattggctggccatatgtaggacaatgaaactggatcctatacaagatagattaaggacttaacgacctgaagctataaaaaattctagaaggtatcattggaaaaacccttctagacattggcttaggcgaggatttcatgaccaagaacccaaaagcaaatgcaataaaaacaaagataaatagctgggacccaattaagctaaagagcttttgcacagtaaaaggaatagtcagcagagtaaacagacaacccacagagtgggagaaaatcttcataatgtatacatctgacaaaggactgatatccagaatctacaaccaactcagtaagaaaaaaacaatcccatcaaaaagtgggctaaggacatgaatagacagttctcaaaagaggatatacagatggccaacaaacatgaaaaatgcccaacatcactaatgatcagggaagtgcacatcaaaaccacaatgtgataccaccttactcctgcaagaatggccataataaaaaaataaaaaaacagtagatgttggcgtggatgcagtgatcaggcaacacatttacactgctgtgggaatgtaaactagtacagccactctggaaaacagtgtggagattccttaaagaactaagagtagaactaccatttgatccagcagtcccactactggatatctacccagaggaaaagaagtcatttgaaaaagatgcttgcacatgtatgtttatagcagcacaattcacaagtgtaaaatcatggaagcaacccaaatgcctatcaacgaatggataaactgctgtgtgtatatatgtatatatgatagtgtgtgtgtgtgtatatatatgtatataagtatgtatatatgtgtcatatatatatatatatgatggaatactgctcagctgtaaaaaggaatgaattagcatttgcagtgacttggatgagattggagactgttctaagtaaagtaactcaggaatggaaaaccaaacatctaatgttctcactgataggtgaaagctaagctatgaggacgcaaaggcataagaatgatacagtggactttggtgacctggggggaagggttggaggggggtgagggataaaagaccacaaatagggtgcagcgtatactgctcgggtgatgggtgcaccgaaatctcacaaatcaccactaaggaacttatgtaactgaataccacctgtaccccaataacttatggaaaaataaataataaaaaaagggtttaaaaaagtataggaagttattggtgaaacgtgtgtacatatatatatgtacacacacacacacacatacatgtatgtacatatatataaaagatgttctgggggaagaaaactgaccctaaataggtattaaaatgcctttgagctttgagagactgaagttttgctgcatagtggaccttagaaaaatctttatgtgcccaaatatagatttctcatattcttaaggactgtggaaaataatatataatatgggaaaaaaatattttatcagctctattgaggcatgatttaaaaaattttacattatttactaataaagagaactgtattttatttttcatttactattccttgtggtcttctatctagttgttcactgcctcattgcctctctgattttcaaacttggaagttattgacacgcgtctttctggccctctcctctggagcacctctctgctgccaatttttttctgccatttttttttttgtaatttaatttaaaaaaaaacttactgaggtgaaattcacatagcatgaaattaaccatgttaaaatgatcaatttagtggcatttagtactctcatagtgttgtgtaatcaccatatctggttctgaaacctttccttcactccaaaggagacccttaccaactacacagtttctctttcccagacccaggcaaccgccagtctgctttcagtctctttggattttccctttctggacacctcatatgaatggcatcacacaatatttgtgaacttttatgtcttcttttttttattttaaattttttttagagctggggtctcactctgttgcccaggctgcagtgcagtggtgcgatcatagctcactgcagccttttaccacctggactcaagtgaacctgattagctgggactacaggcatgcaccaccacaccatgctaattttttttttttttttttttttttttttgagactggctctcttgcccaagctggagtgcagtggcttaatcatggctcacggcaacctttgcctcctgggctcaagccatcctcccacctcagcctcccaagtagctgggactacaggtgcgtaccaccatgctcggctaatgtttgtatgtttagtagagatggggtttggccatattacccagggtggtctcaaactcctgagctctagttaattttgaaatatagaatatattattgttaactgtagtcaccttactgtacaatagaataccagaacttattcttcctatgtgatggtaactttaatcattcatcaacttctccccatcccactccctgcccttccctttactaccctccccacctctccggcctctggtaattactattatactctctactcttttgggaagggtgtttgctatttatttatgataaatattccacatctgtgattctccacagtcagaagttctttgagaggatgccatcagccttggtcagtcagagaatggagtcatctgatttaccatcctgtgaatggccctaggcagatagcataggtgattgttgttactgttttgagacagaatctctgttgcccaagctggagtgcagtggcatgatctcagctcactgcagcctctgcctcctgggttcaagtgattcttctgcctcagcctcccaagtagttgagactacaggcatgtgccaccatgcccggctaatttttgtatttttgtagatactgggtttcaccatgttggccaggctggtctcgaattcctgacctcaggtgatctgccttcttcggcttctcaaagttctaagattacagtcgtgagccaccgtgcctggctggtggcggtggtggtttttttaatttttttaatttttgttttttcaacttttattttgattcgggggcacatgtgcggtttgttacctgagtaacaaaaaaaaaagcctctgcctttatgagataaacttttttatattctgtatgagtaagatcatacaaaatttgtctttctgtgtctggcttgtttcagttaacacaaagtcctgcagattcattcacattgtcataaatgacaggatttcgttcttttttttttttttttttttttttttttttgagacagacagtcttgctgagttgcccaggctggagtgcagtggcaccatctcggctcactgcaacctccgtctcccagcctcaagtgattctcatgctggatttcattcatttttttatggtgaacagttgagccttttaaaaaagccaagcatctggctgggtgcagtagctcgcgtctgtgatcccagcactttgggaggccgaggcgggtggatcacaaggtcaagagatccagattatcctggccaacatggtgaaaccccgtctctactaaaaatacaaaaaattagccaggcgtggtggcgggggcctgtagtcccagctactccggaggctgaggcaggagaatggcttgaacccgggaggcggtggttgcagtgagccgagatcatgccactgcactccagcctggtgacagagcgagactccatctcaaaaaaaaaaaaaaaaaaaaaaaaaaaaaaaaaaaaaaaaaaaagccaagcacatccatttaaattttggtggaacttctttataacattcctggtgtcagcatattctaggtgttgtttggaaaattatttattaaatcaaagactcagcctctctcaagttctttacctcaacaacagttgcttcttcaaacagctgatatcacacaatttttattgtggttatagaaatgaaacactaattttctgcatatgtctgtgagcatattcacaactcattgctggaagtttagataccgctactttcccaatttaggaaaacagatttctggtatgtgcctacgtgggaaggttgaggctgctaagagtcttgcttctgggttttagaagtctcactgtgagaccgggtgcagtggctcatgcctgtaattgcagcactttgggaggctggggtgagtggatcacttgagcccaggagtttaagaccagcctatccaacatggcaaaaccccgtttctactaaaaatacaaaataattagccgggtgtgatggcacactcctgtaatcccagctactcagggaagctgaggcatgagaattgtttgaacctgggaggcagaggttgcaataaagattgtgccactgcactccagcctgggtgacagcaagatgcctgtgaatgttttctgcacatataaaaaggttaaatcattttcagtatggtttgctggttctttgaaaattgataatacatacactttataaatttaattctccatgaactacaatatcaaacagaatacactctatctctacaccatgctgaaaaatggaaactttttttttttctttttggtaacaggatcttgctgtgtcgcctaggctggagtgcagtggcacaatcactggtcactgcagccttgacttcctgggctcaggtgattctcctacctcagcctcccgagtagcagggactacaggcatgcaacaccacaccggcaaattttttgtatctttgtagagatgaggtttcaccatgttgcccaggctggtcttcgaactcctgggctcaagtaatccacctgcctcagccttccaaaatgtgggattacatgtgtaagtcaccacgcctggctgaaaacagaaacttttcaagaaaagttttaaaagaaactaccaaattaatagatgttaccatataacgttcagaaatacaaatattttatgaattatttccagtcctattacttggaggcaaccattgtaaatattttttatgtacaagttgagtatccctcatctaaatccttggcaccagaagtgtttcagatttcagattttctaactttttgcctcatacttattggttcagcatccctaatctgaaaaaaatgcccctgtgaacattgagttttgtcttgtctccctcccctcccctcctttcctctcctctcctctcccctcccttcccctcccctccccctcccccttcccctcccctcccctcccctctcccctcccttctcctctcccctttcccatctccactttcccctctcccctcccccttccctctcccttccccttcccctcccccttccctctcccttcccctcccccttccctctcccttcccctcccctctcccttcccacctcccccctctcccctcccctcccctcccttctcccctctcccctctcccctcccctcccccttccctctcccttcccctctgctcccctcccacctccccctacccctccccctcccctcctctcccctccccttcccctcccctccccctcccctctcccctctcccctccccttccctccccctcccctcccctcttccctccccctcccctcccctcccctcccctcccctttcctctcctgccctctcctctcttttcttagacagggtcttgtgctgttgcacaggctagagttcagtggcaccttcttaactcactgcagcctcaaatcctgagcttaagtgatcatctcacatcagcctcccaagtagctaggacaataggcatgcgtcaccacgcccagcgaatttttgattttcattaattaattatttttgtgtgtgagacagggtctcgctctgttgcccaggctgtagtgcagtggctcactgcaacctcaatctcccgggcacaagcgatcctcccatctcagcctcccaagtagctgggactacaggtgtatgccaacacacccagctaattttttcaattttttatagggacagggtctccctatgttgcccaggctggtctcgaactcctgtgctcaagtgatcctcccagctcggcctcacaaagtactgggatataggagtgagccaccaagcctggcctcggctaatttttaatttttttaatatagagatggggtctcactatgttgctggtctcaaattcttgagctcaagtgatcctcccacctctgccgcccaaagcactgggattacaggcatgagccacagtgcctggatcttttttttggactttgggagtgagacgtgaggattctgtcagccctaaaaccttaggtcttctggtttcttttttgtactctcaattttcttcgtactaccttcaaggtataatgtgcctaagaaatatttccttgtttttcaggttctaaatggcttctaagaagttgggtgcagattttcatggtaagtggactattagaatcatggtttaagttatgatttgatcagaggatttggaatcacttagcatagttttaagtacaagtgcccctttttgtctcttttaatgaacagcttgacaaaaataaagttgtacaacaatgtatcaagtatatctgaaaggtcttcagagaacttgaagtatttcttcaaatgggtagttaaactttagagtgtctctggttattgtacttgaaactactagtgatagattaggagtctgcctgttctggttcttcagcagcattgaaggtatagttactggctgggcgcggtggttcaagcctgtaatcccaacactttgggaggctgaggcgggtggatcacgaggtcaggagatcgagaccatcctgtctaacacggtgaaaccccgtctctactaaaaatacaaaaaattagccgggcgtgttggcgggcgcctgtagtcctagctactcgggaggctgagggcagaagaatggcgtgaacccgggaggcggagcttgcagtgagccgagatcgcaccactgcactccagcctgggggacagagcgagactccattaaaaaaaaaaaaaaaaaggtatagttacctttccctttcctgttccttggtcatagctcttctccatatgtgtgtgtgtgaaaaattctaaccctttggttaatgctttataatgttttagtttagttccctgtgccccatcaaaggaagtaatttactacaaatcaatcactatattacagaggtatcaatactgatatttataattttgaatttgaaattaagagtttctctgtcatcttttcctaagatacaaccttccaaaatggaatacaataataaactactatctgcctttggaggggaatggagggaggtggaggtagctaagaagttaaaattatacccttttttcatacagtagaaggtaagaatttaaaaccagaagtagccaagtaacacaattattttaagagaggttttaaagccaatcttccatgttaaaaattatatcagccaggcacagtggcatgtgcctgcagtcccagctactcagggggctaaggtgggaggattgcttgatcccagaagtttgaagttgcagtgatcatgccactgcactccagcctgggtgacagagtgagaccctgactcaaacaaaaaaaatacatatatatatcacatcattttaagaatgatttactagactgcctggggacgtgttggtatgctcttctgagctgccagtggttgcttgataagatcactcagctgagtcagagtggtgtagcggtgattgtgattttacttgcttatatattttacacaacagcctttgaattttgatttgtcagtgtgcatatacttacatagataacctgcctgagtttttaaaaatccttttgaagttattcaaactctggaattagcattccttaaagaggtcaggcatcttatttttcaggtgagctatttcctattatttatggattattacaggtcttcttaaaagtattcaaatgatagtagaaaggcagatctgggcagggcacggtggctcatgcctgtaatcccaacagtagattaggaggttgaggtgagaggatcgcttgaggccaggagttcaagaccagcctcagcaacatagtgagacgctgtctctacaaaaaaattttaaaaattagctgggtatgctggtatgtgcctgtagtctcagctactcgggaggctgagaggtgggagtagtgctgagcccgggaggtcaaggctgcagtgagccatgatcacgccactgcactccagccagaatcacatgagagcctgtctcaaacaaacaaacaaaaaatgattcttgccactgagcttaagaaaagaaaaagggaaaaaaaggcagatctgaattccctctagatcctaccttttcaagggagaaaagagaggacagagccaagggcagaggaaaagcttagggagagaaaatagcaaaaatgaaaaatttacacttatttcaaaagatagactttctgttttgaatctttggaacatctgttttgatcagactgaaaatagttggaccacatgttttgtgtttcaactgaacattccagagagaagattataattctgaaggtgtctgttcataaagactggtatttcccatatctccttaaattcctaaccaggctgggcatggtggctcacgcctgtaatcccagcactttgggaggccgaggcgggcggatcacctgaggtcaggagttcaagaccagcctgaccaacatggagaaaccctgtctctattaaaaatacaaaattagccgggtgtagtgacgcatgcctgtaatcccagctactcgggaggctgaggaaggagaatcgcttgaacctgggaggcagaggttgcagtgaactgagatggtgccaatgcactccattccatctcaaaaaaaaaaaaaaaagaattcttaaccaaagtgttattttgtttgtttgtttgtttgtttttgagacagagtctcgctctgtcgcccaggctggagtgcagtagcacgatcttggctcactgcaagctctgcctcctgggctcacgccattctctgccttagcctcccgagtagctgggactacaggtgcctgccaccatgcccagctaatttttttgtattttttagtagaggcggggttttaccgtattagccaggatggtctcgatctcctgacctcgtgatccgcctgccttggcctcccaaagtgttggggttacaggcgtgagccaccgtgcccggcccaaagtgttattgtttaaatgaaactttctacctgagtaaaatttaggagaaaaattttctttctcccttaggctgcttctcctttaacagggctctttttgctgagttcctggttgaatttcactggctttacttgttttttttgtttttgtttttttgttttttgggttttttttgggaacaaaacaataaacaccttcattacatgggtgaagacaaaacgaggatttatttgcctttccggaccttgattttcctaagatagaactccaactccttcccctctagcacatagccgtctgtttggccacactgtcccggccttgaagtgatgcacgcaagaagcttgccctgctggaactgctcctccaggagactgctgattttggcctttttttttcctttcatcgatttcttctgaaattttttagatcattttttgtttaaaatctcttcttcctcaggagtcagcttgtctcctttcttgtggcccaggggtagcgcatagtgggactcgtaccactgtccatacggtgtgctgtcgatgagtatggtgtgctgtcaatgagcatgaagcaattcttcaccagggtcttgttatggaccagctcgttattaaacgcattgtagacaacatcgatgatccttgttttgcaaatacaacgctgagccccaggagaaattccctacatgcagccttagggcacggtatttcttgttacctcctcaaacatggactgtgtggacgtggcaggggccaatgttggtgttggcagctgggcacccctgctcatacttccgcttcttgtggtagggctttctcttgcccccggtcttgcggtgcttgtgtcagttctcccgagagatgcccattgctcggcgctggctggaaagagctagttgggtttttagagtaaagtatcctatttttagatatcaggtagtttaaataatagaaatgaaaggcagtagatggagaatatttaataggcaattgtgcaggcatgtgagtacagaaaataaagtttctgctctctcaaggctaaaattagaaagccaggaactaaggctactccttccacttctcaggaagctgcttagcctttcttcactatatgtctctgtgtctgtgatccattattattcagttcatagacttgctttcttggcctaatagtgtagagtacacagggctataaatggccaccccagttaaggtgctgcttgctacttgatctttcagtttcagtggctagcatcatagagatagagattttatatcttttggtcaaggcaaactgatggcatagccttcttagcttatgagcctgtggattggtcctccaaagttagatatctgactgatccattgagaggttaatggatgtgggtaacttttctgtggcacttggggtgtggacaaggaggtaataactgctgtcatgacggatattaaaatgtatttttttttctttttaatatttgggactgactaggtctggtgctgtgctgtctttgactagcacttgatttacctctgagttcattattttcaactaaagttgaacaacttcactgttactagtgaccatatatccctaaataacagaataagggaaacaaacagttatttctcaaacttctagaaatattatccatttcttataaaaactccatacccttcgcttagtttggataaggactttcttggagcctggtgctttaaaatctcaatcctctggctgggcgcggtggctcatgcctgtaatcacagcactttgggaggttgaggcaggcggatcatgaggtcaggagatccagaccatcctggctaacatggtgaaaccctgtctctactaaaaatacaaaaaaaaattagccgagcatggtggctggtgcctgtagtcccagctacttgggaggctgaggcaggagaatggcgtgaacccaggaggaagagcttgcagtgagccgagatcacaccactgcactccagcctgggtgacagagcaagacgccatcttaaaaaaaaaaaaaaaagaaaagaaaaaagaaatctcaatcctctttcactgattcttattttcatctaggagaaaggttatttatctggaaaatgtgttgagactctaatttatgaaaaaatagaccccgtgataagatttgataaaactagcccccctccttaaatcactttatcgaggtataattgatatataaaaagctgtacatatttacatgtttaatgtatacatcttgatgagtttgaggataagtatacactcatgaaaccatcaccatcattaaggcataaacattcattaccttctaaagtttcctcctactctattgtgtgtgtgtgtgtgtgtgtgtgtgtgtgtgtgtgtgtgtgtgtgtgtgtggtgggctggagggattgcttgaggccaggagtttgagaccagcctgggcaacatagaaaaaccccgtttcttgtttttttttttttttttgagatggagtcccgctctgtcgcccatgctggagtgcagtggtgccatctctgctcactgcaacctctgcctcctcaagcaattgctcaagcaattctcctgtctcagccccctgagtagctgggattataggtgcgcaccaccatgcctggctaatttttgtatttttagtagagacagggtttcgccatgttggccaggctggttttgaactcttgacctcaggtgatccacctgcgtctgcgtcccaaagttctgggattacaggcatgagccaccgcgcctggccttgtttctacaaaaaattaaaaattagccaggtgtggtggagcttctctatagtcctagctgctcaggagcctgggacaggaggattgcttaagcctgggagttcaaggttatagtgagctatgatcacatatgcattaggttgtttggtattgttccagatatctcttaacactgttcaattttttttttccctttttctctctttgtatttcagtttggctaatttcttttgacctaacttcaagtcccaagtctttcttatgctgattattgtcttcggattagcatagcctggtttatgaaccatcaaaatttttcttttctgataatgcatttttcacttgtggcatttccatttgtctctttatatttccatctctctgctgaagttcccatctgctcacacatgtttagtttttccattagaccctttaacatatttattattgttattttaaagctccctgtctgatgtttacaatatcttggctctccctgaatttgggtctgatgactggttcctctcttaattctggatcacattttcttgcttctttctgtgtcttataatttttaattgaatgccagacaatgtatattaaaaagctgattttgtagattatatggcttgttttgttgttaggatatgagtaacattttcttgtgatttcacatcttacaacagatatctatgttattttgtatatttatgattttgccagtgttacctggcttgtggctttaagatagttttttttgttttatttatttatttatttatttttaagtcctttgctgcaggaggcgctgatggctttaagatggtgataaccagtcatggaattacagattttcacttaattttaagtttgatcttctttttaaaaaaacctcaatttgaatctcctcacaataatacctgaattaaatattatgcatttgctatcctctattggggatttctccccccacctggaattgtactttttttagaaaaaacgggcagattgcagaatcataggcatatcagcaatttagaaagaaacaaagcaaatgaagtcttcccagagtttatcctgagtcattacatattcagcccactcactatcttccaccaaagtggtatgcagaacctaacttcaaggaactgccacaaccgcagccatgaggcatgcacttagtggctatttaaaaaattgaacttaggaaaatgggtgcaaatattttaggaagattttcagtaataaggactgaaactaaaaggtatttgaggttgaggcagaaaattgttagctataatattttaaattctagatacattggataaaaatggacaattccactttgggaggctgaggtgggaggattgcttgagtctgggaatttgagaccagcctgggcaacaaagtgagccctcagctctacaaaaaaatttaaaaaattagctgggcatggtggtgcatgcctgtagtctcagctactcaggaggctgaggtgggaggatcacttgagcccaggagaatgaggctgcagtgagtggtgatgacgtcactgcactccagcctgggtgagagagcaagaccctgtcttaaaaaagaagctgggtgcgatggctcacgcctttaatcccagcactttgggaggccgaggtgggcggatcatgaggtaaggagatcgagaccatcctggctaacacggtgaaaccccatctctactaaaaatacaaaacattagccaggcgtggtggcaggcacctgtagtcccagctactcaggaggctgaggcaggagaatagcgtgaacccaggaggcggagcttgcagtgagccgagattgtgccactgcactccagcctgggcgacagtgcgagacttcatctcaaaaaaaaaaaaaaaaagaaaaagaaaagctaattcctgaggcataattggttatatttggaagacatatattttgtaattctcacagcaccatcattaatagtacttacggtggtctctatccattattacaaatactgctttctttgtttcccccccccccttttttttttggagatggagtctcagtcacccaggctggagttcagtggcgtgattttcgctcactgccgcctccgcctcctgggttcaagtgatcctcctgcctcagtttcccgagtagctgggattacaggcgtgcatcaccatgcctagctaatttttttttttttttgtatttttagtagagacgggggtttcaccatgttggccaggctggtcttgaaatcctgaccttgagtgatctatccgccttggcctcccaaagtgctgggattacagctgtgagccactgtgcctggccacgttcccatctctttaaatgcctttttgccctttatccctacctcctccttccagtaatcactgaactatttgttcattctctcttaataaagcttttaaagtacgaagaccctggagggttgggggatgtactaaataaatcaccttggcattggctttattagtgaaaggaaactgatttttaaaccagatacctgcaattggtgctagtgaagggaaacggcagccctttaaaggtattctacctcatcttttctgtccctaagccaggacctagtttcatttatagaatataagtttgtcagtgtatatcacactgtagtagtttgctacgtgaaaggtaggcaaggagatcacttctcttataggatttttatctttttttttttttttgagatggagtcttgttctgttgcccaggctgcagtgcaatgacgtgatcttggctcactgcaacctctgcatcccaggttcaagcgattctcctgcctcagcctcccgagtagctgggattacaggcacacaccaccatgctcggctaatttttgtatttttggtagagatggggtttcaccatgttggccaggatggtcttgatctcctgacctcgtgatcctcccacctcagcctcccaaagtgctgggattacaggcatgagccactgtactcggcctgacatggagtcttgctctgtcactaggctggagtgcagtggagccatctcggctcactgcagcctctgactccctggttcaagagattctcctgcctcagcctcctgagtagctgggattacaggaacgtgctaccacgcccagctaattttttgtatttttagtagagatggggtttcaccatgttggccaggatggtctcaatctcctgacctcatgatctgcttgcctcggcctcccaaaatgctgggattacaggcataagtcaccatgcttggcccctaatttttgtatttttagtagatacggggttttaccatgttggccaggctggtctcgaactcctgacctcaggtgatccacccgcctctgcctcccaaagtgttgggattacaggcgtgagccaccacgctggcctcatatctttagcacagtacttttgtagtttttctccaactccttgttaccaatctacaatagaacttggttatttaagaaaatttagttgttattagtattattattgaaatggagtctcgccctgtcgcccaggctggagtgcagtggtgtgatctcagctcactgcaacttctgcctcccgggttaaagcaattctcctgcttcagcttcccgagtagctgggattacatgggcacgccaccatgcccagctaatttttttgtatttttagtagagacggggtttcaccatgctggccaggctggtctcgaactcctgacctcatgatccgcctgccttggcctctcaaattgctgggattacaggcgtgagctgccgcacctggccaaatatagttattattaatgtggatagattttatcatttttgtgtatcatctgtgcttattagtgttaaacaaaagacttaattgtgtgcttgttaacttgactgtaaatctttccaatgattcttagtgccaaagtttcagctttgtttccagttaatcaggatactagccaaagttagaatctttcaataacatttgagtccctattttcaaagaaaacagacaaaaattctttaaaattagaaagagcttttgttctaatcttttaaaatataagcattttataagtgccatagagtttaagtgttgtaatcaacacttagttttgttggtaagctgtgatggcacccggcacttttttggtggtgctggggcgggggatgacatctgtctggtacatttttgtaactttgttcagatctcagacatatgcttgtatcatgtatgagtaatctgttaaaaacattttcatgactagccttgtcatttttgggcaaataattttcaattttcatattaaatataagttggaactgggtgtgatagctcatgcttgtaatcccagcaatttgagaggccgaggcgggaagaatgcttgagcccaggagttggagaccagcctggacgacataatgagaccctgtcttagctactcaggaggctgaggtgggaggattatttgggacccagagggcaaggatgcagtgagccatgatagcaccactgcactccagcctgggcaaatgtctctttaaaaaaattatgtgtgtgtgtgtgtgtgtgtgtgtgtgtgtgtgtgtgtgtgtgtgtgttggggtcggggttagattgaatccagaagaagtataaaagcatgtctttatttatttatttattttgagatggagtttcactcttgttgcccaggctggagtgcactggtgcgttcttggctcactgcaacttctgcctcccaggttcctgcctcagcctcccgagtagctgggattacaggcatgtgccaccatgtctggctaatttcttgtatttttagtagagatggggtttcaccattgttggccaggctggtctcgaactcatgacctccacctgccttggcctcccaaagttctgggattacaggcgtgagccaccggtcccggccaaaagcatgtctttattattggttcttcattcattgaacaaattccatgagccatacattatactgagttttggtgatatagatatgaaacatttctcccctgttaagggacactcaaaatttttttgttttttttttttgtttgtttgtttttgagatagagtctcgctctgtcacccagcctggagtgcagtggtgcgatcttgactcactgcaagctccgcctcccgggttcacgacattcttctgcctcagcctccccagtagctgggactacaggcgcccccactgcgcccggctcattttttgtatttttagtagagacggggtttcaccatggtcttgatctcctgacctcatgatccgcccacctcagcctcccaaagtgctgggattacaggcgtgagccactgtgcccggccgggacactcaaattcttgctcagactctctgaagggaggttaaggaaatgaactattaacaatacaaagaggtaagtcctaaggtggtagtattaactggctattctgaggttgagaaaggagtcgttcttgaggctcactgcaccttccgcctcctaggttcaagcagttctcctgcttcagcctcccaagtagctgggactacaggcgtgtgccactacgcccggtgcagttttgtattttcagtagagagggggtttcaccatgttggccaggttagtctagaactcctgacctcagatgatccacctgccttggcctcccaaaggggtgagactacaggcatgggccactgcacccggcctgagtttcttcttaaagggctaaataataattactcaagtaaataagggtaggaatgtgataggcattgccagccatgaaattagcacatctaaaaggatgaccacacttggaaaattcctagggtgttaataaatatggtgatttcctagagtgttaaattactaaattgatcacagttgtaaatttaatttgctagctaagtgagcgatagttcaaatgttttagttctggccagaagttagatgggaaagagatggaaaagacacccattcccccaagggttgggagtagggggcattcttcctaatggagagtttcaggtgtatctgcagaatacctatcccaggaaatgggagtgatgacaagattacaaatattttctgaccttgataattcttgagatctacacagttttcgtaaggaaagaagtcatcttcatggaagaggtataattgtcttgttctgtgtctgtgagcacccaagaaaatagtgtgaggctgagaggtaaaccttcctttaccagctgccaatgttgaaaaacaaaatttattttatcaactgtatttcattgtccacaatggttctgcctgtaaattagcctcccagagctgctccagaaaagaaaacatggccctgtttggagtatatagctatcgagagtctcatataagaggcgttttccttttatctgaccccgtgaatagatggtcatgttctggtctttccatgttgttcagttatgatgggcaaagaacctgtaggagattaaagcagctccattgtgtatggcttgtgctcctgatgatcttactcagaatcccatgattttgtcgggttttccccttttcatgtaagtgttgtgctgcttaaggatttccatgttgttctagaatgtagtgttttttaagctagagtaattctttctcttcttttttttttttttgagacagagtcttgctctgttgcccaggctggagtgcagtggcgcgatctcggctgactgcaacctccgtctcctgggttcaagcgattctcctgccttagcctcctgagtagctgggtttacaggcatgcaccaccatgcctggccagtttttgtgtttttagtagagacggggtttcaccatgttggtcaggctgggagtaattctttatattaattgaaaatgatttttttctaaagtagagaatcctaatcaaggagattcttttctggggagtctcatccattcagtatttattaaatgctgatgtgtgccaggcaatactgaaggttttgaaaatatgtcattgaataagatagacttaaatacttgccctatatttctttgggaaagagaaacaataaatataattaaaaagtcaatttataatgttagaaggcaataagtgttatggggaaaaggtaaatggtaatatgagagtattgtagtgagggtggggtagtacttttaagtagggcgggtcagggtaagcctcactgagagggtaacatttgagcaaaaacttgaaggagtgagtcatgtgacagaagagtgttccagttagaaggaacagttggtacagagtatttgaggtggattaagcctgtcatctttaaaagcagcagtcaccattacttagtacagtgagccagaggatgactgtaaggagatgagggcagagaggctgtgggtgatgtgagtactttggcttttacactaagtgccattgaaaataaactcctaataagactgaatcagtagaatttccttctcagagatttagggtcaaggaaaaggtaagcagtcagagaaggaactctgtaacttctagacttaggatagcaaaaattaatgcatatccgttagacataagattatggcaaaacaaataatgaagttctttgctgatattttctactttatttttgattatagggactttcagttaccttgatgatgtcccatttaagacaggagacaaattcaaaacaccagctaaagttggtctacctattggcttctccttgcctgattgtttgcaggttgtcagagaagtacaggtaagtggtaatttttagttaaagtttagtgcatttaaaagtttaaagagtaagaatttgatgtatagtgaaatagaaaaaattacagttgtgagctgaatcatgttttggtcaacgatggaccacatatacaatggtggtcccataaaattataaggggctgggcgtggtggctcacgcctgtaatcctaacactgtgggtggccaaggtgggaggatcacttgagctcaggagtttgagaccaggctgggcaacttaatgagacctcatctctactaggggaaaaaaaaatgatagatatatatatatatattcctatcacatagtgacgtagtagccattgtaacatggtagcgcaatgcattactcaagtgtttgtggtgatgctggtgtaaacacatctgctgcattgacagtcttacaaaagtatagcacatacaattcagtatagtatgtaatacaaataaatgactatgttactcatttatgtattactatgctatactttttagcattatctttctacttattaaaaaagttaactgtagaacagcctcaggtaggtccttcaggagatattccacaggaaggcattgtgatcataggagatgacagctccatgcatgtattgctcctgaagaccatacagtgaaacaagatgggaaggtggaagacagtgatactgatgatcctataggcctaggctgatgtgtgtgtggcttcatttttaagaaagaagtttaaaaagtaaaaaaataaaaaatttaaagatcaaaaagcttatagaataagagtataaagaaaaatgttttggaagataaaaaacattttaggctaagtattagttcggaagagtaaaaaagttaaaaaaatttaatgtttataaagttaaaaaggcacagtaagttagagttattatttagagaaaaattgttttttacatttgtgtatatgtgtatatatatatgtgtgtgtgtgtgtgtgtgtgtgtatatatatatgtatgtatttttttgagacggagtctcactctgtcgcccaggctggagtgcagcggtgcaatcttggctcactgcaagctctgcctcctgggttcacaccattctcctgcctcagcctcccgagtagctgggactacaggcgcccgccaccatgcctggctaattttttgtattttttagtagagacggggtttcactgtattagccaggatggtctcaatctcctgacctcgtgatctgcctgccttggcctcccaaagtgctggaattacaggcgtgagccactgcgcccggtcaaaaaattgttttttacaaatttagtatagcctaagtgtacagtgtttataaagtcaagggtactactgtacagtaatgtcctaggccttcacatttaccattcgcttactcactcacccagagcaacttccagtcctacaagctccatttatggtaagtgccctatacaggtggaccatttttaatctttttttttttttttctttttttgagacggagtttcattcttgttgcccaggctggagtgcaatggcgcgatctcgtcaagaagagagactctttctgtctctatgtaacctccgcctccacctcctgggttcaagcaattctcctgcctcagccttctaagtagctgggattacaggtgtgcactaccatgcccggctaattttgtatttttagtggagtcagggtttcaccatgttagtcaggctggtctcgagctcctgacttcagttgatccgcccacctcgacctcccaaaatgctgggattacaagcgtgagccactgcacccagcctatttttaatcttttataccatatttttactgtaccttttctatgtttagataggtttagatacataaatacttgccattatgctacaattgcctacagtattcagcatagtaacatgctatacaggtttatagcctaggagcaatactgtaccatagcaataccgtatagcctaggtgtatagcaggctgtaccatctaggtttgtgtaaatacactctgccctcaccgatgaaatcacctaacatgcattttttagagcgtatccttgtcattatgactgtattatcttatttttgtttcttatagctcctattgttgcctggctcacattgttatacacacatacagattttgtgtcctctgttagattgtatattcctggggccctgtacctcacacagaccaaattcccattgcccatttaactagctttttcacctctttccctttctctgctaatgtcctcattctcttttcagtcactcaagttagatttgctgtgtctcacattgcagttcagcctgacctcatttttcacctgggctgttgcagtagcctctttaattggcccttctgcttgcggtgttttccttctattttttacatagtttctagaatgatcttaaagttttaaattgtcacatcccttttcataactgttcaaaagggttcaatgactaaccagtccttattgagtatagtctagacataaggttatgacaaagcaattgagctcatcacctcctccatgttccctccaaaccacgttactagtagtctgttagaccttgtacgttatctctctatatgttgcttctgctcatgagccgttatctccacctggaatattctttttctcactatactgaaaactccgttcaaatctattctagattgcgtgtaaatgctatctcttcgagggcttctttctcagtcctcccatctttaaggctcagttatatagaaatgtactgagttactccttgaaagcaacaaatagccctgtgttacttacttactgcagtacacatttactaaacgcatgtttatgagaggtggtctactgggcactgcaggtagagataaatgccttaatcactgccctcaaggtacttacagttgagagaagttacctagagcaacagaaaaatatggtactttaactcttcttcctgtgacttaagaagatttttaaaaatgcagctttcaggaaaagaagttttgtttttctggaattcactaaggcatcaccattttattctaaaaggtattactttttttatcttccaaagtctatatgcagtaagtaatcataatgagggaacttcagttacttttgggagaaaaaaaatatttattgagatataattcacataccatgaaatttacctttttttaaaaaaaaactttttttggtttatttgtagacacagtctcactctgtcactcagggtggagtctagtggcacagtcatggctcactgcagcctcgacctccctgagcttggtgatcctccctcctcagcctcctgagtagctgggactattggcatgcaccaccatgcctggctaatttttgtattttttgtagagatggggtttcatcatgttgcccaggctggtcttgagctcctggcctcaagtgatctgcccacctcagcctcccaaagtgctgggattacaggtgtcagccaccatgcccggccaaaattcacctttttaaggtatacatacagttcagtgatttttaatatattcacatagttgtgtaataatcattactatctaattcccgaacattttcatcaccccaaaaggaaacccagtgtccactagaagtcactccccacagcctctggcagcctcctcgcagcctctggcaaccagtatctactttctgtctctatgggtttgcctattctggccatttcatataaatggaattctgcagtagcagccttggtgactggcttattcacttagcataatgttttcaaggtttatccacgttgtatgaatgaggtattagtacttcatttatttttgtaggtgaataatatttcattgtttggatataacacactttgtttatctgttcatcagttgatgggacattgtggtagtttctaattttcggctattatgaataatgatgctctgaacatctgtaaacagatttttgtgtggacacatgttttcagttttcttgggtataatgtataggaatggcattgctgggtcatagtaactctatgtttaacattttaaagaactgctatttttccaaagtggctgcacaattttacaatcccagcagcactacaagagggtaccaatttcttcacttccttgcccactcttattaactcgttttcattatatacattcttgtgggtgagaagttgtctctcattgtggtttttatttgcatttctttcatgtctaatggtgtcaagcatcttaagtatctttaatactgaattaatgttccttttgtgtatggagactttattgggccagaagagagatagacctactttgtaacgtttttccatgttttatttgtgtaagaatttttttattggcaataacaaatagtcattacttacctttgtacatgatactattagcaatatgatttaaaaacacctgtcttgtttctcattattcactgctttactgatgccttcagaaaacttgttttgattcccaaattgtcgatttaggctttgctgggaatttcccatttggtcagtctgaagcaccaataaaagcatggtatgtgctcactgtgctcatagcacccactgataacaaaaggagatcaaagctaagagctccattccaatgtgggccatgtgaaatatttttgttctctaatgcacaaagcaatctttttttgagatggagtcttgctcttttgcccaggctggagtgcagtggcgccatcttggctcactgcaacctccacctcccaggttcaagagattctcctgccttagcctcctgagtagctgggactacggcatgtgccaccacacctggctaatttttgtatttttagtagaagacagggttttgccatgttgaccaggctggtcccgaactcctgacctcaagtgatccgcccaccttggcctctcaaaggaggccaagcctgtctggcctacaaagcagccttaaactttgactgtctggagtctccatggggttgtagtgttgtatctggtcccctccgtacccagagaacagtcagacctagagctctagacagatggcttgaaagttcctataactgtcatatttgcctttgcatgacaatacaaactcaacttttcagctaaaatttctttagagtgagccagtaaaacatacacagcccttgcttctagggtccagaaagcttctgttgaatgtggctcacgtgaggtagcccttagtgtcatggtttagaacatcctctggtgtcactcatacatgtgctggagaattgacctgtaatagctatataatcttggacagattttttaacttctgcaagcctcaatttcttcatctgtaaagggaggatgaggatgattagcttttaaggttgttagaagagttaaataatgcatttataatgcttactctggttcctggaactccataaatacaagatgacattatttattattatactccaaaaccacattcttttctactttaatatttctgccatcctcagccccctccctccctgcaccgcaccctgctttttctgcgttccaagtattctacattactttggtaactaaaaaacaaaagttcaataaatgtttgctagaaaaggaaagaaatttccaatttttttaaaataaaacttcaaagaacaatgtttatagggcaatgggaagttagttatagcctccatttttattaggggaaccaattgcaaaattgggttttctccacagttagaagagcagagtcattgccactgctcttttctcattgttccattagtggtagaaaggaagcccagtgatccccccatatgtctatctgaggcacagcagctggctcaggatgtaaagtaacttcttgtcatgtgcctttctaggcttctcttttgttgtttgaatttgaatggcttgagtatgaccaggggctctttcctatgtttcttctctaaaattctggtgttagcacgttagacctctcttttcccccttttttacttttagtgtgtctctcaccttggacattaacacagatactgtttagctctagtgctttggggtgaaagccaaagattttgttttttcctgtcctatgtgaatgttgctttatataataggtctgtttctcttaagtgtgcaaaataaatttttgtaaattgagctatacttaagatattgttaaagaaccatgaagtggctctttgtgtaatttgctgtgtaaaaatcttaatctgatttcttataagtttttctgcattttaactgcaacctgttcatcataatctaatagatagtggtttaagagcatagaatctgtagtcagactgcctgggttcaaatccaggctcttccatttagctaccagctttatgcttggttgtagatcctgttaagtaggaataatagtagttactttaaaaggttattgagaaaatctagagagttaatgcataaaaagtgtttagaatcatgcatggcaccttacaggtatttcttacatgtttggggctatcattacctagcatgggatttgtttaggacattgtgctagataatagagatccaaggagggtctgtagccaggttgctgcccacaagaggcttgtgggaacatagtttggttaaatcttacaaggacattggaagccttactctttttaagtggggatcatcccacacgccttaaatgctgccttgtccggttatcctcttgcaccaggagtgaggaaggagtgaattgggtggtggggtaaagatggccacctgggttcacacccccttcctctgctatatctttgcagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtaagtcttttaaatcccccgccgactcccatattttcctgatgacagggattatgttttttcttgttgtttggttgatttttttcgagacagggtctcattctgttgcccaggctggaatgcagtggtgtgatcgtaccttattgtagcctcgacctcccgggctcaagcctgttgggacaacaggcacatgccatcacacctaatttttgtgttttttgtagagatgcggttttgacacgttgcccaggctggtctcaaactcctgacttcaagttatctgcctgccttggccttccaaagtgctgggattacaggtgtgagccaccaagactggcagtacagaacaacacattattgcattctagaatagaaatcaatagaagtcaagaaccttttgctacaccagcttacagatttcttttcctttcttttttttgagacagagtcttgctctgtcgcccaggctggagtgcagtggcaccatctcggctcactgccaacctccacctctcacgcaattctcctgcctcagcttcccgaatagctgggactacaggcatatgccaccacactcagctaatttttgtatttttagtagagacggggttttaccacgtttccgaggctggtctcaaactcctgaccttagttgatccacctgcctccacctcccaaattcctgggattacaggggtgagccgctgtgtccggccagcttacagattttttaatgtaaaagcacatcaagagactatttagagccaaaaaggagcctgagtatattggtgggatatctgtcagagaccataacaagcctgctattagctggtaaaaagatacaaaatcttggcctgctttacaagtcccagtaatagcattcttggtcaatgatagtctgtgtgaatgcttctattgtcagagagctcatagctgcttgtaaacttccataaaccttggcccgggtaaacttgatagagtgccgaacaccattattatcttcttggagtgggcttcattctaattcctcttggtcagttgttgggctctggtcagcactgtacttcttccttttcatggtactttgaatgctttagagaaattaaaatctccctggaaaagatcagggatccttggccaacactcccttcctctcatttaaagttagattaaccatttagagatcaaagccaataaactaacagcagagatctttctcaaactagaacgcttgtcattctttgaccagcctgatgatgggagtttctttctgacctgttcatctcaggatgggaagaggcctgcttcttgttggcttgagaatttgctgccttccacctgcaggtataaacagagctggagttctggtgtttcttttttcttttttttttttttgagacagattctaattctgtcacccaggctggaatgtagtggtgtgatctctgctcactgcaacctccacctcccagggtcgggcgattgtcctgcctctcgcagcctgccaagtagctgggattacaggcatgtgctatcgtgctcggctcatttttgtatttttagcagagatagggtttcgccatgttggccaggctggtctggaactcctgtgctcaagtgatccacccgcctcagcctcccaaagtgctgggattacaggtgtgagccacagtggctggccaattaaatattgactataatcaccctgttgtcttatcaaatggtagatcttattctatttttttctttgcttttttcttcaacagagtctcgctctgtcgcccaggctggagtgcagtggcgtgattttggctcactgcaacctctgcctcctgggttcaagggattcttctgcctcagcctccagagtagcagggattacaggcgcctgccaccatgcgcagctaatttttgtatttttagtagagacggggtttcaccatcttggccaggctggtcttgaactcctgacctcgtgatccgcccgcctcggcctcccaaatgctgggattacaggtgtgagtcaccgcacacagccattctttctattttttttgtacctattaaccaccagcccccgactactacccttctcagcccctgtggtaaccatccttctagtgtctatgtccatgggttcaattgctttgatttttagatcacacacataagtgagaacatgtgatgtttgtctttctatgcctggcttatttcacttaacataatgatctccagttccatccatgttgttgcaaatgacaggatctcattctttttcatggctgaacggtactccattgtgtacgagcaccacatttttttaatccatccttgtttaagttctttcactttactctttttttttttctttggagacagattttgctcttgttgttcaagctggcgtgcaatgttgcgatctcggctcactgcaacctccgcctcccgggttcaagtgattctcctgcctcagcctcccatgtagctgggattacaggcatgtgccaccacgcctggctaattgttctatttttagtacagacggggtttcatcatattggtcaggctggtctcaaactcttgacctcaggtgatgcacctgcctcggcctcccaaagtgctgggattataggtgtgagccactgcacctggcctatccattcatctcttgatggacacttaggttgcttccaaatcttggctattgtgaacagggctgcaacaaacatgagagtgcagatcttgtttatgttttactttctgggacatatccttaacttacaacttcaaaaaaaaactactaaatcttacaaccttttattttatttaatttatttttccccctgaacttgatagtaggtgattattttttaagagatgggatttttgtcccctaggctggggtgcagcttactgcctcagcctcctgtctgggactacaggtgtgcaccactatgcccagctgatttttgtagagttgggggtctcactgtttgcccaggctggtcttgaactcctgggctcaagtgatcctcctgcctcagcctcccaaagtgttgggattacaagcatgagccaccatgcccagcctaaatcttactaccttttaaatacaatttttactttatcatattttaaatttccaagtgctttgtctattccctcttttggtttggtgttttcatgctggtggctttggctttctattcacgtttaagtatgaggcactaaaaaaataacagtcacaaagtttgtgtgtcagaggtgtgcttgctgatcattaagcttcactataggttgaaagttaattggctttgccggggaagtccccaaaatgtaaacatgtgaagggcttgggtgagggtttctccagagaattctggctgaggactgatgttggggaatgctggtgtgttgcttttacttaatccttgtttaagttctttcacttcactctgccccacactgtgcctggtgcttagtcctctttggtctctggttcccattttctggagactataccttctgcctcctgcacagggtggggatgaatggggactgtttcaccaagggctttactgctctgatcactgactgtgtgtatctttgccttatcccaacagtacctggtgcttccagagtctgagcccctcttagggatcctaatgggctgatagactgactcccccctttcctacttacttacttagtttataacttcattgctggcaattaccatcccttcattatctttccacattctaaaatttcattgaaatatatcacaccagtaatcccagcattttgggaggccgaggtgggaggattgcttgagcccaggacttcgagatcagcctgggcagcatactgagatcttgtctttgtttctttatttaaaaagaataagaaatatattgtccactgctaccccctttccttttattgctttaaagatgaatacagttttaattctttatttttaaatttttattattttttttgagacagggtcttgctctgtaatcacggctcactgcagcctcgacctcctgggctcaagtgatcctcctgcctcagccttctgggtagctgggactacaggcacgtgccaccacacctggctaactttttgtgttttgtagagatgagtctcaactatgttgtccaggctggtctcaaaattctgagcttaagcagtccttctgcctcagcctcccaaagtgctgggattataggcatgagccattgctcctggccttagtttgtttatgatcattttagtgggcttttgggaagaagagatggtaaagacattttagtgtgttaaatgaaattctccctttgaaaattctaatggacttcaatttattccacaactgttgatgaagaccagtaagtgtaaagccaagagtcaggccctggggatttagaaatgggcatgacatggtaactgacctctctgcaagctcacactaatgtaatgtgataagtactttgccagcagtgtgactaaagctctgtgggaccacaggtggcagtgtgtccgctgagttgtgcacacacattagcagtgggttaaaaggaggtttatggaaagacttggtagaagctgtcttgaggttaggcttgagggccacataggtacagaaaggactgccaccttctgaggcctgagagcatgctgagactcttcagaagcttgagcactaatatttgtctcctttcacaaacgtactttccctcaaacactcatatttaatttggaaagatttcataataattctcatttttgtctagtttctacttggttacaaatatggagcacttcagtcatcgagtatgaaaatccctttttatgccagagtcaacctttgcccctgcaggaagtaaattttactattcttttattgaaaaaataatgacaaatggctaccatgaatgcagttaatggtgtttaaaaagtcatatctagattactcctaagagccttatatatatttgaaaatggtaccctggagtaaataaatttggtgagtaactggagaaactaaacactgttataattttgatgagggatcctttcaaaccttgtctgtccgtttggggtctgctggattagcctgttgcctgtttgattcatgaaacatttatatgaaggtgacatcttattttgtttgtccctgttcaagaaaagtatcatctgttaggatagatgatacttttaaatcatccatttaaaatcagtcatttaatatcccgtgcatctttaaaaaatattgtagagcatgtacaattaataaatatatctttttttcttatttatttatttatttagagacggtgtctcgctgtgtcaaccaggctggagtgcagtggcgcaatcttggcccactgagacctccgccttctgggttcaagtgatcctcctacctcagcctcccaagtagttgggattacaggaatgcaccaccacacttggcccattttgtatttttagtagagatggggtttctccgtgttggtcaggctggtcttgaactcccgacctcaggtggtctgcctgccttgccccccaaagtgctgggattacaggtgtgagacacctcacccgctgttttttcacttaattcagatgctttaaataattaacagtcgtatgttcattatttgctaacctaacaccctgtgctggatatttggtaggttgtccctaaaatttattacaaatgatgttgagatggatatattcctatacataaatattggtttgcattattattatttcttcagactagtttcctagaaataggtaactggatcaaagaatctgagcagttttctggatttatgccatgtttacctaaagcataccaaataacatttccaccagtagggtatgtgagagtactgcatgtatgtttaaaatagatacgatttttttttttttcagacagtctcactctgtcacccaggctggagtgcaatggcatggtctccactcactgcaacctccacctcccgggttcaagcgattttcccacctcagcctcccgagtagctgggactacaggcatgtgccaccacacccggctgatttttgtatttttagtagagatggggtttcactatgttggccaggctggtctcaaactcctgacctcatgatccacctgcctcggcctcccaaagtgctgggattacaggcgtgagccaccgcacctggctagatatgattttattaacatttgtaatgtgcagtattctgggtgtatgcctgcatcccaccaggcatttaggaggcattatgagaagggcaggcagttgaagaatagtcctgactccttcctggctggggaatgtcatgtgagagctggcattgctctgtggctgttggtttctttagcccaggttaaagcccgtctctaaagagggagacacaatcttagacctgccaagtggctagactggtgtgatccaatccctgtgccttattgtgactcttgtaccataatgacagccctgtgcttgggctgctgagtgtgtgctgtgggtgagatggttaagcaccaacagaatgggctctgaggcctatagccatcctggctttccccagcagactttgaggagagcatctggttacatctgtataatttcgaacttgcttctaggacagagggcttcctaccacctaaccatgctccctctccccaccaataaaacaaggaaataaaaaaatttttgtgtgaacatcttccctggttcttgggacctgcgccaagctgtaaaagggcttgtgacctcgttcctgtggtcagtgggtcctttggcctgggagtgtgctgtcttcctgccttgggcttgatttgtgatcagaagtggtgggggagttaatcacggcactctgtacgcctatccgactggggttagtaagttccagtggcagggagcaggctgcctgtagctggtgggcaggtccctagagtccagattccagtctgtgggatccagcctggtgtggctagtatgccttctgtcctggcactgtaggatggcagctttggcaggaaacgaagcacagtacatgatgtagggcaaaggtgtggagtaccctcaaaaccctgggttcctgagctgtccaggttcctaagctgtccatgcatgggaaccacactcacagcctctgccgaagagtagagactttgggatagagttagctccaaagtgggagtatttgaagtgaaaaatgatgcctcagaactgatacttcagcctgggaaagggataatgctggagagaaatcgcagccagcttggacatcagtcccgggggcagccacagcttctttcttcaactcaaatcctggagatttgggcatgcaagggcctgtcgtgttgtggcgctttctcaatcaccaaagtgggactagggcagagcaggacagccacaattgcaggtgacctcccacctttttccctctcagctggcactcccctacccctctttgttccttttcagggtgtctgaccagcaacctggcgatttcttccaacctgaccgcttttcttggggcttgaatagtgtcagaaatgccaacccctggactaggctgcctcagtgacttctttgggggcccaggtcttcttgccttaatcttcttgtttttccactaggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcaggtgagcggttggtcagccaggagggcaggctcagacctgtggagctggagtagtgtcctcccctgtcctagagcccctcagacttgtagcaccaacctcctttcctgtgggtttgtgaggacacggggcatgttttggggaaagccagcagccttgggagcagtacttcttttggaagctattccgggacccaggctgagagacagctttgggagaattggagctgttctccaactaccccctcctttctctgcctctccaaaaggggcagagctaggcttggggtatggtcaaatgtctctttccaggaattttcatcctgtcatctatgcccagagtgttgaattagggtactggagtgttagaccttggtgacattttctgacttgggctgttttcttagagtagccgcctgcccaggctgtggagttgaccattctggtgggcgtgtcagctgtggctgcaactcctttggaaaatgcctgctcctgtttagaaggctgtgcctgtgttcattaaagagtcactggggtcctgttgtgttggacacagtcaaggcacaaaatcaaatcctatccagtatctgacggcctgggtggggcggagaacggacttcacacactagtttgttgaggtctcttggaaagcacagcaaagagcagcagtaggtgctaaaccccttgtttcttttcttagattctcgactatctctttgcacatggacagctttgtgagaagggcttcgaccctcttttagtggaagaggctctggaaatgcaccagtgttcagaagaaaaggtgggaatcttcatgtttcttgggaaccctctggaaaaggagggaccaagtatccatcctggttttctcccttggcccacacacaacctttttgctttgccagtgactacaggtacaagtatttgaagggcagaatctcccaagtattcagacaggccgaggcctgcgtttggcttggtggttgaagcattgggttgaaaacttcagaatcccagtgaagggaagggaatattggcctgggctaaaagccaaacttcttagatgattagggagggagattgctggactttttgcctagactgctctttgaagagcagccatttctgggttcagtatccttccttggtgggaagatggatgtgggtggtgggacccagacagagctcagcaacagtgagctgggactgggctgactcctgaaggttgatggccgtcaccaaacccgtttgccttggcttccaccacagcccacctctgcttgctaggggaccttatggagactcacggggctctgggggaaggatgtagacattctgctctcccccagtccccgtcccacacacacactccttcactcagctgtgctgtgaccccacccttttctttaatctgtgttctcttctctcccttagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggt

SEQ ID NO: 38805 - DNA, 18040 bp, Homo sapiens; identical to SEQ ID NO: 38699

SEQ ID NO: 38806 - DNA, 37853 bp, Homo sapiens
cgctcataaaaggaaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtaggtggcgacgggccgtggcctgagacctccggcgaaacgcgggagcgaagggctgagtcctccctccgcgccgcggctcccgacctccctgaggcggcgctctaggggcggtgcgcacgcgctctgggcgggaggggggcggggctcgtgggggtgggggcgggagaggagggcggggccggggctcggggagggcgggccctgcgcccggccgctcgaggtctgcgcttgcgtgcttccatccccggcgagggtgggaaacagcgacacgctgggctcggcacggacgcagcttccaggtggggtactcggacccgggtcacgaagatgcggacagaggatgggccccgaactccagcacttattttatgatttgcacaaaaattttgtatatatatatagttcttaacaagatacactaacagctcgtcgtttgcccaggaggctcaacctcccgcctcggcctcccaaagtgtggggagtataggcgtgagcccccgcgcccggccaaaaaatgcccgtcttaagaacaacaaaacagcctccttcaccctcgctatcctccagttacctcctcctcggctccggtttgcagccaaaggccttagtctaccctcactaatgccttttctcctccaagtcttgaacccttgagcctctagtcaggctttggtctccaccactccactaaaaaggcttcttgtcaaagccaccagtgatctctaggtggccaaatgcattgttaagttaggtctcagtcctgttcagcatttgatgctgtggatcactgcccctccttgaaacactgttttcatttggcttgctgaacgttctcttcctttgcctctgctctctctggcttctcctctgctgattctaacctaggcatcatctcacatttttgtttttattagagacacgttctctgttgctcagactggagaacagtggtgttattacagctcactgcagcctcaaactcttgggcttaagcagtcctcctaaccaaagcctccccaaatgctggaattacaggcatgagccaccgcaatcccagtttcacattttaaatgtaaatactggccaggcgcggtggctcatgcgtgtaatcctagcactttgggaggccgaggtgggcagactgcctgagctcaggggtttgagaccagcccgagcaacgtggtgaaatccagtctcttctaaaaaaaaaaaaaaaaattaaaaaattagccgggcgtggtggtgcacgcctgtaatcccagctacttgggaggctgaggcacaataatcacttaaacccaggaggtggatgctgcagtgagccaagatcgtgccactgcactctagcctgggtgacagagcaagaccctgtctcaaaaaagagttctagaggtggaagaaaatccacatataagtggacctgcacaattaaaacctgcattgtttgagggtcaactgtatagctattttaaaagagatttattgtgatggattgggtgacactattatagaggctgagaagtcccgagatttgccatctgcaagctggaagcccaggaaagcaaaccctcaggaaactcacagacacactctaaagtgtttcaccagctatctgggaatcccctagcccaatcagtttgacacataaagttaaccatcacatttccctagctttgtttttcagttgcctcaatcatcattttactggtgatactttgagtgttgtcataatagcctaatggtgggttggcagcttccacttttgtgatctcttttactattgaatatgctgaagtcgtgacacaacttggaattcagaggaagagcataggttttagaacttgcagccttgcagccccagctcaactacctatttttcctgagttacctagcataacctatctgaatttcagtttcttcactatacttactattctgttatctattttataggattgctgtaaggtttaaatgagaaacactggcataagttgcaatacagaggcatgaaggaaaaaaattgtcttcttaatgtctctttaaccaattgatgaatatagattctatttatttatttatttatttttgagatggagtctcgctctgtcacccaggccggagtatagtggtgcaatgtcaactcactgcaacctctgcctcccgggttcaagtgattctcctgcctcagcctcctgagtagctgggattacaagcatgcaccaccatgcctggctaattttttgtttgtttgtttgtttgttttgagacggagtttcactctttgttgcccaggctggattgcaatggcgcaatcatggctcactgcaacctccgccttccggtttcaagcgattctcctgcctcagccttccaagtagctgtgattacaggcatgtgccaccacacccgattaattttgtatttttagtagagacagggtttcaccatgttggccaggctggtcttgaactcctgatcttagttgatctgccggccttggcctcccaaagtgctgggattacaggtgtgagccattgcgcccaacctacttatgttttttttagaaacaaggtcttactctgtcacccaggctggagcctagtggtgccattatagctcattattcccaaattcctgggctcaagtgatcctcctgccatagcctcctgagtagctaggactacacatgtgcaccaccctgcccagctaattattttattttgtttttgtagagacagggcctccgtgtgttgcccaggatggtcctgaactcctgacttcaagtgatcctcccatttcggcctcccaaaatgctgggattacggtcatgagccactgcacccagtttgcagattctcattgctagtgactgggttgagagtgtgggatgtgagtgtggggtattaggttcctctttccctttgacccagaacaaagctcttactgttttaagccctgtgggattaatcttagagtggcttaagtgtaggatatttggatttgtttatttgaggccttttatgctattatagtaaaagggccagcaattttaggctgggtattagtggttaacatatgcttctaccctgcagcctttgtccctcagaattggctatctcttcagaccgtgcttaatgaaagttcttattagtcaagctactcagttgcagataacaaaaagctactctgactagcctaagctgaaaggggtgtttgttgactctgtgatattgtaaaatatatatctggtttgtatcccagtttggagcttcctggagggtggcgtgcccagggtgggtatggaagctcttcgctccttcccacatgctttgccctgtgcacctcttccttcatctgtatccattgtgacatcctttataataagccagtaaacctaagtgtttccctgagtgctgagagctgctcctgcaaattaatggaacccaaggagggagtcatggaaaccctgatttatagtcagttggtcagaagcacaaataaagcaactgggggcttgtgactggcattgagaattggggggacatgctcgtgggactgagccctcaacctgtggggtttgacactctgtctgggtggatagtgttggaaataaactgaattagaggacatccagcgtgtatccactgcagactcaatggattgattggtgttggggagaaatctccacacatttggccacggaaatcttatgtgttgattatcctatattgtgacagcagaggagaaagttttgttttttcctcacagactgtagctgaagagtcctggagtaaatcagtttcagatgggactctatccagaagcctaaattatgtcaccagtattttctgtttttctttctctgttttttttttttttttttttttttttcagagacggggtcttgctgtgtttcccaggctggtcttgaactccaggcctcaagagatcctcctgcctcagcctcctgaaagctgggactacaggagtccaccaccacacctgggtacttttttttttttttgaaacggagtctcgctgtgtcgccaggctggagtgcagtggtgcagtctcgactcactgcgacctccacctcccgggttcaagtgattctcctgcctcagcctcccaagtagctgggactacaggcatgcaccaccatgcccagctaatttttttttttttttgtatttttagtagagatggggtttcaccatgttggccaggctggtcttgacctcttgacctcatgatccacccgccttggccttccaaagtgctgggattacaggtgtgagccaccacgcctggctgcacacctgggtactttttatttttggtagagatagagcctcgctatgttgacaagtctggtctcaaactcctgggctcaagcaatcctctgtacttggcctcccaaggtgttgggattacaggcatgagccactgcgacccgcctgtttattggttttgttaaatgccttgtcatgaggcattaaaaagcccatgatggaaagaagatagccccagagaagggattccaaattcttcacaaattcttcaacagatgagtggattaaaaacgacatctatccatagaatggaatgttatttaaccataaaaaggaatgaagttactgatacatgctgtgacattgatgacctttggaaacatgctaagtgaaagaagcaagtcacataaggtcacagtacaattctatttatatgaaatgtctagaataggcaaatctacaaatatgaattagaataatggctgccagtgactgagaggagaagggggtggggaatgactgctaatgagtataaggttttaaggagagttggtgaaaatgttctaaaattagatagtggtgatatttgcacaaccttgtgactaacataacactgaattgcacactttaaaaaagtgaattggggtgggtgcggtggctcacatttttaatcccagcacattttgggaggctgaagcaggaagattgcttgagcccagtagtttgagaccagcctgagcaatatgatgagacctcatctcaacagaaaattataaaattagctgggcgtggtggtgcacacctgtagtcccagccacttgggaggctggggcaggaggattgactgagccaaagaagtcaaggctgcagtgagctgtaattacaccacttcactccagcctgggcaatgagagtgagaccctgtctcaaataagtagatagagagatagagaattgtatggcatgcgaattatcttcattaagctgtttttgttgttgttgttgttttgagacggaatctcactctgtcacccagactggagtgcagtggtgcgattttggctcactttaacctccgcctcccggattcaagcgattcttgtgcctcagcttctcaagtagctgggattacaggtgtgtgccaccacacccagctaatctttgtacttttttagtagagacagtgttggccaggctggtctcgaattcctggcctcaagtgatctgcccaccttggcctccaaaagtgctgggattacaggtgtgagccaccgcacccggcccattaagctgttattttaaaaagtctgcctaaacctctgaactagacaaacatggggcatattccaagcaacttagccaagtttaaaagatcagtacagatttcagctgatgcttgcctcagggaagctagatttggagtttgagttcagctgtgattaactgcatgttaacagaaacaaaacaccaaactctcaagaacataacagaatccagagtctacaacacatcatctacaatgtccaggatataatccaaaattcttagacacaagaaatggcctgggcatggtgtcttatgcctgtaaacccagcacagcactttgggaggctgaggcaggcagatcacttgaggacaggagtttgagaccagcctggccaacatagcagaaccccttctctactaaaagtacaaaaaaattagctaggcgtggtggtacacaggaggctcaggaggctaaggcacaagaattgtttgaacccaggaagtggaggttgagctgagatcgtgccaccactccagcctgggcaacagagcaagactctgactcaaaaaaaaaaaccacgaaaattttaaaatatatttttacaaaacaggaaaatatgatctgtgttcacaaaaaaaggcaatgaatgggcccggcacagtggctcacgcctgtaatcccagcactttgggaggctgaggtgggtggatcacgaggtcaggagttcgagaccagcctgaccaacatggtgaaaccccatctctactaaaaatactaaaattagctggacgtggtggcgcacacctgtaatcccagctactcaggaagctgaggcaggagaattgcttcaacctgggaggaagaggttgcagtgagccgaggttacaccattgcactccagcctgggcaacagagcgagactctgtctcaagaaaaaaaaaaaaaagaacgaaaattttaaaatatatttttacaaaacaggaaaatatgatctgtgtttacaaaaaaaggcaatgaacgggcccggcgcagtggctcacgccggtaatcccagcactttgggaggccaaggcaggcggatcacgaggtcagcagatcgagaccatcctggctaacatggtgaaaccccgtctctgctaaaaatacaaaaaattagctgggcgtggtggcgggtgcctgtagtcccagctacttgggaggctgaggcaggagaatggcgtgaacctgggaggcggagcttgcagtgagctgagatcgcaccactgcactccagcctgggtgacagagcaagactctgtctcaaaaaaaaaaaaaaaaggcaatcaacgaagatcaaccccaagaggacccagatgttggtatcaactgacaagaattctaaaagagaatcaaaataattagttaaaataaatttttttaaaaatttaaagcagttattaaaacttcgtcaggccaggtgtggtggctcacacctataatcccaacaatttgggaggctgagtcgggaggatcgcctgagcccaggagttaaagaccagcctgggcaacatagtgagaccccatctctacaaaaagtttaaaaattagctggacaggcacagtggctcacgcctgtaatcccagtactttttgggaggctgaggcaggcagatcacctgaggtcaagagttggagaccagcctggccaacatggttaaaccctgtctctactaaaaatacaaaaattagctgggtgcggtagctggcacctgcaatcccagctacctgggaggctgatgcaggagaattgcttgaaacttggaggtggagattgcagtgagccaagatcgcaccactgcactccagcctgggcaacagagcaagactccgtctctaaaaacaaaaaacaaaaaaacacaaaaggtgcaggggaaagaaagaaagaaaagatgtggccttctaagtcagtgggaacacgagcatgctaggagtcaaaaagtttagggtactgggcgttacctcagcattcctaagaatgcttgaaaccttgctggaattgctgagcctctcagggtttgggacagttttgtttacatgatagaattgtgataagattagctggcaccctcggactctgataaaaccagccacttggcctggaagtgcagtgtcccctcatctggccttccaattcattatggttccaaccccagggcctcattcccacttgctttgcaccagcaggcttggcatttgttctcagaaggtcacagaaacctttgcttctacttagaacatgtttcctggggaagtttagacttatgactgaccagatccagagatagcagcactttgatgtaaaatcataggaagagcttgttctctcagacaagccactacccagtaggcaaagctcaaacgagagcccttaaatggtgtggtctttggccaggccatcatcgtggggttattcctaggtttggcaagcgtcagcatttcttttgcttgtgcgattggctcttttgctcagtgtaacagcagacccctggcctccagatgagaagggccactagcgttcactaagtgcatgctctgggccggccactgcctaggacctttcttagatagttgatcatcaagtaggtgctcttgttttaattttattgagacccagaaaggttaaataattcatccagggtgagtgtgaggctttatgagaactttacagttgttctctcccttccccctccttggactattcctggaacatgaaggtccagttcctttccctgatggctgtatggcaggtggcgtacttcatttctttgtgggaaattatacttgtattgatgctgggcatgctgctcgcctcttcagtgttttcccaagtaaggtctgacaaatggggatccaagccctcctgtatttcaggctttattttgggtaccaagatgcaaagacaatccattaagacagttcttggccgctcatggtgactcatgcctgtcatcccagcactttaaggaggctgaggcgggaggattgcctgcgcccaggagtttgagatcatcctgggcaacaaggcaagacctcatctctacaaaaatatttaaaaattagctgggtgtgatggtacatgcctatagtctcagctacttgggaggctgaggtgggaggatcacttgagcctgggaggtgcaggctacagggagccgagattgggccactgcactccagcttgggtgacagagtgagaccctgtctcaaaaaaaaaaaaaaaaaaaaaaaagacttagttcttctacttttaaggggcttgaagtctgagtagaagactcttccacacatagaaagcagtcttaaaagggtgtgtgtgctctgattgtggttatataacatttacagaaggtggatacagaatgaaaatcacttgaggttgttgggatttgctttaaaacatcctttaatgttgcatttttctttcaccttaattaggggaaaaagggagataattggaaacaggggtgaccagagtgctctggggaggcagaggttctgtaataactgttggtagccaaggaggccacaaagaagagaggatgtttgcgtggtaagagtgtgttgccattcgccagatacgtgccagaggcaagggacatcaaggcagtgggcacagttagatggtccactttgaaagttcgtggctgatgggatccagggatagcaagagcttattgtgaaattacaaaatgaggtggttctgccaggctaggcactacccagtaggcacagtgatcttccagaccacgtggtcagctctctccctgaaagtttcaacctctgtgtgttgtgtgtctatctgtgtgtctttgtcagcaaaagcttttatgagatacacaccattttttcttgttatatgtacatgggatatctttaaaggaatacccaagaaacaactagttgcctgtagcgataggagatttcgttgtatttcaaaaataatctgaatttttttactacgtgcatatattgtttactcagttttgtgtgtgtgtgtgtttttctagagaaacagactttttttttttttttttttttttgagacagagtcttgctctgtcacccaggctggagtgcagtggcgtaatctcggctcactgcaacctccacctcctgggttcaagcgattctcctgcctcagcctcctgagtagctgggactgcaggtgttcctgagtagctgggactacaggcgcacaccaccacacctggctaatttttgtatttttagtagagacagggttttgccatgttggccaggctggtcttgaactcctgacctcaggtgatctgcccgcctcggcctcccaaagtgctgggattagaggcttaagccactgtgcctggccaagagaaacagactttatgaacaaccacatgagacagtgagacaggtgatgaggacctaaactaaaacaatgacaagtgtggtgggagagagggggctgcattcccagcttgggaagccagctgtgcagcaatgctgttaaccagcatctagaaggcagagcagtgcgggactggaagtgtgagcatctgcgggtgcatctcagtgggattattcagggggcagttggaagtctgaattgggagccttgagaggtcagggttggtgacactgatttggaagtttagcctgaagctgatgagaatgcttagggagtgcttagagaatgagaagaggatcccggagcgatcttccaccgggttagagaaggaggcggcaacaaaccagaatggtggttagagacactggggagcgtggaggcctggtgtgttagcgttctccagagggacagaactctgtgtgtgtatatatatatgtgtgtgtatatatatatgtatatatatacgtatatatatatatacgtatatatatacacgtatatatatacacacatatatgtgtatatatatacatatatgcatatatatacgtatatatgtgtatatatacgtatatatatgcatatatatgtatatatatgtgtatatatatgtatatatatacatatatatgtatatatatacatatatatgtatatatgtatatatatgtatatatgtatatatatgtatatatatatatacacacacacacacacacacaaacacacacacacacatatatatgagtttattagggagaattgcctcacgattacaaggtgaaatcccatgataggccatcagcaagctgaggaaagagagaagctggtagcataattcagtccaagtctgccagccttaaaaccagggaagccagcagtgcagctgtcagtctgaggcctaaggcctgagagcccctgagaggtgtaagtctcagagtctaaaggccaaagaacctggagtctgatgtccaagggcaaggggagaggaggccaagtgtccggcgtgacacagaacagagccagcacgcggactcagcaagctgctggtcccccttcttccgcctgctttgtgccagccatgctggcagccaactggacggtgcccacccatatggaggatgggtcttcctctcctagtccactgacaaatgtcagcctcttctggcaacaccctcacagacacacccaggaacagcgcttcaccagccgtctaggcatccctcaatccagaccagttgttacctaggattaaccatcacacctggaaatctagagagtggagctttgaggtgcagtatgtaagcaggtgtgcagtgcagcagaaaggtccaggagctgccaggagctccctgggagctgagggtgggctgaggcgtgaatgggagaagtgacgatggtaggtatggtagttttttgttttttattttgagacggagtctcgctctgtcacccaggctggagtgcaatggcgcgattttggctcactgtaacctcctcctcctgggttcatgcagttctcctgcctcagcctctagagtagctgggactacaggcacccgccaccacacctggctaatttttgtatttttagtagagatggggtttcactatgttggtctcaaactcctgacctcgtgatccacccgcctcggcctcccaaagtgctgggattacagacgtgagccaccacgcccagccaggtatggtagttttatggtgaaggaaaggatagtgattcagtcagcatttattgagaacccagtgtgccaggctctctgctaggtatggagagtaaagtgatccctatcctcaaagactggacaaactaggggaggagacaaatatatacaaagaagatttgaatgtgatttggtaggtacagtgctagaaagagggtcttgggggccgggcacggtggctcacgcctgtaatcccagcactttgggaggctgaggtgggcagatcacgaggttaggagatcgagaccatcctggctaacacggtgaaaccccgtctctactaaaaatacaaaaaaattagccaggcgtggtggcgggcgcctgtagtcccagctactcaggaggctgaggtgggagaatggcatgaacccgggaggcagagcttgcagtgagccaagatcgcgccactgcactccagcctgggcaacagatcaagactctgtctcaaaaaaaaaaagaaaaagaaaaagaaagagggtcttaggggaacagaaaggcaacttaaccctgcctaggagactgggagtttcagtttgtgatcagtggaggaggtgacttggtgctaagctagatcttaaagattaagtaattaactgagaggattaggagtgatctggatgtcccagatagagggaacagtgtgaacatagggcaggcatggagataagaaattatgtggggctgggcgtggcggctcacatctgtaatcccaacacttttcagagccaaggtgggcaaatcactttgggctcaggagttcaagaccagcctgggcaacatggtgaaacctcatctctacaaaaattacctgggcgtggtggtacacacctgtagtcccagctactcaggaggctgagcctggagagagaattgcttgagcctgggaagcagaggttgcagtgagccaagattgcaccactgcatactagcctgggcaacagagtgagaccccatctcagcctcccaagtagctgggattacaggcgtgcaccaccacacccagatactttttttgtatttttagtagagaccaggtttcaccatgttggccaggctggtctcaaactcctgacctcaggtgatctatctgccttggcctcccaaactgctgcaattacaggggtgagccaccgtaccccaccagttaattggcttttaaagtacattcaattataaaatcattaccataatccaattttagaatattttctggacacactgattttcttttcattttcttgacttttaaaaatattatttttttaaggctttaacttcagtatgattttttaaatattatttttattatggaaaatttctagccatagagaagtagaagtgtgtaagaaatatccatgttgagcatagtaatttggggtcttttctggatagagatgttcaaccagtgagtgagtatcttagttcatttgggttgctgtaacaaaataccttaggctggatatttgtaaacaacagaaacatattgctcatagttttgaaggtgccatctttgaagcacagagcaagccctcaccagatgccgaatctgctggcaccatgatcatggacttcctagcctctagagcaatgcatttctgttgtttatacattccctagtctaaaatattttgttaaagcagccaaatggattaagacaaattggtaccagaagtggggtgctgctataacaaatacctgaagatatggaagcagctttggaactgggtagtgggtagagactgagttttgacgttcatactagaaaaggtttacattgtcatgaacaaatcattaagcacaggtgtggtaagggcacaggaggagagctgtagagaaagcctcagtcttcttagagatgccctaagagggcatgaacagaatgttggtggaaatatggatggtaaaggccattctgatgagatctcagatggaaatgaggaacatgttagtggaaactgggggaaaggtgatctttgttataaagtggcaaagaacttggctgatttgggtttgtgcctgttgacctaaaggaacaagcctaggcaaaattaatgtagagtttatttgggccaaggttgaggactgcagcctgggacacacttgtaagttgccttggggagtgctctgtttggcctttgttacaagcagatttttaaaggcaaaagggaatgaggagtgggctcacacaaagttttttgacaggggccaggtgtgttgactcacgcctgtaaccccagcactttgggaggctgaggtgggtggatcacctgagatcaggagtttgagaccaggctgaccaacatggtgaaaccccatctctactaaaaatacaaaaattagccaggcatggtggtcggcgcctataatcccagctgctcaggaggctgacgtaggagaattgcttgaatccgggaggtggaggttgcagtgagccaagatcatgccattgcactctagcctgggcagcaagagcaaaactccatctcaaaaaaaaaaaaaaaaaaaaaaaagttgtttgacaggaattctcgttgatttacagagataacatgaattagtgactggctatacattgttgaactataggatatgagaaattacagaaaatgccagtgtatgacattgtatagctactttgcatgagttagtttagagctcacatagcaagtggcttcatgaggtgattgattatttagcttaagtgtggagtgagacatgactgctgttgcatctcattgcttctctgggcttgataattaaggggtggttggggggggctcacattcttcagattaaaggtttcttggccaggagcagtggctcacgcctgtaatgccagcactttgggaggccgagggggatggatcacgaggtcaagagatcgagaccatcctggccaacatggtgaaaccctgtctgtactaaaaatacaaaaattagcggggcatggtggtttgtgcctgcaatctcagctacttgggaggctgaggcaggagaatcgcttgaacccgggaggcagaggttgtggtgagctgagattgtgccactgcactccagcctgatgacagagtaagactccatctcaaaaaaagaaaaaaaaaaaatacaaaattagacgggcgtggtggcgtgtgcctgtaatcccagctacttgggaggctgaggcaggagaatcgcttgaacctgggaggcgaagtttgcagtgagccgagatcacaccattacactccagcctgggcaacaagagcgaaactctgtctcaaaataaataaataaagtaaaagaaagaaagaaataaaaataaaagcttcttttctttcttatgtcctagtgttttgtgggagaacttaagagtgatgaaatagaatatttggtggatgaagtcactgaacaaagtggtgagggggtggcatggcttctcttgacggcttatagtaaaatgtgagaagagagaaacaaactaaatacagaatttaaagccaaaaggaaagcagaacttaagcatttggaagattctcagcatggccacgttgtaaagaatgaaaaagtaggctgggcacaatggcttacgcctgtaatcctagcactttaggaggttgaggcaggtggatcacttgagctcaggagttcaagaccagcctgggcaacatggtgcaaccctgtctctacaaaaaattagccgggcatggtggcatgtgcctgtggtcccagcttctcaagaggctgaggtgggaggatcacttgaacctgggagattgaggctgcagtgagctgaaattgcaccagtgcactccagcctgggtgacagagcgagagcctgtctcaaaaagaaaaaaaaagaataaatgtatttggagagaatatgaaaggtgtggccaagccatcctttgataaggagactagtatggatgtggaagccaggtactaatcaagacaatggaaggatgaccccgaaggcatgtgggggctgtcacccccatcacaggcccagaaggcccagggtgttgggggcagaaccatttcaaggctctgttcctagcattctggggcagtgctccttggcagcccgaggtagtttggcagcatccacatggcgctgtctttgctggtgcacagaatacacaagctgtaggggcatggctacccccacctagattgtaaaggatgccctgaagagccttgggcccaggcagagaactgacacagggtaaggcccctgcagaaagtccccattagggcattgcctagcagagctatgggggtagggttgcctctgagaccccagactggtagagccaccagtgtgcaactccagcctgggagagccacaggcatgcaactccaacaagtgagggctgttgcatgggctgtgcccagcaaacctgtacaggcagggctgcccagagcccagcaacatgtccctgccagtgtgtccagaaggtaggaggacatagagttgaagaaggttgttcagaaaccttgagattgaatggggtttgctctgttgggttttggacttacctgggacctattacccctttcttctttgttgtttctctcttttagaatgtctgtcctatgcctgtcccaccgttgtattttacaagcacataacacgtttgatttcacaggctcacagatggtggggaatttgccccaggatgaattgtactttgagtctcacccatacctgattgattgattgatttttttaaattttatttatttatttatttatttatttatttatttatttatttatttagcgagagagtgagcctcactctgtcacccaggctggagtgcactggtgggatctcggctcactgcaacctctgcctcccaggtttaagtgattctcctgcctcagcttcctgagtagctgaattacaggtgcctgccatcatgcccagctaatttttgtatttttagtagagacagggtttcaccatgttggccaggctggtcttgaactcctgacctcaagtgattcgcccaccttggtttcccagagtgtgggattacaggcatgatacaccacacccagccacccatatctgatttagatgatagatgagactctggactttagacttttgagttgatgctagaatgagtttctatttggggccattggggtggactgaatgtattttgcaagtaaaaaggacatgacttttgggggttcaggagccaaatgctgtggtctgagtgtttgtgttcccctaaaattcatatgttgaaacttgatccccaacatggtggggcctttgggaagtgattaggctgtgaggattccactctcaagaatggggttagcgcccttatgaaagaggcctgagggacttgtgttgccccttctgccatgttgagaatgcagtgagaaggcaccatctttgaagcggagagcgatgccgaatctactggggcctggatcttgtactttccggccttcagaactgtgagcaataaatttctgttgttggccaggcatggtggctcacgcctgtaatctcagcacattgggaagccgaggcaggtggatcacctgaggtcaggagttcgagaccagcctggccaacaaagcaaaaccccgtctctactaaaaatacaaaattagctgggcgtggtggcagacacctgtaatcccagctacttgggaggttgaggcaggagaatcgcttgaaccagggaggtggaagtttcagtgagccaagatcacgccactgcactccagcctggcgacagaactagactccgccttaaaaaaaaaaaaaaaaaagattctgaatctttgggaagccctctgggctggggatcgatttgggagtcagtaccatgtggttcatagttgacgcggtagcttgcagaagccaaggaaagcctacgctttcaaaaaaagtttggaagagtcaatgtaaggaaatccaaagtggacctaactgtggagatgggggtcagggaaggagagagctggggtgtgaagtagtgaaaattagaaaagtgcctgctaagtccctgacgctactaatgagtggtgattgattgatgaaagcagagatttccgttcttgcctgagagcttctagtctgttggggaagaaaagatacaccaatagcagctggctagaaggccagtttcttctttttttatttttatttttattttttgagacggagtctcgcactgttgcccggactggagtgcagtggcacaatctcggctcactgcaagctctgcctcccgggttcacgccattctgcctcagcctcccgagtagctgggaccacaggcacccaccaccacgcccggctaatttttagtatttttagtggagatggggtttcactgtgttagccaggattgtctcaatctcctgaccttgtgatccacctgcctcagcctccctaagtgctgggattacaggcgtgagccactgcgcccggcccttttgtatttttcttgagacggagctcttgttgcccaggctggagtgcagtggcacgatctcggctcactgcaacatccgcctgctgggttcaagcagctctcctgcctcagcctccgagtagctgggattacaggcaccggccaccacgcctggctaacttttgtattttcagtagatacagggtttcaccatgttggccaggctggtctcaaactcctgacctcaggtaatccgcctgcctcggcttcccaaagtgctggtattacaggcgtgagccactgcgcccggtagaaggccagtttctaaaggcgtgttgcagagtccatgtcagttctaggaagaatcaagcaagagaaaagtgtgcttctttaggactggtcaggcaagcgcagccttgagccagaagggaaagggctttgcaggtaggagtgggcaggcagcaagatcgtgtgtctgagacagtgtagagggaacaggccagaaggaatgtcagctgagccggggaggtgtcgctgggtatgatccagtgctagagcctgtctctcgctgcgcctgcctcctctcacacagccccctcttctgtccctggcttctcagcatgaaactccccccagccacgtgttcacattcctccgtgtcactttcctccattcagcaccccccataccccttcttgctcgctggcctcccagctgtactcccagacagagtaacctacatttgcttcctgcatttgcctccccctcctgtgtgttggcttctgtctcttccacggaaaatgttttccccaaggtcctcagtgacttcctcagctttgggagacccctctgagtcctcttctgtggcatttggtgctgtttatcatcccttctgtgactttcttttgacggatgtacagattgggagatggcactacacagctgggaagtgggggtgaggacctgggggggtgtaagagatagccaggctccagcccagaggaggagctggaggtgggtggccggcgaactgccaggagggaggccctgaagccagaggagaagggagtagcatcatgtcaagatcagtaggccacatcggaagcagcagagagggccctcacgcttcccctgcaggggctgttgactctcttgatgagagactgatgaggacagagctagagaagtgggttggaaagtgaagtggggacaaggaagcagcaccggatccctgcacaatttagggaagaagttttgccgtgaagaggaacagaggtgggggcctctaaaggggtttggaagctcttttgtgttttttcaggatgaactctcctcaatcatgcttgttcactggtagaggagaaaggattcgctgacagtcggaggggagatggagttcagaacacaaatgaagactgtttttccctctttagggtgaaggcagaggtgacaggcattgctatacagagcttgtagttttgatggtgggcataaagtctctggcttcccttccgagtgaagtaggaacctcagatatcagctaataggacccaggcctgggtctgagggcagtatcaaggatattgaggagagaggaggtttgaagtgtgctaagggaaggctaaccagatgacttggccacgtggttgcagcacctctcgctgtttgtgacagtgctgtgtaaagtaaaaccccctgtccagtggtggggctgttaatagggctcaggtgcgggcatgtgcaaggcgggccattggttttgttacgggtggaaggtatctgagttaccagcagcaaatctgtacgggtttgcagcaatctcacttcttgcctgttaagaattcgacttgggcacaaggcaggaaaagaccgaggcaagtttcagagcaggagtggaagttcattaagaagctttggaacaggaaagaaaggagaagtacacttgaaggagacccacgtgggtgctgaggtccagtgcggtgtttaaccttgatcctaggacattctaggaccaaggctggcccttttcccatgattcttccctcacggcgagctgcccgcatgcacagtgtgctccttacccttgggaggtgggcacatacacagtgtgtaggaagttgtacggatgcccatctgaggctttcttcactgttctggtgatgtgccctgggaggccatgctctgccatttggtctcttaatgtgcatgctcaggaaggtgcgtctccttggtgtctgcattcaattaacacttcagtgcatcaagtgtggaccgtcaggaaatggcctctccctggcacctagtgggtgggggagagccctctcctgccctgctcctgcctgtccaactccctataacagtttcagccaggattcctgctttagcaggagagaataaccctttctatgccaagccacaccttccctgatctggccactgagcttgcatcttctgtccacaccttcactttctttgttatggctcactggggttctttcctttttcctcacttagcagatagtctctagcctcatcagttcccaagactttagcaacagcctgcatgctgatcatgctcagatttatccacttccaatctgtgatctaaactccacttttattcttttgtgtggttttaactaatgcaactagggagactaaagcaacttcatcctgtattctaattcaccgtgttcacttctgattaattccagttctggaaaggactccaagatttccagtttgtctattgttccttgtgtaagagtacatacttaccataaatcctgccatggggtcacaccatcttgatgttatcatacttcagttgtccagtgcatcccttctgaaccaccctttccctatggtatacaagccctgggggtactggcaccaggatccaccatctggcttcaccaccacctgagacacagatgtagcttctgttcctaggtctctaaatgtttctaaggggatatgttcttctctatatgacaatgcattgtgtaaagctgtggtggtaaaaacagtgtcgtacatgtgggacaacacagatcaatatcacaagcagctaaaagaaaaagaaattggtcttcataaaaattaaaaacatgtgcttccaaggacacaactcaagacaactggctggacacggtggctcacacctataagcccagcactttgggaggccaaggcgggtggatcacttgaggttgagagtttgagaccagcctggtcaacatggtgaaaccctgtctctactaaaagaaatacaaaaattagctgggctttgtggtgcgtgccttgtaatcccagctactcaggaggctgaggcaggaaaattgcttgaagccgggaggcagaggttgcagtgagctgagattgagtcactgcactccagcttgggtggcagagtgagactccgtctcaaaacaaacaagcaaacaaaaaagacaaataaccaaactttaaaatggtaatatatacagatggccaacagcatatgaaaagatactcaatgccattaaccgttagggacacacaaatcaaaaccacaatgagactctacttcagactcactaggatggctgtaatcaaaaagagagaggccaggcatggtggctcacacgtgtaatcccagcattttgggaggccaaggcaggaggattggttgagctcaggaattcgacaccagcctgggcaacatagtgtgaccctgcctctgccaaaaataaaaatgacagagagagacaatagcatgtgttggcgcaaatgcagagtgggaatgcacattgcaggtgggaatgtaaaatggtcacccagttggaaacagcatgcagctcctcagaaggttaaacagagtttatgtttaatacacttattaagataaacatagtgtaaatacgttaaaaaaaacacattattaattctcatagatatgtacccagaaatgaaaacatgtcatgaatacaaagaaggaaacaacagacactgggcggggagggtaggaggagggagaagcgggaaagataaccatcgggtactgggcataatacctgggtgatgaaattatctgtacaacagacccccatgacacatatttacctatgcaacaaaccttcacatgtatccccaaaacctaaaattaaaattaaaaaagaagggccgggcgcagtggctcacacctgtaatcccagcactttgggaggtcaaggcaggtggatcacctaaggtcaggagtttgagaccagcctggccaacgtggtgaaaccccatctctactaaaaatacaaaaagtagccagcgtggtgatgggtgcctgtaatcccagctacttgggaggctgaggcaggagaattgcttgaacgagagaggcagagattgcagtgagccgagatcacaccactgcactccaagttgggcaacaaggctagaatctgtcccaaaaaagaaaaacaaagaaaacgtgcccacacaaaaacctgtacacaacgctcatagcagcattattcataatagccaaaaaaatagacgtaacccaatgtccatcagttcatgaactgacatgtaaaatatgatatagcaaaacaatggagttattcagcaataaaagcacaggcctggcatggtggctcacgcctgtaatcccagcactttgggaggctgaggcaggtggatcacccgaggtcaggcgtatcacccaaggtcagacattcgagaccggcctggctaacatgtcgaaaccccgtctctactaagaatacagaaattagccgggcgtggtggtgggcgcctatagtcccagctacttgggaggcaggagaaacacttgaacccgggaggcggaggttgcagtgagccaacatcgtgccattgcactccagcctcggtgacacagcgagactctgtctcattaaaaaagaaaaaaaaaagtgcagactacataaatctaaagagacagaaagtaaattaatatttgcctgggggtggggtggccatgtaccatgtatttaaagtgtgcaattcattggtttttagtatattcagagttgtgcaaccatcagcacaattttagaacattttcaacacctggccaaaaaaaaaaaacaaaaaaacccatactcattaatagtcgctgtcctttctctcccaacccttccccacccagctttctatggattcggctattctggatatttcacgtaaatggaaacacaattatgtggtcttctgtgattgcagcttctttcacttagcataatgttttcaaggttcatccatgtcatagcgtgtctcagtacttcatttctttttactgtcaagtaatattccactgtatggataatatcacactttatgcattcgtgtagtttctctacctccttcccaactcttgtctcttttttattgtaggtgtgaagtggtgtcttcagtagttttgacttgcatttcccaatggctaatgatacggagcatcttgtcatgtgcttggtgatcatttatatgtcttctttggagaactgtctattcagatcatttttgtatatgggctgagatagggaaccagattcattcttttacatgtggatattcagttgtcccagtaccatttgttgaaaagattattctttccccactaatttgtcttgacacccttgttgaaaattagtcgaccatttctggtttctcagttctattccattgaactagatgtctttgcttacaacatcttgattactgtagctttctttttttaaagttaaaaaatttataaagtagaagtggggctcaggctcgtctggtggcctaggctcgtctggacccctggctgcaagtgatcctcccgcctcagcctcccaaagtgctgggattacaggcgtgagcctctggggcctggccacaattgagttttgtttattgatctcgtatcctgcaactttgctatgagttctaaccttgtcttagtcctaatagttgtttaatggattccttagggttttctatatacaaggtcatgtcatctgcaaatagaaatagttgtacttcttcctttccaatgtggatgccttttatttcatcttattgcctcattgccctggcgagagcctccagaacaatgttgactagaaatgacaagggcccatgctcatcttgttcctgacttaggggaaagcttttaatctttcgcctttaagtctgatgttcgttgtgggtttttcatagatgcccttcatcaggttgaggaggttaccctctattcctagtttgtatgttattatacttttaaatagcagcagcagagcatgtaagaagatatgaataaatacatggcgagaggttcgcagttgattaagtggggggaagagtttactccattcatcgtgaatctgatctctgtgagtaggaggatgtgttagttgaacaactttaaaaaaaaaaaaaaaaaagagggcgaggtgggtggatcacgaggtcaggagtttgagaccagcctggccaagatggtgaaaccccgtctctactaaaaatacaaaaaattagccaggcaaggtggcgggtgcctgtaatcccagctactctggaggctgaggcaggtgaatcgcttgaacccaggatgccgaggttgcagtgagcagagatcgcaccgctgcactctagcctgggcgacagagcaagactctatctcaaaaaataaataaataaaaaataaaaatagagacagggtcttgctgtattgtccaggctgatctcgagctcctggactcaaaccatcctcctaccttcgcctcccaaagtgctgggattacaggtgttagtcactgcccccagcttgaacaaactttgtaagatgcaggctattgtgcaaaattttagcactgtaaaaaatatccccttattttatcaaatatacctttatcttgaggcatatgtctattttcacctacttgtaacttacactcttgattacttttggttgtctttttactcttgttctaattatctttttttttttttttttttgagacggagtctcactctgtcgccaggctggagtgcagtggcgtgatctcggcgcactgcaacctccatctcccgggttcaagcaattctcctgcctcagcttcctgagtagctgggactacaggtgcccaccaccatgcccagctaatttttgtatttttagtagagacaaggtttcaccatgttggccaggatggtcttgatctcttgacctcatgatctgccctcctcggcctcccaaagtgctgggattacaggcatgagccaccacgcccggccctaattatcttttattgtacagaagcattttattttcatcagagtacattcatcttgattgagatattttacagtagtttctctccccatgctggctgggcgtggtggctcacgcctgtaatcccagcactgtgggagactgaagcaagcagatcacctgaggtcaggagtttgagaccagcctggccaacatggtgaaaccccatctctactaaaaatacaaaaattagctggacatggtggcacacacctgtaatctcagctactcaggaggctgaggcaggagaattgcttgaacctgggaggcagagattgcagtgagccaagatcacaccactgcactccagcctaggtgacagggcaagactcccgtctcaaaaaaaaaaaaattatcttcccactatagtaagaaagtaacagcgttttatgacttggaaagtgtcttcatataaaatcttatttgaatctcccaaaatatagcagagatgatccccattttacagattaaaatatggataccagaaatgtttgaatcatttgtcaggatattggcagcagagcaggggctaagggcatgctatctttttaaggcacttcatattaatttttgtatttatatacaaaaattatacactccttgactccttgacttcgtcgaacatatgacattcaaacatatcaatagggtggaggagaatccaaggatagcttgccactgtattcatttcttatggctgccataacaagttactgcaagctgggtggcttaagacaagagaaatttattccatcacagttctaggggccataattccaaaatcaagatgtcagcttggttccaaagacaagggattgttgcttcttggaggcttagacggggccgttactccgcgcatctctcccggctggatgggtggctgccggcagtccttggcatcccctggcttgcagctgtccaagtccagtcgctgcttctgtctgcacctggctgtgtgtctggattaagggcacaccctattccactatgacttcatcttagtgacatcttaaatacttctccaaagaccctaattccaaacaaggtgacattacaggtaccatggttaggactacaatgtatctttttattattactatcttttaaagggatagggtgtcacactgtcatgtaggctggagtgcaatggcacgatcgtagctcatgcagcctcaaccccctagggcctagcgatccactcaccttagcttctcgaatagctgggactacagatgtgtgccactatgccgggctaagtttttaatttttttgtaaagacggggtctccgtgttgcccaggctggtcttgaactcctggcctcaagcaatcctcccgccttggcctcccaaagtgctgggattacagcatgagcctccaggcctaatgtatcttttgagggggcacagttcagcccacagcagccactaacagagttctcttctgtcctcgctcccccaccaggtgcccctgtagacaatggccctcgtgtctgccgattcccgcattgcagaacttctcacagagctccatcagctgatcaaacaaacccaggtaaaaagtcaccaccctccattcccagatgggaacatgggctttgatgctgagccgtgaagtgggggtggcatttgtgttcagagagattggactcgcaggaaccaaaatgacgtaataaaagtgaaaggaggggaatttggtgtatggctaccattcctgttggattttctaccatgtacaggatttcatgattcattttgtttgacagctatcctgagatagaattcacatgccatacaacgcacccatttaaagtgtataatccagtggtttttcgcagctcacaaaattgtgcaaccattagcacgatcaatttcagaacatttttaacacccaacaaaaatgccccatatcttttccttccaccctattaatccaggcaaacaaaaacactcttttttttttggagacggagtctcactgtgtcacctaggctggagtgcggtggcgcgatctcagctcactgcaacctctgcctcctgggttcaagcgattcttctgcctcagtctccctagtagctgggattacaggcacacaccaccatgtccggctaattgtttttgtatttttagtagagacggggttttgccatgttggctgtctctactaaaaatacaaaaattagctaggcttggtggcggatgcctataatcccagctactggggaggctgaggcaggagaatcacttgaactcgggaggcagaggttgcagtgagccgagatggcgccactgcactccagcctgggtgacaaagcaagactccatctcaaaaaaaaaaaaagccatttttcccctatttgatatcttttctttcacagatacaagggagatgcgtattggtgcctgtagctcactgcaggctatcgggcatgctctgccacattttgcccacgatactcagggtttatagctacacaaggatcagtttgctggcagttgtgcaccgcacagccaggaaggagtagatcccagaaattccttcccaaatggtattccttttagacgtaacctggagagtaagagtcagaagatgccggcactcattgctaagtgaaagatgccagtctgaaaggttacgtgctgtgtattccaactgtaaacgaaaagcaaaactagagagtgaaaggatgagcggtagccagggccttgggagagataggatgaaagggatggataggtggagcacagaggattttagggggtggaactcttctgcagggtaccatgatggggggcacgcaacatgatgcgttgtccaaacccatagaacggcagaacacacagagtaaaccatcatggggatggatgtagttaattatctaacagtattggctcatcagttgttacaaacgcaccactctaatgcaagatgttaacaataggggagactgcgcagggcagagcaggtatacatacaggaactctgtgccatcagctcagcttttctgtaaaccaaaactgctctaagaagagtttatcaataaaatacattgtaaaataaaggaaaaaagggctgggcgtggtaactcatgcctgtaatcccagcatgttgggaggctgaggcgggtggatcacctgaggtcaggagtttgagaccagtctggccaaatggcgaaactccatctctactaaaaattagccgggcgtggtggtacatgcttgtaatcccagctactagggaggctgaggcaggagaatcgcttgaacctgggaagtggaggttgcagtgagccaagatcgcaccactgcactccagcctgggcgacaagagcgaaactccgtctcaaaaaaataaataaaggaaaaaaaagatacaggcagattacgcattccattcagtcatccacagttagaacagtttatcatcatcccatacaaccagggtgtccctcagacagctgctgccgagttcccagactcccatctcacccgtcagcttccaaaagcaggcgtggtcctgacagacacagggcttcgccctttcaggcacccagtgtaactgacctaagagatggcattctctctctctcagcctctcttgaggtatgagtacaatattggatttccctcattgcataacccatttaatttgttctgttaactcggctactgtttctcctctccatttgtgattggttttcacccaaacttttccacctttgtaagggatgttagctttggccactgtacctggtccagattgcagcggcagcagtactagtctagcaagtatccccccccaaccccaatccattcccatttatatagggtggggttacacaggtatggactattggctgtcttgagcactaggcagctagctagctgtgttcactgttaacctcattttgcaggttgaggtaaaggcgcaacccacccatcaggcacttaaaaattctcacataaaggctaaaaagcatagtcataatttctttcttaggatctgtctcagtttccagcatctgcagttgcagctctgctcccaggatgactgatatgggaggaattgcaccagcattcttccccaccccttcttctccacatcaattgatcatacctgtatgtgtctatttctggactctgaattctgttctgttgatctatatgccagtaccacaccatcgtgattaccgtagcttcgtaataaattttgaaattgggaagtatgagttctccaactttttttttctttttccaagattggggataatctgggtcccgtgaatttccatatgaattttaggatgaacttgtcaatttctgcaaagaagtcaattagaattttgatggggattgcgttgactgtatagattgatttgtctctttgataaaggactatcattaaagatatcacttatgatttaactttaatgccttcttttttttttttttttaacagtctcactctgtcacccaggctggagtgcagtgacatgatctcagctcactgcaacctcagcctcccgagtagctaggactatacgcacatgctacaatgcccggctaatttttgtatttttagtagaggtggggtttcatcatgttggccaggctggtcttgaactcctgatctcaagtgatctgcccactttggccttccaaagtgctgggattacaggcttaagccactgcaccaggccctttaaggccttttataatgcttttgcattagtcaaaggagaaaatcatcttgaactcctgaatttggatttagaaaatgagggccatagccgggcgcccttgcctgtaattccagcactttgggaaaccgaggcaggtggatcacgaggtcaggagttcaagaccagcctggccaagatggcgaaaccctgtctctactaaaaatacaaaaaattaggccgggcgcattggcttacgcctgtaatcccagcactttgggaggccgaggcaggcggatcacgaggtcaggagatcgagaccatcctggctaagacggtgaaactccgtctcttctaaaactacaaaaaattaaccaggcgtggtggcgggcgcctgtagtcccagctactcgggaggctgaggcaggagaaaggcgtgaacccgggaggcggagcttgcagtgagccgagatcgtgccactacactccagcctgggcgacagagtgagactccatctcaaaaaaaaaaaaaaaaaaagaaaatgagggccgtattttggggatggggactctggcctggctggcagggtaccacagcagcacaaagggccaccgtcatgtcctgctgctcttttccttacaggaagagcgttcgcggagcgaacacaacttagtgaacatccagaagacccatgagcggatgcagacagagaacaagagtgagtagctgggctcaggagagaaaggggatgagatggggctagggtgagtatggccaagactgtgaccgaggtggtcattgtattcaaaatagatttgcatgtatctgcatattccaaaatgcagcaggagggacagctttccgttaatctgggtgacctgaagaactaaaatccctctactctgaggattcgaaaggcagtgaaatgaggctgtatctagggaagcttgcccttagagcacacaagcgccccagttagctggtgttttctagaaaggagcttccttcccaggcggcccctgcatctgccctgaggccctcaggtggtgagatcctggggctggggctttcttactctgggtaactctgagaattgtgttttcctgggtcctgacaaatattttctgtgagtgtcatgatggagaaaaggtaagacagtactctcgcagatgtagggatggcatttgtaccatatggaaatgcggactcatggagcctgggggcatccgcctcaggagcactcctgagccagcagagctctgactgcagctacggcctctctgtgcctccacgagtgtgattccggtgcatggaagcagtgccatgctactgtgcctgccctggccctgcctccttatccctgtgtttcctctgcagtttctccctattaccggacaaagctgcgtggcctctacacaaccgccaaggccgatgcagaggctgagtgcaagtgagtaccgtgcacccacttcatcgccgctccctcctttcctgggggctgggctgcaggtccatttggaccaagtccccagcctgccttcctcccatggataagctgattgctactcccagcctctcgcttgggtcccgcattccctggcccactgccaggcccactcttccagttacctctgctgctaatgcctttacagaaggtggcaaggcgtgagtcaacactgccgtttactggctctatgaccttggcagagtcattaaaatagggatatcaggggctgggtagctcagatctgtaatcacaacattacagaggtgattgggaggccgaggttagaggatcacttgaacgcaggtgtttgagaccagcctgggcaacaaagtgagactttgtctctacaaaaagtttttaattagctgagcgtggtggcatgtgtctgtaagcttggctgggaagtcatactcagatgacctgaaggttttatggttctgagatggagaagtttcacttccagaaaactcctgcttttaaaataatcttaaggccgggcaggcacagtggctcatgcctgcaatcgcaaggtgggtggatcacctgaggttgggggtttgagaccagcctggctagcatagcgaaaccctatatctactaaaaatacaaaaattagccaggtgtggtggcgcacgctacttgggaggctgaggcaggaggcggaggttgcagtgagctaagatcgtgccactgcactccagcctgggcaacagagcaaggctctgcctcaaaaaaaaaaaaaaaactaaaataaaaaaatgatctggaaacactgtttccttgaatctctgcaggagattcaggaacttgaacattacattcctctactttgagaacacactggttctgaagtctgactgtgcccagaggctctgtttatttggggtggagctccaacattggtattaactatctgacatttcctcactagtaggattcatgctttacacttttggcacagaagaggtgtctctggtgggtcatattagacggcacaggatgctgtctgtgccattggttaaagtggtattttccacgtttctcttgtatcagattactgctattttccattgtgtgattgatcgattaagacagggtctcagtctgtcatccaggctggagtggagtggcgtaatcatggctcacttcagcctcaaactcctggcctcaagtgatcctcctgcctcagcctcctgagtagctgggacaataggcacctgccaccactccacctaatttttgtattttttgtagagaggggttttgccatgttgcccaggctggtcttgaactcctcagctcaagcgatccacccaccttggcctcccaaagtgctgggattacaggtgtgagcctctgcacctggcctccattgcataattaataagtgtcttgggagatacttttgagactgtaactatcctgttcatatcaaacacactagttttagcatccatttatgatttgtgcgtgaaacaattgagattttttaaacttcccccaggagattctgatgcccaccaaggtttgaaagccacttcagtaacatgtcacagaagacagtttaggacaggctgtataaaactgtatcctccacacaggcctggcaacagtgatgagactctcagagttccctttggccccgtggctctttctccttctctgctttctggggtcccggtgctcacagcctgaggtggcactggctgggccatccctgcattgtacgcagcaggcaagctgttccttgtccctgcgttggtttggctgcccttggcctacctccatcttctggccctggcctggtgaggtccatgagtcacatgccctggggcacccccggacacctcccgagatgctgcatcacacccagttcctgtgcatctccttcctgccgcacaaaggtctttagaactccgggtcatttcagaaaggcttgccagaggaatggactggggtttgccatggtatcagaggaaaataaaatgacccaaagtggagtttgtgctgctgactactgtggaaatacgtattttttttgaaatggagtttcgctctgtcacccaggctggagtgcagtgacacaatctcggctcactgcaagctctgcccccaaggttcaagcgattctcttgcctcagcctcccaagtagctgggattatagacgcccgccaccacgccgggctaatttttgtatttttagtagagaaggagtttctctatgttggccaggctggtgtcgatctcctgacctcaagtgatcctcctgcctcagcctcctaaagtgctgagattacaggcgtgagccaccacacccatccctgctgtggaaatactctttgggaagattccctgagctttaggatgaaggagcctcactccagccaagttctgtgtttgcttctgctgggttctttgggttcctgccaccctggaatccccataaactaacttcacagaggcttcctggggcttcaaggccatgcaggggtctgtctttgggttcagcctttcagaaaggatgaggtccttccacccagttctgctctgggccagcacctctccccagagtctcccctccttttgtgtgaccctcgggcagacctgaggccccctctcctcatttcaggaggttcctgcagcctttctgcagggtttgccgaaggcagtttgcctgtgtcctttcctctctgggatcctgtgttctcttagtttttggcatgctgctttctaccaccttgttttttatgttcttaagactaaaagacacatactgaagatttccagttttctttttttttttgaaatggagtttcgttctttttgcccaggttggagtgcaatgacgcgatctcggttcactgcaacctctgcctcccaggttcaagcgattctcttgcctcagcctcccaagtaggtgggattacagttaaagacgctcgccaccacacctggctaagttttgtatttttaatacagacggggtttcaccatattggtcaggctggtcttgaactcctgacctcaggtgatccacactcctcggcctcccaaagtgctgggattacaggcgtgaaccaccacacccgggcagatttctagtttcaccatgaggttggtctgaataacccagcccaccttgaccagaacaggaacctgcacacacctgtcattccacctgcgcaggaggctactgtgagaacctctggagtccgggaccagcctgggcaatgtagcttgacccaaaacagaaaaaatggaagagaagtctatgctatgtacgttaaccaaaccctctttctcccttctccccgccctcagcatccttcggaaagctctggacaagatcgcggaaatcaagtctctgttggaagagaggcggattggtgagtgggagagaacatgctgggaggtcctttgctaggacaagaggagaggccctgcgggcagcagtcaccctcctgtgggggcctgtggccaccacctgctggcatcctcccatggaggctctggcagactggctctaccactgagaagggacaggaggtcattcccagtgcccagaggcaggggtttcccagttctccctcagcagccagagatcatcccgccctggcccctcatctcctgccccttctggggcctgggccagtcgccccctcctctgccatggcccatgcccatctgttgccctggctggtttctgcagagccacacgctgtgtgtcgtaaagccagccttccagaccccctcagcctgcattaggctctcctacctgtctgccctcccaacaatcccatggtgggcagaatcttggcatgtcagtgtccccacacagccatgctggttctgtgtgaagtcaagtggggtgtccagctgtgcctgaggaggttgaaggtgcacatttaattttttttttggtttttttaactttctgttgaattacaatgtatattaatagaagaaaagtacacataagtgcagagttcaatgaaatagtcactaactgaacacacttctgtaaccagcattcagatcagcaaacacagcctgaacagcaccttggaacccgctttctttcttctggttcctccccctggatccccgctgtgctgccatctcacccaactgtagttaaacccagcagcccctataggtgctgacacatggccgatggggtcacagtcctgctgggccctcgggctcactcgggaactgggggctcccaggtgctccttcaacagctcagtgcagcatgctcgggggtcaaggccggcacctatccctggggcctcaggcctcccttccttcccacagcggccaagattgccggtctctacaatgactcggagccaccccggaagaccatgcgcagaggggtgctgatgaccctgctgcagcagtcggccatgaccctgcccctgtggatcgggaagcctggtgacaagtgagggcagcagctgcgagggaggggctggtgcccaggggctgggactgaccctttgttccactcacaggcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtgagtgacaccaaccctggggctgctctctggtcaccgaacttgcctgggctacgggagaaaagctctgcagagggtgctccccagaggctggttgtgcagggagcaccaggtcctcccccatcctcactccccaacaggtactgcgcccctggctgcatccagccttttcctccttttgtctgcaggtatgaggtagatgacatcgatgaagaaggcaaagagtgagtgtccaggccagggcagggcatggagcctgggggcagcctaacagctgagaaggagcatccccacccggccacaggttgatataagcccctcttcccccaggagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcgggtaaagcagcctccaggggagaggccatgggtgatgtcaggaacaggctgatcagacagacgaggggtcctctccccactccttccctttgtcctcatctcacaggctccaagctgacaggacccaccagctgccctccctcttccactccagccccaaaggccaccatccctttgccagccctggcagccttggcaagccccgagtcagtggcttccagccccaggagaaccagctccgagatgggaagctcctgccctgagccctgggctcctaccgccttgtgctcttggtgacatgggacacaagccacctgaggccaggatccctgcctgccaccctctgggttgccctcagtcctctcaacaaagagtccttgaaaggcagcagaccctccagctatgaccccactaggaagggagtcagcacccctactcctccctgcctattccctgccttgggtctccagccactgagaaaagagctctgtagcagcagggactgggccaagacttcttgaccccagagtgaaggatgttaggagtggctgagagtccacggcccagagcctcctgtggtctaggctgggggaagggggtgcctgtcctggcctgggggtctctgagcagcccctcctgtctgcctgccccacagccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctc

SEQ ID NO: 38807 - DNA, 38357 bp, Homo sapiens; identical to SEQ ID NO: 38723

SEQ ID NO: 38808 - DNA, 3539 bp, Homo sapiens
agtcatgatcaccgagaccgcggcggagcctacggtccctgcagtgcctgctgctgaggaggccaccgaagctcggggacgcgaggagccggcgtggccctgggtgagcccaggcccaagcgggaacgggcgcggggcgggcggcgcagacccaggggcgcgggcttcatgccccagccgtgccccctgtcccgcagaaagacgccccgatccggacgctggtgcagcgcatccaccagctgcaggctgagcgcgcgcagggcttccgccgactggaggagtgagtgggggcgcggaggggctcagggttcggtcccccgcccgctccgggcgtgggcgtgttctcggcgggcgtgcctggaggaggagctgggtccttgtgtggctgcagagtcagatggggcggggatttcggggcaccgggtcctcaccttcacgaaaaaggccccacagcacgtccccactacccgacgactcactcttcgtggcttctctctcctccccaagagcaggggtgggcctgtctcgcgttcccctgcgggagtcaggaagcgtccttcctacctaccagtcctcccctctggtgtctggggacacttcctgggggcctttcaggtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtgaggccaccaccccttccccgccgtgtctctaggaccctggccggctcctctcatgacgcacccctggttggggggtggtcccagtatcccatacacagacctcaccccttcctgtcccaccccaatcctctattaaggcttcacttggggattctcggaccttgccctctgctgttcatccccaatttttttcccaagttttgtccttattcccagagcactcccgctttctcccagctccgcctaaatgctattccaagatgcccagatcccgccccaacaatgctccacccactctggttgttccgcgtctagggtcccaccctcaacctcccgtagatacaggcgaggggggtcccaggccacgcctcctccgtattattcctccatcacagctttagttctttgcctatttctctcttgcgatccgcctgctcggccctgcaaccgtgtgtgactggaattcctaggccacgccccccatgagcgacccgtctcagcgtctctttggcctttttctttctggtgttttttttttttttttttttttttaagacaggctcttgctctcttgctctctcacccaggctagagtgcaatggcgcgatctcggctaacggcaacctccgcctcccagattcaagcgattctcctgcctcagcctcctgagtagctgggattacaggcataatttttgtattttgtattttttttagtagagacggggttgtgccatatgggcaaggctggtctcgaactcctggtctcaagcgatccgccctcttctgcttcccgaagtgctgggatttcaggcgtgagccaccgcgtccaggctttttggcctacttttatcctgggtccccgtccctgggaccatgaggcgcaacctaacccacccctacggccaatgcctggctaagacgtcactgttgttcccaggccacgcccacatcgcgctcagcactgcctctggcctgcctgctgtctcctttctgagagagcctctaaactgaatttcggactcttcctacacaaagcactgcccctcgtggttctacccgggcactgcctttctgggtgcctctgttttttcctgaacatccttggagggcagggggtgggttctgctcgtggagacatccttcgtgttgctcattcccccaccaggtggccctgctgcagttgatggagacgccagagctggcggggcaggaggacgctgtacggatgcagcagctgaaaatgaagtgagcgctgctgcccaagccgcctggctatgctcgatttgcaccagggttggcacggtcaggacgctgccagcagaggaaccctctgccagtgcacaatggtgttctcacctggtggccctcagatgtacacttccccagagggcacagccgtgaaacttcacatcagtttcgctgtgcattgctgggacactgctgtatacctcgacacatgccaatcctgcacacgtggctgtccgtggagcttggacatgccccactgagcacagaccttcagatgcctgtcctcagcccccaagcacacacactcatgtacacacacatttgacaaagtcacacttcataacctcctaatggtacacaccccaccaagatggccttttcttttcttttttttctgagatgcagtctcactctgtcaccaggctggagtgcagtggcgcgatctcagctcactgcaacctccgcctcccgggttcaagtgattcccctgcctcagcctcctgagtagctgggactacaggcgcgtgccaccacgcccagctaattttttgtattttagtagagatgggtttcaccatgttggccaggatggtctcgatctcctgacctcgtgatctgcccacctcagcctcccaaagtgctgggattacaggcgtaagccagcacgcctggtcctttattttcttttcttttttctttcttttttttgagatagagtcttgctctgtcacccaggctggagtgcagtggtgcggtcttggcttaccgtaacctctgcctcctaagtagcttggattacagatgcccgccaccatgcctggctaattcttgtatttttagtagagacggggattcgccatgttggccaggcttgttttgaactcctgacctcaggtgatctgcctgcctcagcttcccaaagtgctggattacaggcgtgagccaccatgcccagcccagatggccttttctctcagcccactgtgacctatggggccaccccttctccctagcacctaagtgttccctcttgctgctagtgctgcctggaggtttggcggcgggcaggagggcctggggctcaccacagccacagccctcttgcagcttcgcggcagcagctaattcaccccatctgggttttatttatagttcccatccgctcttgtagggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgt

SEQ ID NO: 38809 - DNA, 5005 bp, Homo sapiens; identical to SEQ ID NO: 38727

SEQ ID NO: 38810 - DNA, 11682 bp, Homo sapiens; identical to SEQ ID NO: 38463

SEQ ID NO: 38811 - DNA, 85815 bp, Homo sapiens; identical to SEQ ID NO: 38726

SEQ ID NO: 38812 - DNA, 510254 bp, Homo sapiens; identical to SEQ ID NO: 38492

SEQ ID NO: 38813 - DNA, 5616 bp, Homo sapiens; identical to SEQ ID NO: 38675

SEQ ID NO: 38814 - DNA, 2029 bp, Homo sapiens; identical to SEQ ID NO: 38429

SEQ ID NO: 38815 - DNA, 1760 bp, Homo sapiens; identical to SEQ ID NO: 38676

SEQ ID NO: 38816 - DNA, 16015 bp, Homo sapiens; identical to SEQ ID NO: 38494

SEQ ID NO: 38817 - DNA, 10882 bp, Homo sapiens; identical to SEQ ID NO: 38514

SEQ ID NO: 38818 - DNA, 6286 bp, Homo sapiens
ccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggtaaggagaactgggtttatgctcacagagactttgggaattgaaaggatcacagtttggtcacagctgttcatttctgacatgaccttgcacagatcccctcacttctgggttcgctggtcagtaaaacggggcaatggtgatgagtgttgcgggcatcagcaggtgcacagctggtggagcacagcctgaagaatctgtgcctgcactcacagcccagtcccaggacagcgggctttgctgccccattgcccattacttagccaagtcgatctccatgaaactctcagggagtaaggctgaactgatcctctcatcagtgggacagatgggagaactgaagctcccagagggtgataggctttcccccatctcccctagcatgccggggcattcttctcaattttaccctcctaatttctcctgtcccagaccagccagacacgtaccatgtctcagacaagcctgggagctgaggatggattcttagggctccccagggcaaatgtgggatattttcccaccccaggagcctcatgttccaaacaagacccctgagtggaccttgtcttgtgactttcaacttctgaaaactaccccatgctcccccagatgccccacatttttcctatgacaccctgccggacgcacaccaaaccgcaaaacacatgattccaatacctggaaatacatgggctggggcagatgggtgaaggagatacttatgaacaaggaagacaagaagtggtttgatcttttctaaaatagtatggaagaggctgctttcttgtaatttgctaaaataagctcttctcatggtaaaatcaggttcatgcaattttcaaatcggaatgtgcattttgttcatttgcttcacccttttccctgagccagaccctcccaccagcttgccagaggctgctactgtcttgcttgcacactgccttccaatctctcatgaactttggtctcttttgtgggacgattagtaaaatttttcctttggagaagacgcctgtcttcattctcaattcctccacttttgtctgccctgtagaccaacacgtatcacattccttcaagcctacggtgtgtccaccacgctctattcagttcttttataatcttctccatgactcattttagcattgccatcagtatcctttctgactcacctgtgaacactttgttatttgtgaatatctgccaaaaaatgtattcctcaatgcagcctgatccactcagaaagcttggattgggagagctattgttgctggtcattggctaacataacatagtttgactggcttttgtgacaggcaattggctgttttaaaagaaaagacctcaattcagagaaactcctgccaccagcaattttatttttgaataaccttttataagaaatgcactcaagattttgcaataaaattctgtgtgttggttttagggtaggcttctagctgtccaattaatttgtctcctgaccagggagtggcagcattgtacacatgttccaagaggtttgttgacttttttggaaaagtctctttttccacctgtggaatcaaggacaatacacagcaaaaggagccatttcctgatgctagctccattgtaaatatgtgacctttggcaggtcatttaatgctcagtttccttgcattttaatagaaattttaagatcagttttgatcacatcacagggaatttgagagagcaattaaaataagaaggatgaaataactttgaaaattataaatgtattcacagaggcttattacaattatgatgttcataatcaatatcattaccactgtcatcttgacccttaccacatcattatgttgattccaaacctcagaaaacgtcatctaaagtagagaggatgtcagggaactggtgctattttagcaaaagccagaagcataatttaccagagacgagaacagggtgtgggagagaggaaaatgttcttctctgggcttaagaaaaagaaagaaaggagagaggggagggtaaagaggaaaggaggaagaaaagaaagaagggaaagggagggaggcaggaagctgtcttaatacattctgataatataaaaatagatttcttgacctaaagaaggccaagaaaatccactgaatgaatagaaaaatgtggaaaagatagaaatcacagaagttattaaaaattgaagtttataaattaccaaaatagcaaataaaccatgaaaactgtttttaatttaatgataatcagtaaaatgtaagtttaagccaattaagacatccttatttatgcccataaggatgacaggaaattaaaagtgtaatattactaagtgcctgtgaagatttggggacttcttataaatgggtggtgcaaataggagttaactcaactccctgggagtcatatttggcaataaccagtcacgtggaaaatgtacatccccaatactgttgcacaatgctggaaacccggagcaggcaatgagttgttcttgaattcggcctgaagttgattctttctcttcaatcacctcactacctcctctccaccaaccgtcagggtgggaaagcggtcataccggtccccctataccatttcctctcacgtcagttcttcgtgtccctgatccccacttccatcctcccactggacagtaccttgtaatttcctctccgccgctggaatgtccatttgacacaaagactttctgggactggaagtttccactacttcaaataaaccaatcttatttacagcaaggcaatttttttttctctattctggtaagtttgttactttaatttcaatttttttaatgcctactctttgttccatagaagaatgctttctccatttcatgcctttctggttgggggagataatcaactgatttgcttcaaaatatttcctgattttctgtaagttgaggggagggaagtaatcgtgcactattttagcataacctaacatctaacatcacctgctttgtttaaagttatttacagatgtttcaaagtaaagtatgagttagaaaattagggatggaaatggctcatttgagaatgattattcttagatgtctgaattgaggtgccctcaggctctaccagctcccaaacgtacatctgctttttatccttttcctgtttttattccaggagagaatgggaggattccagaggggcaaatatggaactatggctgaaggtaagaaagtcttgaagttctcaagagccccagacacttgggagaatcacaattctctccccatctacccccatctaaaacacagtggcagaaacccattcattttaaatgaagaagataaaggcaactatcatcacgtgtgtgttatcaaaccatcacacacacacacagacacacacacacaccatagtgtgatgctctccctgcatcaggtatgtgggaaatgtggaaaggaaaccaagtcataggttgaagggtctggaagcaaatggtgaatatgttttctctttctttgtctgctgacagctcaaaaagaaaaggtccccatagggatttagtcattgtgcttgctacaaaacaccacagaataacttaagaaaacgaagaaccaacccagagtgggagaaataaaataatagatttttaagagcctaaaatgcacttcgaattcatttgggctctagaaatccacaggttctcccctcttcgtgcctgaagattttcgctcctgccacagtgtcaccctctccaacaccacttctgctataattttgtgtgcttcaatcagccacatagatgagcttttcaacacacatgcttctattgagcttatcttccacctttttgagccatccaccctagggtcatctcccagacgctgccctaacattaactacaacctatgtcatctcaatttcaaacatttcactccctatccagagggcacagacccagggacaggcagctgacccccggcagtgggtcactatagatttgccagtggagacctccttgaccctcaagacttggatgaatgtgtggagtgtgtctatacaagtgtgcctggaaatgtgtgggtgaaagagaagtaattggattttctcacttgtaactactaatcccctgcctctttctaataattctccatggagctggcctaaacaccacgcaggggaaaacacaaggaccattttctttcaggaaagctctatttgccacaatccagatgaagtgcttaaagcatccccttaatgcaacagttctaattcctggctgtggatccaagcatgggcttccaatggggctttctacatgcaagattcacctatagttgtatgcacacttttatgtacacataaatatgtctgtcattctggggaggacgttcatagctttcatgagataaccatgaacaatgacctaacagtcttaagaatcattaacttagtaagatacaaaacttcgttttctacaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccacatt

SEQ ID NO: 38819 - DNA, 10266 bp, Homo sapiens; identical to SEQ ID NO: 38387

SEQ ID NO: 38820 - DNA, 14645 bp, Homo sapiens; identical to SEQ ID NO: 38331
